United States Patent
Kwok et al.

(10) Patent No.: US 11,174,491 B2
(45) Date of Patent: Nov. 16, 2021

(54) MODULATING LIGHT RESPONSE PATHWAYS IN PLANTS, INCREASING LIGHT-RELATED TOLERANCES IN PLANTS, AND INCREASING BIOMASS IN PLANTS

(71) Applicant: Ceres, Inc., Thousand Oaks, CA (US)

(72) Inventors: Shing Kwok, Alexandria, VA (US); Kenneth Bounds, Tarzana, CA (US); Ryan Miller, Sacramento, CA (US); Sam Harris, Newbury Park, CA (US); James Burns, Valley Village, CA (US); Roger I. Pennell, Malibu, CA (US); Vijay Sharma, Wildwood, MO (US); Michael F. Portereiko, Thousand Oaks, CA (US); Han-Suk Kim, Pinole, CA (US); Gerard Magpantay, Woodland Hills, CA (US)

(73) Assignee: Ceres, Inc., Thousand Oaks, CA (US)

( * ) Notice: Subject to any disclaimer, the term of this patent is extended or adjusted under 35 U.S.C. 154(b) by 41 days.

(21) Appl. No.: 16/045,503

(22) Filed: Jul. 25, 2018

(65) Prior Publication Data

US 2019/0055571 A1 Feb. 21, 2019
US 2021/0214735 A9 Jul. 15, 2021

Related U.S. Application Data

(60) Division of application No. 13/630,902, filed on Sep. 28, 2012, now abandoned, which is a continuation-in-part of application No. 12/863,102, filed as application No. PCT/US2009/031292 on Jan. 16, 2009, now abandoned, said application No. 13/630,902 is a continuation-in-part of application No. 12/373,134, filed as application No. PCT/US2007/073154 on Jul. 10, 2007, now abandoned, said application No. 13/630,902 is a continuation-in-part of application No. 12/513,086, filed as application No. PCT/US2007/083495 on Nov. 2, 2007, now abandoned, said application No. 13/630,902 is a continuation-in-part of application No. 12/515,687, filed as application No. PCT/US2007/085237 on Nov. 20, 2007, now abandoned, said application No. 13/630,902 is a continuation-in-part of application No. 12/307,561, filed as application No. PCT/US2007/072877 on Jul. 5, 2007, now Pat. No. 8,344,210, said application No. 13/630,902 is a continuation-in-part of application No. 13/119,572, filed as application No. PCT/US2009/057116 on Sep. 16, 2009, now abandoned.

(60) Provisional application No. 61/021,943, filed on Jan. 18, 2008, provisional application No. 60/819,763, filed on Jul. 10, 2006, provisional application No. 60/856,613, filed on Nov. 3, 2006, provisional application No. 60/860,145, filed on Nov. 20, 2006, provisional application No. 60/818,569, filed on Jul. 5, 2006, provisional application No. 61/097,789, filed on Sep. 17, 2008.

(51) Int. Cl.
*C12N 15/82* (2006.01)
*C07K 14/415* (2006.01)

(52) U.S. Cl.
CPC ........ *C12N 15/8271* (2013.01); *C07K 14/415* (2013.01); *C12N 15/82* (2013.01); *C12N 15/8261* (2013.01); *Y02A 40/146* (2018.01)

(58) Field of Classification Search
None
See application file for complete search history.

(56) References Cited

U.S. PATENT DOCUMENTS

| | | |
|---|---|---|
| 4,987,071 A | 1/1991 | Cech et al. |
| 5,034,323 A | 7/1991 | Jorgensen et al. |
| 5,204,253 A | 4/1993 | Sanford et al. |
| 5,231,020 A | 7/1993 | Jorgensen et al. |
| 5,254,678 A | 10/1993 | Haseloff et al. |
| 5,538,880 A | 7/1996 | Lundquist et al. |
| 5,766,847 A | 6/1998 | Jackle et al. |
| 5,878,215 A | 3/1999 | Kling et al. |
| 6,013,863 A | 1/2000 | Lundquist et al. |
| 6,326,527 B1 | 12/2001 | Kirihara et al. |

(Continued)

FOREIGN PATENT DOCUMENTS

| | | |
|---|---|---|
| EP | 0 534 858 | 3/1993 |
| WO | WO 97/01952 | 1/1997 |

(Continued)

OTHER PUBLICATIONS

Jiang et al. Assessment of low light tolerance of seashore paspalum and bermudagrass. Crop Science. 2004. 44:587-594.*

(Continued)

*Primary Examiner* — Ashley K Buran
(74) *Attorney, Agent, or Firm* — Dentons US LLP

(57) ABSTRACT

Methods and materials for modulating low light and/or shade tolerance, and red light specific responses in plants are disclosed. For example, nucleic acids encoding low light and/or SD+EODFR-tolerance polypeptides are disclosed as well as methods for using such nucleic acids to transform plant cells. Also disclosed are plants having increased low light and/or SD+EODFR tolerance. In addition, methods and materials involved in increasing UV-B tolerance in plants and methods and materials involved in modulating biomass levels in plants are provided.

5 Claims, 79 Drawing Sheets
Specification includes a Sequence Listing.

(56) References Cited

U.S. PATENT DOCUMENTS

| | | | |
|---|---|---|---|
| 6,329,571 B1 | 12/2001 | Hiei | |
| 6,423,885 B1 | 7/2002 | Waterhouse et al. | |
| 6,452,067 B1 | 9/2002 | Bedbrook et al. | |
| 6,573,099 B2 | 6/2003 | Graham | |
| 6,753,139 B1 | 6/2004 | Baulcombe et al. | |
| 6,777,588 B2 | 8/2004 | Waterhouse et al. | |
| 6,906,244 B2 | 6/2005 | Fischer et al. | |
| 7,173,121 B2 | 2/2007 | Fang | |
| 7,214,789 B2 | 5/2007 | Pennell | |
| 7,265,263 B1* | 9/2007 | Hannapel | C07K 14/415 800/278 |
| 7,312,376 B2 | 12/2007 | Apuya et al. | |
| 7,378,571 B2 | 5/2008 | Apuya et al. | |
| 7,402,667 B2 | 7/2008 | Cook et al. | |
| 7,429,692 B2 | 9/2008 | Dang | |
| 7,445,654 B2 | 11/2008 | Wong | |
| 7,598,367 B2 | 10/2009 | Cook et al. | |
| 8,344,210 B2 | 1/2013 | Kwok et al. | |
| 2003/0175783 A1 | 9/2003 | Waterhouse et al. | |
| 2003/0175965 A1 | 9/2003 | Lowe et al. | |
| 2003/0180945 A1 | 9/2003 | Wang et al. | |
| 2004/0214330 A1 | 10/2004 | Waterhouse et al. | |
| 2005/0009187 A1* | 1/2005 | Shinozaki | C07K 14/415 435/468 |
| 2005/0032221 A1 | 2/2005 | Chang et al. | |
| 2005/0160493 A9* | 7/2005 | Ratcliffe | C07K 14/415 800/281 |
| 2006/0021083 A1 | 1/2006 | Cook et al. | |
| 2006/0021088 A1 | 1/2006 | Inze et al. | |
| 2006/0041952 A1 | 2/2006 | Cook | |
| 2006/0260004 A1 | 11/2006 | Fang et al. | |
| 2006/0265788 A1 | 11/2006 | Rommens | |
| 2006/0272060 A1* | 11/2006 | Heard | C12N 15/8273 800/289 |
| 2007/0006335 A1 | 1/2007 | Cook et al. | |
| 2007/0033671 A1* | 2/2007 | Jiang | C12N 15/827 800/278 |
| 2007/0056058 A1 | 3/2007 | Olivier et al. | |
| 2009/0094717 A1 | 4/2009 | Troukhan et al. | |
| 2010/0119688 A1 | 5/2010 | Kwok et al. | |
| 2010/0192261 A1 | 7/2010 | Kwok et al. | |
| 2010/0199378 A1 | 8/2010 | Kwok et al. | |
| 2010/0205688 A1 | 8/2010 | Kwok et al. | |
| 2011/0214199 A1* | 9/2011 | Coffin | C12N 15/1079 800/275 |
| 2013/0014292 A1 | 1/2013 | Pennell et al. | |
| 2013/0117886 A1 | 5/2013 | Troukhan et al. | |

FOREIGN PATENT DOCUMENTS

| | | |
|---|---|---|
| WO | WO 98/36083 | 8/1998 |
| WO | WO 98/53083 | 11/1998 |
| WO | WO 99/32619 | 7/1999 |
| WO | WO 02/046449 | 6/2002 |
| WO | WO 05/011105 | 2/2005 |
| WO | WO 05/023639 | 3/2005 |
| WO | WO 05/034308 | 4/2005 |
| WO | WO 05/034343 | 4/2005 |
| WO | WO 2005/098007 | 10/2005 |
| WO | WO 2006/034479 | 3/2006 |
| WO | WO 06/038236 | 4/2006 |
| WO | WO 06/040572 | 4/2006 |
| WO | WO 2006/036864 | 4/2006 |
| WO | WO 2007/044988 | 4/2007 |
| WO | WO 2007/055826 | 5/2007 |
| WO | WO 07/062762 | 6/2007 |
| WO | WO 2007/0072877 | 6/2007 |
| WO | WO 2007/083495 | 7/2007 |
| WO | WO 2007/085237 | 8/2007 |
| WO | WO 07/103956 | 9/2007 |
| WO | WO 2007/120989 | 10/2007 |
| WO | WO 2008/008779 | 1/2008 |
| WO | WO 2009/057116 | 5/2009 |
| WO | WO 2009/092009 | 7/2009 |
| WO | WO 2010/033564 | 3/2010 |

OTHER PUBLICATIONS

Smith et al. The shade avoidance syndrome: multiple responses mediated by multiple phytochromes. Plant, Cell, and Environment. 1997. 20:840-844.*
Genbank Accession No. NM_001036413. *Arabidopsis thaliana* BLH1 (BEL1-like homeodomain 1) AT2G35940 (BLH1) transcript variant AT2G35940.3 mRNA, complete cds. Published Nov. 3, 2005. pp. 1-2.*
GenBank Accession No. AAK43836. BEL1-like homeodomain 1 [*Arabidopsis thaliana*]. Published Apr. 30, 2001. pp. 1.*
U.S. Appl. No. 60/505,689, Cook et al.
U.S. Appl. No. 60/518,075, Pennell et al.
U.S. Appl. No. 60/544,771, Cook et al.
U.S. Appl. No. 60/558,869, Cook et al.
U.S. Appl. No. 60/583,609, Alexandrov.
U.S. Appl. No. 60/583,691, Alexandrov et al.
U.S. Appl. No. 60/612,891, Kwok.
U.S. Appl. No. 60/637,140, Feldman.
U.S. Appl. No. 60/757,544, Dang.
U.S. Appl. No. 60/766,307, Kwok.
U.S. Appl. No. 61/097,789, Pennell.
Abler et al. "Isolation and characterization of a genomic sequence encoding the maize Cat3 catalase gene" *Plant Mol. Biol.*, 22:1031-1038 (1993).
Akashi et al., "Gene discovery by ribozyme and siRNA libraries," *Nature Reviews Mol. Cell Biology*, 2005, 6:413-422.
Alonso-Blanco et al., "The use of recombinant inbred lines (RILs) for genetic mapping," In *Methods in Molecular Biology* (J.M. Martinez-Zapater and J. Salinas, Humana Press, Totowa, NJ., 1998), 2: 137-146.
Baerson et al., "Developmental regulation of an acyl carrier protein gene promoter in vegetative and reproductive tissues" *Plant Mol. Biol.*, 22(2):255-267 (1993).
Bateman et al., "Pfam 3.1: 1313 multiple alignments and profile HMMs match the majority of proteins" *Nucl. Acids Res.*, 27(1):260-262 (1999).
Bechtold et al., "In planta Agrobacterium mediated gene transfer by infiltration of adult *Arabidopsis thaliana* plants" *C.R. Acad. Sci. Paris*, 316:1194-1199 (1993).
Burr et al., "Gene mapping with recombinant inbreds in maize," *Genetics*, 1988, 118:519-526.
Burr et al., "Mapping Genes with Recombinant Inbreds," In Freeling and Walbot (Ed.), *The Maize Handbook*, (New York, Springer-Verlag, 1994), pp. 249-254.
Bustos et al., "Regulation of b-glucuronidase expression in transgenic tobacco plants by an A/T-rich, cis-acting sequence found upstream of a French bean b-phaseolin gene" *Plant Cell*, 1(9):839-854.
Cerdan and Chory, "Regulation of flowering time by light quality," *Nature*, 2003, 423:881-885.
Cerdan et al., "A 146 bp fragment of the tobacco Lhcb1 *2 promoter confers very-low-fluence, low-fluence and high-irradiance responses of phytochrom to a minimal CaMV 35S promoter" *Plant Mol. Biol.*, 33:245-255 (1997).
Chen et al., "Functional analysis of regulatory elements in a plant embryo-specific gene" *Proc. Natl. Acad. Sci. USA*, 83:8560-8564 (1986).
Chenna et al., "Multiple sequence alignment with the Clustal series of programs" *Nucleic Acids Res.*, 31(13):3497-3500 (2003).
Conceicao, "A cotyledon regulatory region is responsible for the different spatial expression patterns of *Arabidopsis* 2S albumin genes" *The Plant Journal*, 1994, 5(4):493-505.
Conkling et al. "Isolation of transcriptionally regulated root-specific genes from tobacco" *Plant Physiol.*, 93:1203-1211, (1990).
Dai et al., "RF2b, a rice bZIP transcription activator, interacts with RF2a and is involved in symptom development of rice tungro disease" *Proc. Natl. Acad. Sci. USA*, 101 (2):687-692 (2004).

(56) References Cited

OTHER PUBLICATIONS

De FEYTER et al., Methods in Molecular Biology, vol. 74, Chapter 43, "Expressing Ribozymes in Plants", Edited by Turner, P.C., *Humana Press Inc.*, Totowa, NJ, 1997, pp. 403-415.
Do et al., "ProbCons: Probabilistic consistency-based multiple sequence alignment," *Genome Res.*, 2005, 15(2): 330-340.
Durbin et al., "3-Markov chains and hidden Markov models; 4-Pairwise alignment using HMMS; 5-Profile HMMs for sequence families" In Biological Sequence Analysis: Probabilistic Models of Proteins and Nucleic Acids, (Cambridge University Press, Cambridge, UK, 1998), pp. 47-134.
Fejes et al., "A 268 bp upstream sequence mediates the circadian clock-regulated transcription of the wheat Cab-1 gene in transgenic plants" *Plant Mol. Biol.*, 15:921-932 (1990).
Fromm et al., "An octopine synthase enhancer element directs tissue-specific expression and binds ASF-1, a factor from tobacco nuclear extracts" *The Plant Cell*, 1:977-984 (1989).
Gardiner et al., "Development of a core RFLP map in maize using an immortalized F2 population," *Genetics*, 1993, 134: 917-930.
GenBank Accession No. AF096096, dated Jan. 25, 1999, 2 pages.
GenBank Accession No. AF129516, dated Apr. 6, 1999, 2 pages.
GenBank Accession No. L05934, dated Oct. 22, 1993, 3 pages.
GenBank Accession No. U93215, dated Feb. 27, 2002, 42 pages.
Green et al., "Binding site requirements for pea nuclear protein factor GT-1 correlate with sequences required for light-dependent transcriptional activation of the rbcS-3A gene" *EMBO J.*, 7:4035-4044.
Guerois, Raphael, "Predicting Changes in the Stability of Proteins and Protein Complexes: A Study of More Than 1000 Mutations," J. Mol. Biol. (2002) 320, 369-387.
Hong et al., "Promoter sequences from two different *Brassica napus* tapetal oleosin-like genes direct tapetal expression of β-glucuronidase in transgenic *Brassica* plants" *Plant Mol Biol.*, 1997. 34(3):549-555.
Hwang et al., "Aleurone- and embryo-specific expression of the β-glucuronidase gene controlled by the barley Chi26 and Ltp1 promoters in transgenic rice" *Plant Cell Rep.* 20(7):647-654 (2001).
Hyrup et al., Peptide nucleic acids (PNA): synthesis, properties and potential applications *Bioorgan. Med. Chem.*, 4:5-23 (1996).
Jordano et al., "A sunflower helianthinin gene upstream sequence ensemble contains an enhancer and sites of nuclear protein interaction" *Plant Cell*, 1:855-866 (1989).
Kasuga et al., "Improving plant drought, salt, and freezing tolerance by gene transfer of a single stress-inducible transcription factor," *Nature Biotech*, 1999, 17: 287-291.
Kebrom et al., "The molecular analysis of the shade avoidance syndrome in the grasses has begun," *J. Exp. Bot.*, 2007, 58: 3079-3089.
Keller et al., "Vascular-specific expression of the bean GRP 1.8 gene is negatively regulated" *Plant Cell*, 3(10):1051-1061 (1991).
Kumar, Prateek, et al., "Predicting the effects of coding non-synonymous variants on protein function using the SIFT algorithm," Nature Publishing Group, vol. 4, No. 8, 2009, pp. 1073-1082.
Lam et al., "Site-specific mutations in alter in vitro factor binding and change promoter expression pattern in transgenic plants" *Proc. Natl. Acad. Sci.* USA, 86:7890-7894 (1989).
Luan et al., "A rice cab gene promoter contains separate cis-acting elements that regulate expression in dicot and monocot plants" *The Plant Cell*, 4:971-981 (1992).
Lubberstedt et al., "Promoters from genes for plastid proteins possess regions with different sensitivities toward red and blue light" *Plant Physiol.*, 104:997-1006 (1994).
Matsuoka et al., "Tissue-specific light-regulated expression directed by the promoter of a C4 gene, maize pyruvate, orthophosphate dikinase, in a C3 plant, rice" *Proc. Natl. Acad. Sci.* USA, 90:9586-9590 (1993).
Matzke et al., "RNAi-mediated pathways in the nucleus," *Nature Reviews Genetics*, 2005, 6:24-35.

Medberry et al., "The Commelina yellow mottle virus promoter is a strong promoter in vascular and reproductive tissues" *Plant Cell*, 4(2):185-192 (1992).
Meier et al., "Elicitor-inducible and constitutive in vivo DNA footprints indicate novel cis-acting elements in the promoter of a parsley gene encoding pathogenesis-related protein 1" *Plant Cell*, 3:309-316 (1991).
Mittal, "Improving the efficiency of RNA interference in mammals," Nature Reviews *Genetics*, 2004, 5: 355-365.
Nature reviews RNA interference collection' [online]. Nature publishing group, 2005, [retrieved on Apr. 12, 2012]. Retrieved from the Internet: <URL: ttp://www.nature.com/focus/rnai/index.html>, 2 pages.
Ng, Pauline C., et al., "Predicting the Effects off Amino Acid Substitutions on Protein Function," Annu. Rev. Genomics Hum. Genet. 2006, pp. 61-80.
Parks et al., "Sequential and coordinated action of phytochromes A and B during *Arabidopsis* stem growth revealed by kinetic analysis," *Proc. Natl. Acad. Sci.*, 1999, 96:14142-14146.
Perriman et al., "Effective ribozyme delivery in plant cells" Proc. Natl. Acad. Sci. USA, 92(13):6175-6179 (1995).
Refseth et al., "Hybridization capture of microsatellites directly from genomic DNA" *Electrophoresis*, 18:1519-1523 (1997).
Reva, Boris, et al., "Predicting the functional impact of protein mutations: application to cancer genomics," Nucleic Acids Research, 2011, vol. 39, No. 17, pp. 1-14.
Riggs et al., "Cotyledon nuclear proteins bind to DNA fragments harboring regulatory elements of phytohemagglutinin genes" *Plant Cell*, 1(6):609-621 (1989).
Rivera et al., "Genomic evidence for two functionally distinct gene classes" Proc. Natl. Acad. Sci. USA,95:6239-6244 (1998).
Sandhya, Sankaran, "CUSP: an algorithm to distinguish structurally conserved and unconserved regions in protein domain alignments and its application in the study of large length variations," BioMed Central, May 2008, pp. 1-14.
Sheridan, "The mac1 Gene: Controlling the commitment to the meiotic pathway in Maize" *Genetics*, 142:1009-1020 (1996).
Slocombe et al., "Temporal and tissue-specific regulation of a *Brassica napus* stearoyl-acyl carrier protein desaturase gene" *Plant Physiol.*, 104(4):1167-1176 (1994).
Sonnhammer et al., "Pfam: A comprehensive database of protein domain families based on seed alignments" *Proteins*, 28:405-420 (1997).
Sonnhammer et al., "Pfam: multiple sequence alignments and HMM-profiles of protein domains" *Nucl. Acids Res.*, 26:320-322 (1998).
Summerton et al., "Morpholino antisense oligomers: design, preparation, and properties" *Antisense Nucleic Acid Drug Dev.*, 7:187-195 (1997).
Truernit et al., "The promoter of the *Arabidopsis thaliana* SUC2 sucrose-H+ symporter gene directs expression of β-glucuronidase to the phloem: Evidence for phloem loading and unloading by SUC2" *Planta*. 196:564-570 (1995).
Urao et al. "Molecular cloning and characterization of a gene that encodes a MYC-related protein in *Arabidopsis*" *Plant Mol. Biol.*, 32:571-576 (1996).
Wagner et al., "Overexpression of phytochrome B induces a short hypocotyl phenotype in transgenic *Arabidopsis*," *Plant Cell*, 1991,3: 1275-1288.
Yamamoto et al., "The promoter of a pine photosynthetic gene allows expression of a βglucuronidase reporter gene in transgenic rice plants in a light-independent but tissue-specific manner" *Plant Cell Physiol.*, 1994, 35:773-778.
Yan et al., "New construct approaches for efficient gene silencing in plants," *Plant Physiology*, 2006,141: 1508-1518.
Zhang et al., "DNA sequences that activate isocitrate lyase gene expression during late embryogenesis and during postgerminative growth," *Plant Physiology*, 110:1069-1079 (1996).
Zheng et al., "SPK1 Is an Essential S-Phase-Specific Gene of *Saccharomyces cerevisiae* that encodes a nuclear serine/threonine/tyrosine kinase" *Mol. Cell Biol.*, 1993, 13:5829-5842.
International Preliminary Report on Patentability in PCT/US2009/031292 dated Jul. 20, 2010, 5 pages.

(56) References Cited

OTHER PUBLICATIONS

International Search Report and Written Opinion in International Application No. PCT/US2009/031292, dated Sep. 1, 2009, 8 pages.
Tiwari et al., The flowering time regulator CONSTANS is recruited to the Flowering Locus T promoter via a unique cis-elememt. *New Phytologist*. 2010. 187:57-66.
GenBank Accession No. NP_5683001.1. Unknown Protein. Published Apr. 24, 2008. pp. 1 -2.
GenBank Accession No. NP_5683001.1. CCT motif family protein. Published May 26, 2011. pp. 1-2.

* cited by examiner

| SEQ ID NO | Sequence | | | | | Length |
|---|---|---|---|---|---|---|
| SEQ-ID-NO-93 | MGKYMKKSKV | --TN------ | ---------- | TEPTEP---- | --TSLGVRTR | 28 |
| SEQ-ID-NO-70 | MGKYIRKSKI | DGAGAGAGGG | GGGGGGGESS | ND-ALMDVVSPS | SSSSLGVLTR | 50 |
| SEQ-ID-NO-80 | --MRKAKT-- | --TN------ | ---------- | ---LTVVDL-- | ---SCGVRTR | 22 |
| SEQ-ID-NO-99 | MGKYIRKTRK | -TE------- | ---------- | ---VL------ | --SPLGVLTR | 22 |
| SEQ-ID-NO-72 | MGKYIRKAKT | -AG------- | ---------- | D--VAVMEL-- | SQAAPLGVRTR | 29 |
| SEQ-ID-NO-105 | MGKYMRKPKV | -SG------- | ---------- | E--VAVMEV-- | AAAPLGVRTR | 29 |
| SEQ-ID-NO-119 | MGKYMRKGKV | -SG------- | ---------- | E--VAVMEV-P | CGALLGVRTR | 29 |
| SEQ-ID-NO-115 | MGKYMRKCKV | -SG------- | ---------- | E--VAVMEV-P | CGALLGVRTR | 30 |
| SEQ-ID-NO-103 | MGKYMRKGKV | -SG------- | ---------- | E--VAVMEV-P | CGALLGVRTR | 30 |
| SEQ-ID-NO-109 | MGKYMRKGKV | -SG------- | ---------- | E--VAVMEV-A | MAASASSRKR | 30 |
| SEQ-ID-NO-96 | MAQVKARART | -AL------- | ---------- | D--VDLDVP-- | ---TTT-K | 23 |
| SEQ-ID-NO-101 | ---MEV---- | -SD------- | ---------- | ---------- | ---TTTTK | 17 |
| SEQ-ID-NO-102 | --MRKCKG-- | -IE------- | ---------- | E--VTIMEV-SD | VDLEVPTTTK | 27 |

| SEQ ID NO | Sequence | | | | | Length |
|---|---|---|---|---|---|---|
| SEQ-ID-NO-93 | AAKTLALK-- | ---------- | SSASDSALAG | DSS------- | KKKQQQMNDC | 52 |
| SEQ-ID-NO-70 | AKSLALQQQ- | QQRCLLQKPS | SPSSLPPTSA | SPNPPSKQKM | ---------- | 99 |
| SEQ-ID-NO-80 | AKTLALKKQ- | QA--LRLH-- | ASSASPPPPS | SPA------- | ---------- | 50 |
| SEQ-ID-NO-99 | AKALALN--- | -G-------- | ---------G | DGG------- | ---------- | 34 |
| SEQ-ID-NO-72 | AKTLALQ--- | RLQ------- | KSSTSSPPTV | VSAPATCDG- | ---------- | 58 |
| SEQ-ID-NO-105 | ARALAMQ--- | ROP------- | QGAAVAKDQG | ---------- | ---------- | 49 |
| SEQ-ID-NO-119 | SRTLALQ--- | R-T------- | TSSQKPPEKG | EGDPGAGAGA | GA-------- | 60 |
| SEQ-ID-NO-115 | SRTLALQ--- | R--------- | AQRPPDKG-- | EAGEAAG--- | ---------- | 53 |
| SEQ-ID-NO-103 | SRTLALQ--- | R--------- | AQRPLDKG-- | DAEDAAA--- | ---------- | 53 |
| SEQ-ID-NO-109 | SRTLALQ--- | R--------- | AQRPLDKG-- | DAEDAAA--- | ---------- | 53 |
| SEQ-ID-NO-96 | -RKISIN--- | -N-------- | ---------- | ---------- | ---------- | 30 |
| SEQ-ID-NO-101 | -KRKISSD-- | ---------- | ---------- | ---------- | ---------- | 24 |
| SEQ-ID-NO-102 | -KRKISSD-- | ---------- | ---------- | ---------- | ---------- | 34 |

Figure 2 (continued)

[Sequence alignment figure showing multiple protein sequences labeled SEQ-ID-NO-93, SEQ-ID-NO-70, SEQ-ID-NO-80, SEQ-ID-NO-99, SEQ-ID-NO-72, SEQ-ID-NO-105, SEQ-ID-NO-119, SEQ-ID-NO-115, SEQ-ID-NO-103, SEQ-ID-NO-109, SEQ-ID-NO-96, SEQ-ID-NO-101, and SEQ-ID-NO-102, with residue position numbers on the right.]

| | | | |
|---|---|---|---|
| SEQ-ID-NO-93 | PLT | GRYEWVQ | VSP | 207 |
| SEQ-ID-NO-70 | PLPG | RFEWTK | VDD | 289 |
| SEQ-ID-NO-80 | PLPG | RYEWEK | LDP | 240 |
| SEQ-ID-NO-99 | PLPG | RYEWVK | VNH | 210 |
| SEQ-ID-NO-72 | PLPG | RYQWEK | MDP | 258 |
| SEQ-ID-NO-105 | PLPG | RYEWVK | LD- | 190 |
| SEQ-ID-NO-119 | PLPG | RYEWTR | LDC | 221 |
| SEQ-ID-NO-115 | PLPG | RYEWTR | LGC | 206 |
| SEQ-ID-NO-103 | PLPG | RYEWAR | LDC | 213 |
| SEQ-ID-NO-109 | PLPG | RYEWAR | LGC | 212 |
| SEQ-ID-NO-96 | SLE | GRYEWVK | L-- | 180 |
| SEQ-ID-NO-101 | PSE | GRYEWVR | LGS | 156 |
| SEQ-ID-NO-102 | PLE | GRYEWVR | LGS | 163 |

Figure 3

| SEQ-ID-NO | Sequence | # |
|---|---|---|
| SEQ-ID-NO-129 | MGRGRSSSSS SIESSSKSNP FGASSSTRNL SL--TDLRLG LSFGTSS--- | 44 |
| SEQ-ID-NO-247 | -------MS PPLELDYICL SAAAGGRPDD DLKGTELRLG LP-GCESPDR | 41 |
| SEQ-ID-NO-302 | ---------- ----MSTDTGR SSTESEVSGL DYEETELKLG LP-GGSRTAG | 36 |
| SEQ-ID-NO-270 | ---------- ----MDGGVG- ---YA---DMD ALKATELRLG LP-GSHPPEK | 30 |
| SEQ-ID-NO-236 | ---------- ----MERTAT- ---YE----- NLKATELRLG LP-GI DEPEK | 30 |
| SEQ-ID-NO-137 | ---------- ------MV--- ---FE----- NLDATELRLG LP-ASSKESL | 26 |
| SEQ-ID-NO-300 | ---------- ------ME--- ---FE----- NLDATELRLG LP-GTATRQS | 26 |
| SEQ-ID-NO-303 | ---------- ------ME--- ---RDL---- NLEATELRLG LP-GTATQQL | 26 |
| SEQ-ID-NO-133 | ---------- ----MEGSVG- ---YD----- NLRATELRLG LP-GTEPVSI | 30 |
| SEQ-ID-NO-209 | ---------- ----MENSLGK ---YG----- NLEATELRLG LP-GSDEPEK | 31 |
| SEQ-ID-NO-201 | ---------- ------MEK-- ---DGL---- ELE-TELRLG LP-GRDVTEK | 25 |
| SEQ-ID-NO-231 | ---------- ------MAR-- ---EGL---- GLE-TELRLG LSCGEPK--- | 23 |
| SEQ-ID-NO-234 | ---------- ------MEK-- ---EDL---- GLE-TELRLG LP-GAGGENN | 25 |

| SEQ-ID-NO | Sequence | # |
|---|---|---|
| SEQ-ID-NO-129 | RPVAATTTLE LLPAKGAKRG ---------- ISAACGKGKEA -GTQYFNGGY | 53 |
| SEQ-ID-NO-247 | S--------- -ETEKKKRG FSDEVVPPAP ---------- SGDEKDKKVA | 91 |
| SEQ-ID-NO-302 | PLPTTTTT-- --ARPTKRS FAETVDLSLG AESRSGDLGD RSTCDFGSGA | 74 |
| SEQ-ID-NO-270 | QSSSASTSA- --KYSKKRT LDEDRAA--- ---------- RRETSEGGR | 61 |
| SEQ-ID-NO-236 | ---------- --RISNKRA SSEMD----- ---------- NSSSGKENE | 60 |
| SEQ-ID-NO-137 | EKQTPNSNL- --AKSNKRS LPDMNDDS-- ---------- GVAAAKKCD | 50 |
| SEQ-ID-NO-300 | EKQTPSSNV- --TKSNKRS LPDMNEDPAG SSRENSSTVS SNEEKSHDQ | 71 |
| SEQ-ID-NO-303 | ---------- --VRSNKRS LPDMNEDSAG RSESSSV--- SSNDKKSDE | 68 |
| SEQ-ID-NO-133 | RSA------- --VRSNKRS LQQVADDDCG VN-------- GCRSDDQNE | 58 |
| SEQ-ID-NO-209 | M--------- ---MKKRG SPEASEEECI SKGNMNSSD- GSDITSDDQ | 69 |
| SEQ-ID-NO-201 | ---------- --KNEKKRM FTEMI MTSSG SHSEQCESSV VSSGVDVEKV | 61 |
| SEQ-ID-NO-231 | ---------- ---NKNKKRV FSEIDG---- ---------- GVEENGGSG | 45 |
| SEQ-ID-NO-234 | TDKDK----- ---------- FSDIE----- ---------- GENSSSEED | 51 |

| SEQ-ID-NO | | | | | | |
|---|---|---|---|---|---|---|
| SEQ-ID-NO-129 | CNEKSHVLTY | ADKEGDWMMV | GDVPWEMFLS | TVRRLKISRA | NYHY------ | 175 |
| SEQ-ID-NO-247 | RKDGEYVMTY | EDKDGDWMLV | GDVPWEMFTE | ACRRIRVMKS | SDV-VGLGVT | 235 |
| SEQ-ID-NO-302 | VNGTEYVPTY | EDKDGDWMLV | GDVPWKMFVA | SCKRLRLMKS | SEAINLAPRT | 203 |
| SEQ-ID-NO-270 | CKGSEYALTY | EDKDGDLMLV | GDVPWEMFTS | SCKKLRI-RG | AEAIRGLGSS | 187 |
| SEQ-ID-NO-236 | YNGSDYAPTY | EDKDGDWMLY | GDVPWDMFLN | SCRRLRIMKG | SEA-KGLHAY | 193 |
| SEQ-ID-NO-137 | YNGSEFVPTY | EDKDGDWMLV | GDVPWEMFIN | ACKRLRIVRG | SEA-RGLGCV | 182 |
| SEQ-ID-NO-300 | YNGSEHVPTY | EDKDGDWMLV | GDVPWEMFIN | SCKRLRIMKE | SEA-RGLGCA | 203 |
| SEQ-ID-NO-303 | YNGSEYVPTY | EDKDGDWMLV | GDVPWEMFIN | SCKRLRIMKE | SEA-RGLGCA | 200 |
| SEQ-ID-NO-133 | YKGSDYAPTY | EDKDGDWMLV | GDVPWEMFIN | SCKRLRIMKG | SEA-RGLGCG | 189 |
| SEQ-ID-NO-209 | YNGSEYAPTY | EDKDGDWMLA | GDVPWEMFIT | SCKRLRIMKG | SEA-KGLGCF | 202 |
| SEQ-ID-NO-201 | GDNCEYVITY | EDKDGDWMLV | GDVPWNMFVS | SCRRVRIMKR | SEX-TGFGLX | 191 |
| SEQ-ID-NO-231 | AENCEHVPIY | EDKDGDWMLA | GDVPWGMFIE | SCKRLRIMKR | SDA-KGFDLQ | 170 |
| SEQ-ID-NO-234 | AENAEHVPIY | EDKDGDWMLV | GDVPWEMFRE | SCKRLRIMKR | SDA-KGFDLQ | 174 |

| SEQ-ID-NO | | | |
|---|---|---|---|
| SEQ-ID-NO-129 | ---------- | ---------- | 175 |
| SEQ-ID-NO-247 | RAGVKSKNKN | ---------- | 245 |
| SEQ-ID-NO-302 | PQGSTRAR-- | ---------- | 211 |
| SEQ-ID-NO-270 | Q--------- | ---------- | 188 |
| SEQ-ID-NO-236 | RL-------- | ---------- | 195 |
| SEQ-ID-NO-137 | V--------- | ---------- | 183 |
| SEQ-ID-NO-300 | V--------- | ---------- | 204 |
| SEQ-ID-NO-303 | V--------- | ---------- | 201 |
| SEQ-ID-NO-133 | V--------- | ---------- | 190 |
| SEQ-ID-NO-209 | ---------- | ---------- | 202 |
| SEQ-ID-NO-201 | PXGLDE---- | ---------- | 197 |
| SEQ-ID-NO-231 | PKGSLKRFI- | ---------- | 179 |
| SEQ-ID-NO-234 | PKGSLKGFIE | GVRK       | 188 |

Figure 4

| | | | | | | | |
|---|---|---|---|---|---|---|---|
| SEQ-ID-NO-319 | ME AGSE--GE | NNRISN---- | ---------- | ---------- | --PNKNISS | SNEGNAKPKR | 31 |
| SEQ-ID-NO-331 | MDDGDGAAPA | EGSAASTPPP | APPAAAAAAA | ---------- | AAVSAGSTGA | SGSGEKTVKR | 50 |
| SEQ-ID-NO-317 | M--------- | ---------- | ---------- | ---------- | ---------- | ---------- | 1 |
| SEQ-ID-NO-321 | MEESSEVHFG | ENRVSP---- | ---------- | ---------- | ---------- | EKNLKR---- | 22 |
| SEQ-ID-NO-327 | MEEVTELQSE | ENKLSM---- | ---------- | ---------- | ---------- | EKNKKR---- | 22 |
| SEQ-ID-NO-330 | MEESSELQPE | ENKVSA---- | ---------- | ---------- | ---------- | EKFPKR---- | 22 |

| | | | | | | | |
|---|---|---|---|---|---|---|---|
| SEQ-ID-NO-319 | QMKTPFQLEA | LEKAYALETY | PSEATRAELS | EKICLSDRQL | ---------- | QMWFCHRRLK | 81 |
| SEQ-ID-NO-331 | MMKSPYQLEV | LEKITYAVEQY | PSETLRAELS | AKIGLSDRQL | ---------- | QMWFCHRRLK | 100 |
| SEQ-ID-NO-317 | --------A- | LENFYNEHKY | PTEEMKGKLA | EVGLIEKQV | ---------- | SGWFCHRRLK | 42 |
| SEQ-ID-NO-321 | TVKTPAQVVA | LENFYNEHKY | PTEEMKSELA | DQIGLIEKQI | ---------- | SSWFCHRRLK | 72 |
| SEQ-ID-NO-327 | RLKTPAQLKA | LEDFYNDNKY | PTEEMKSELA | DELELTEKQI | ---------- | SGWFCHRRLK | 72 |
| SEQ-ID-NO-330 | KLKTPAQLKG | LEKFYTEHKY | PTEELKLA-A | EELELTEKQV | ---------- | SGWFCHRRLK | 72 |

| | | | | | | | |
|---|---|---|---|---|---|---|---|
| SEQ-ID-NO-319 | E--------- | KKDN------ | PTKKQRKGAA | LPPESPVDEL | RAVPGPDYGS | GSGCSGSSPYM | 126 |
| SEQ-ID-NO-331 | DRKPPTKRQR | REEEAAVPL | MAPPPVLPPP | ALPLSSGELL | IGASSPYDEP | 150 |
| SEQ-ID-NO-317 | D--------- | KRHV------ | KEDGNALGSQ | DRSSVLQDR | GSGLRQDSCG | STKQTDYWNP | 87 |
| SEQ-ID-NO-321 | D--------- | KRL------- | RDEVCTNGRQ | DRSSGIIQDR | GSGLRQDSCG | STKQGDYRNL | 116 |
| SEQ-ID-NO-327 | D--------- | KKML------ | NDEVCANGRQ | DRSSGVIQDR | GSGLVQDSCG | STKHVHYRYL | 117 |
| SEQ-ID-NO-330 | D--------- | KRLL------ | KEEEANANGRQ | DRSSGVIQDR | GSGLGQDSCG | SSKHGDYKYL | 117 |

| | | | | | | | |
|---|---|---|---|---|---|---|---|
| SEQ-ID-NO-319 | DTRKLGGS-- | ---------- | ---------- | SSRGMMEDAP | TV-------- | 146 |
| SEQ-ID-NO-331 | PLPPVHSR-- | ---------- | ---------- | RGAGRSSAVP | RLSAPDIG-- | 176 |
| SEQ-ID-NO-317 | KPREVESQRL | Y--------- | ---------MG | NADG-EDSTS | SDRSSLRKN | 119 |
| SEQ-ID-NO-321 | DPREVESQRL | YGRDFHPADL | TYDRTSRYTG | NVTG-IDNS | SGSSSSLQDK | 165 |
| SEQ-ID-NO-327 | DPKEVESHGL | YNHCFSAADI | TYGHKNHRYA | ENDSATDNTS | SESSSLQDR | 167 |
| SEQ-ID-NO-330 | DPKEVESNGL | YNRDLSVADM | TYGRRNHFSE | NVSGMDDTS | SESSSYLQER | 167 |

| | | | | | | | |
|---|---|---|---|---|---|---|---|
| SEQ-ID-NO-319 | ---------- | ---RRYYESQ | QSIM------ | ---SMQL--- | ---MPS---- | E--------- | 158 |
| SEQ-ID-NO-331 | ---------- | ---RRYYEPL | PVMLPPPPVA | ---HPQF--- | MRSYGYNKPS | E--------- | 201 |
| SEQ-ID-NO-317 | LVSSKDGIRD | VESSRYVAHK | DVLQ------ | GAAMPLTPKG | TDSFGY-KPS | GYLKVKGESE | 167 |
| SEQ-ID-NO-321 | FVCQREDPYD | AETSKYLAQN | PVMLPPPVA-- | GSLLPPNT-KG | ANNMGH-KPS | GYLKVKGEIE | 214 |
| SEQ-ID-NO-327 | LLCQGQDPYD | MEPSSHVTPN | ---------- | KALPPLNPKG | AINMGY-KPS | GYLKVKGEIE | 216 |
| SEQ-ID-NO-330 | MYPQGQDPYE | MEPSRY---S | ---------- | ---------- | ---------- | GYLKVKGEIE | 213 |

Figure 4 (continued)

| | | | | | |
|---|---|---|---|---|---|
| SEQ-ID-NO-319 | LRAI ACVEAQ | LGEPLRDDGP | MLGIEFDPLP | PDAFIGA--- | ---------- | 194
| SEQ-ID-NO-331 | LRVI HSVESQ | LGEPLRDDGP | VLGIDFDPLP | PGSFGAPI-- | ---------- | 239
| SEQ-ID-NO-317 | NFAI TAVKRQ | LGRQYQEDGP | PLGVEFDPLP | PGAFEPQTNP | IVHEPI YVGN | 217
| SEQ-ID-NO-321 | NAAI TAVKKQ | LGRHYKEDGP | PLGVEFDPLP | PGAFASPSRD | PVSGPI YVGD | 264
| SEQ-ID-NO-327 | HAAI TAVKKQ | LCKHYREDGP | LLSVEFDTLP | PEAFECQLAD | LANEAYYAAN | 266
| SEQ-ID-NO-330 | HAAI TAVKKQ | LGRNYQEDGP | LLGVEFDPLP | PGAFECQTEE | AVHEPYHIAD | 263

| | | | | | |
|---|---|---|---|---|---|
| SEQ-ID-NO-319 | QRRPHL PHL | GTRKSFNPGP | ---------- | ---------- | ---------- | 194
| SEQ-ID-NO-331 | LAQMCSPDVS | GVRKQSSLGA | ---------- | ---------- | ---------- | 239
| SEQ-ID-NO-317 | PALPNSPEVS | AVKKQSSLSS | ---------- | ---------- | ---------- | 237
| SEQ-ID-NO-321 | PALLNSPEIS | TVKSRPGLSS | ---------- | ---------- | ---------- | 314
| SEQ-ID-NO-327 | | | FEAQVLLVHA | GNLYILQLSI | TSNDVCHPMF | 286
| SEQ-ID-NO-330 | | | | | | 283

| | | | | | |
|---|---|---|---|---|---|
| SEQ-ID-NO-319 | | | | | | 194
| SEQ-ID-NO-331 | | | | | | 239
| SEQ-ID-NO-317 | | | | | | 237
| SEQ-ID-NO-321 | ITTVTFTLLL | LPIYHQSCTG | TTSNYAHNMF | PSSFRYVPKK | GSVRPENVME | 364
| SEQ-ID-NO-327 | | | | | | 286
| SEQ-ID-NO-330 | | | | | | 283

| | | | | | |
|---|---|---|---|---|---|
| SEQ-ID-NO-319 | | | | | | 194
| SEQ-ID-NO-331 | | | | | | 239
| SEQ-ID-NO-317 | | | | | | 257
| SEQ-ID-NO-321 | QGIFLYDSSD | SIPPSSISCT | SNESLYILAV | SYEL ARKSKL | HSPDPDSEDD | 413
| SEQ-ID-NO-327 | | | | RYE- VYSTKM | SSHDSYTEGA | 300
| SEQ-ID-NO-330 | | | | RYD- SYFTKI | SSQDS----- | 302
| | | | | RYD- SYYTKH | GSQDTHMEGV |

| | | | | | |
|---|---|---|---|---|---|
| SEQ-ID-NO-319 | | | | | | 194
| SEQ-ID-NO-331 | EHDDDDNIMV | GMEPGLRDKK | SFGEPRLKSP | STSFYNSVPR | HKSFKETFKG | 239
| SEQ-ID-NO-317 | NCNPE----- | ---PSDSHDR | KSHHHLEQKP | TYNGSNSNAG | GNSAMDMPDD | 307
| SEQ-ID-NO-321 | | | | | QMVRD | 455
| SEQ-ID-NO-327 | DFGSLHDVHV | ---QDKQDKK | ALHGTKHRQT | FQSNAGRFPG | RNSLDLYED | 305
| SEQ-ID-NO-330 | | | | | | 349

Figure 4 (continued)

| SEQ-ID-NO-319 | ---------- | ---------- | ---------- | ---------- | 194 |
|---|---|---|---|---|---|
| SEQ-ID-NO-331 | SPREI PVTNS | ---------- | KKGW-I SSKS | ---------- | 239 |
| SEQ-ID-NO-317 | LAGET SAYVN | ---------- | KRHYRMSSKH | ---------- | 352 |
| SEQ-ID-NO-321 | STGEASAYNN | ---------- | TKNCRKGT KH | WAEGSRNHLV | 504 |
| SEQ-ID-NO-327 | STGEA-AYNL | ---------- | TKNHRKDAKR | ---------- | 355 |
| SEQ-ID-NO-330 | ---------- | ---------- | ---------- | ---------- | 397 |

| SEQ-ID-NO-319 | ---------- | ---------- | ---------- | ---------- | 194 |
|---|---|---|---|---|---|
| SEQ-ID-NO-331 | ---------- | ---------- | ---------- | ---------- | 239 |
| SEQ-ID-NO-317 | HDYDNNL SN | GGR------- | ---------- | ---------- | 380 |
| SEQ-ID-NO-321 | LHDCDNDNPK | IVQ------- | GFEERRSDSL | ANVQNL SGS- | 532 |
| SEQ-ID-NO-327 | LHGYENSNLK | NVQ------- | GFDGT RDSG | STHLGPSGR- | 384 |
| SEQ-ID-NO-330 | QYNYENTNQK | ---------- | GMEGI RSDST | SNPSDHYEEN | 447 |

| SEQ-ID | Block 1 | Block 2 | Block 3 | Block 4 | End |
|---|---|---|---|---|---|
| SEQ-ID-NO-319 | ---------- | ---------- | ---------- | ---------- | 194 |
| SEQ-ID-NO-331 | SPREI PVTNS | ---------- | KKGW-I SSKS | ---------- | 239 |
| SEQ-ID-NO-317 | LAGET SAYVN | ---------- | KRHYRMSSKH | ---------- | 352 |
| SEQ-ID-NO-321 | STGEASAYNN | ---------- | TKNCRKGT KH | WAEGSRNHLV | 504 |
| SEQ-ID-NO-327 | STGEA-AYNL | ---------- | TKNHRKDAKR | ---------- | 355 |
| SEQ-ID-NO-330 | ---------- | ---------- | ---------- | ---------- | 397 |

| SEQ-ID | Block 1 | Block 2 | Block 3 | Block 4 | End |
|---|---|---|---|---|---|
| SEQ-ID-NO-319 | ---------- | ---------- | ---------- | ---------- | 194 |
| SEQ-ID-NO-331 | ---------- | ---------- | ---------- | ---------- | 239 |
| SEQ-ID-NO-317 | HDYDNNL SN | GGR------- | ---------- | KTGYL T | 380 |
| SEQ-ID-NO-321 | LHDCDNDNPK | IVQ------- | ---------- | RNNYTS | 532 |
| SEQ-ID-NO-327 | LHGYENSNLK | NVQ------- | ---------- | RGEYAK | 384 |
| SEQ-ID-NO-330 | QYNYENTNQK | ---------- | LQYDYDNVNP | KKAPRSEHI K | 447 |

| SEQ-ID | Block 1 | Block 2 | Block 3 | Block 4 | End |
|---|---|---|---|---|---|
| SEQ-ID-NO-319 | ---------- | ---------- | ---------- | ---------- | 194 |
| SEQ-ID-NO-331 | ---------- | ---------- | ---------- | ---------- | 239 |
| SEQ-ID-NO-317 | SRSPESMD-R | GPSSGMA--G | YHGERNQMK | MQREK----- | 423 |
| SEQ-ID-NO-321 | GKSLDTEE-R | ARCT MEKED | KLHGEMKRMK | GSHDPVRVKR | 581 |
| SEQ-ID-NO-327 | QVYLDT GERR | GLNKRMAKEE | KFDGDRKI KK | QYRDPDEV-R | 433 |
| SEQ-ID-NO-330 | RGSVDTEE-R | GLSSRMT KDE | LFKGDRKSKK | QYRDAGGA-G | 495 |

| SEQ-ID | Block 1 | Block 2 | Block 3 | Block 4 | End |
|---|---|---|---|---|---|
| SEQ-ID-NO-319 | ---------- | IPE------- | PHNRT G | ---------- | 203 |
| SEQ-ID-NO-331 | ---------- | VVE------- | K------- | ---------- | 244 |
| SEQ-ID-NO-317 | RVKHGYI QQV | YAPKSSSYSE | LERKS----- | ---------- | 449 |
| SEQ-ID-NO-321 | RFRVDF PQQ- | EHVAKASFSE | RRRTNLTKR | LNPENMATGI | 630 |
| SEQ-ID-NO-327 | WAKVDPLEQ- | YDVKQSSVAE | LEPRKS---- | ---------- | 458 |
| SEQ-ID-NO-330 | RLKANT FQP- | YNMKQVPVAE | LEPRKT---- | AFTEVVGALD | 520 |

| SEQ-ID | Block 1 | Block 2 | End |
|---|---|---|---|
| SEQ-ID-NO-319 | ---------- | ---------- | 203 |
| SEQ-ID-NO-331 | ---------- | ---------- | 244 |
| SEQ-ID-NO-317 | QI NRSCV | ELPSSLSGDD ETDESSSSMD | 476 |
| SEQ-ID-NO-321 | VPI DI GRSAM | ERPSSFS--ED ETPET SSSAE | 659 |
| SEQ-ID-NO-327 | ---QRSAA | EMPSSFS--ED ETAETSSSAD | 482 |
| SEQ-ID-NO-330 | ---QRSAA | EMPSSFS--ED ETADT SSSLD | 544 |

| SEQ-ID | | | | | | |
|---|---|---|---|---|---|---|
| SEQ-ID-NO-401 | S--- | ---- | ---- | ---- | ---- | 134 |
| SEQ-ID-NO-370 | SRL- | LPAA- | AAADESWSPP | APTLT--AM | ---- | 161 |
| SEQ-ID-NO-409 | SRL- | LPAAT | TAADESWSPP | APTLT--AM | ---- | 164 |
| SEQ-ID-NO-349 | HRL- | LP--- | -ATTESPSPS | PATATPHFAR | I--- | 167 |
| SEQ-ID-NO-357 | LRL- | LP--- | PAADDYAAV | AAGLAARF- | ---- | 163 |
| SEQ-ID-NO-337 | TPL- | VVVP- | --EDHQLSSN | ---VM | ---- | 162 |
| SEQ-ID-NO-339 | TPL- | VVVA- | --ADDQLVSS | N---VM | ---- | 160 |
| SEQ-ID-NO-395 | TPL- | -MP-- | --EDDTPC-- | ---FQ- | ---- | 155 |
| SEQ-ID-NO-417 | TPL- | -LP-- | --EEEASC-- | ---FL- | ---- | 150 |
| SEQ-ID-NO-437 | TPL- | -LP-- | --EEDASC-- | ---FW- | ---- | 153 |
| SEQ-ID-NO-355 | THF- | VPYHK | MEDYNQRLWN | DAASEDDIDD | DVSLFSHRHD | YYYIANASL- | 180 |
| SEQ-ID-NO-393 | TPL- | VPGEM | PVAVDDQMWA | AAGVPDSYYD | DFFSFPFASA | SPPSPTLLLP | 191 |

| SEQ-ID | | |
|---|---|---|
| SEQ-ID-NO-401 | ---- | 134 |
| SEQ-ID-NO-370 | ---- | 161 |
| SEQ-ID-NO-409 | ---- | 164 |
| SEQ-ID-NO-349 | ---- | 167 |
| SEQ-ID-NO-357 | ---- | 163 |
| SEQ-ID-NO-337 | ---- | 162 |
| SEQ-ID-NO-339 | ---- | 160 |
| SEQ-ID-NO-395 | ---- | 155 |
| SEQ-ID-NO-417 | ---- | 150 |
| SEQ-ID-NO-437 | ---- | 153 |
| SEQ-ID-NO-355 | ---- | 180 |
| SEQ-ID-NO-393 | HQLFSAS | 198 |

Figure 6

| SEQ ID | Sequence | # |
|---|---|---|
| SEQ-ID-NO-1842 | MSSSCIPTGL RLDLDMVKAA ASPVCAHSSP LRPAHYSSPS STLSSEASNA | 50 |
| SEQ-ID-NO-456 | ---------- ----MCSNK ASPVVGEE-- ---------- KQSTRSSKR | 22 |
| SEQ-ID-NO-511 | ---------- ----MLMNC DFNCDLFE-- -QEAKRRS-- -YPWARPCDG | 29 |
| SEQ-ID-NO-498 | ---------- ----MFMNC NFNSNLLE-- -NEAGRIS-- -FPWARPCDG | 29 |
| SEQ-ID-NO-478 | ---------- ----MFKQE SNNICNRE-- -N-------- -NRGARACDT | 23 |
| SEQ-ID-NO-481 | ---------- ----MLKQE S--------- ---------- --NWAQACDT | 14 |
| SEQ-ID-NO-485 | ---------- ----MLKQE S--------- ---------- --NWAQTCDT | 14 |
| SEQ-ID-NO-496 | ---------- ----MLKKE NSN------- ------S--- --NWARVCDS | 16 |
| SEQ-ID-NO-510 | ---------- ----MLKKE KSGGFDRS-- ---------- -NNWARVCDS | 23 |
| SEQ-ID-NO-536 | ---------- ----MLKKE RTSGGETG-- ------E--- -NNWARICDT | 23 |
| SEQ-ID-NO-474 | ---------- ----MLKQE SSGGGGGD-- ---------- -NRARVCDT | 21 |
| SEQ-ID-NO-475 | ---------- ----MLKQE SSGSGGGD-- ---------- -NRARLCDT | 21 |
| SEQ-ID-NO-457 | ---------- ---------- ---------- ---------- -MPKPCDA | 7 |
| SEQ-ID-NO-532 | ---------- ----MKVEE QTVGGGG--- -GAGQGGAGF WGLAGRPCDT | 32 |
| SEQ-ID-NO-466 | ---------- ----MVIDT TNVKGLTG-- -R-------- WGMAAKTCDT | 24 |
| SEQ-ID-NO-508 | ---------- ----MGIER GGLKSLRG-- -G-------- WSVPPKLCDS | 24 |
| SEQ-ID-NO-488 | ---------- ---------- ---------- ---------- --MALKLCDS | 8 |
| SEQ-ID-NO-494 | ---------- ---------- ---------- ---------- --MATKLCDS | 8 |

| SEQ ID | Sequence | # |
|---|---|---|
| SEQ-ID-NO-1842 | SSSSATSVSL KRARAPRKRP NQAYNEAAL --LASLHPSV FPVNKSPKTA | 98 |
| SEQ-ID-NO-456 | -KKRKN REATTMEDK SSSNLDASRK --IRTKTKK- -P------- | 56 |
| SEQ-ID-NO-511 | CHAAPSAVYC HADAAYLCAS CDTQVHSANR --LASSHERV RVCVSCESAA | 77 |
| SEQ-ID-NO-498 | CHAAPSTVYC CADAAYLCAS CDLQVHSANR --LASSHERV RVCETCESAP | 77 |
| SEQ-ID-NO-478 | CGSTICTVYC HADSAYLCNS CDAQVHSANR --VASRHKRV RVCESCERAP | 77 |
| SEQ-ID-NO-481 | CRSAACTVYC RADSAYLCTS CDAQI HAANR --LASRHERV RVCESCERAP | 71 |
| SEQ-ID-NO-485 | CRSAACTVYC RADSAYLCTN CDAQVHAANR --LASRHERV RVCQSCERAP | 62 |
| SEQ-ID-NO-496 | CHSATCIVYC RADSAYLCAG CDARIHTASL --MASRHERV WVCEACERAP | 62 |
| SEQ-ID-NO-510 | CHSATCIVYC RADSAYLCAG CDSRIHAASL --MASRHERV WVCEACERAP | 64 |
| SEQ-ID-NO-536 | CRSAACTVYC RADSAYLCTS CDARVHAANR --VASRHERV WVCESCERAP | 71 |
| SEQ-ID-NO-474 | CRAAPCTVYC RADAAYLCVG CDARVHAANR --LASRHERV SVCEACERAP | 71 |
| SEQ-ID-NO-475 | CRAAACIVYC RADAAYLCVG CDGKVHGANK --VASRHERV WVCESCERAP | 69 |
| SEQ-ID-NO-457 | CHVSSAAVFC RLDGAYLCAG CDARAHGACS --RHARV--- WMCEVCEVAP | 69 |
| SEQ-ID-NO-532 | CAVDAARLYC RSDSAFMCLS CDSTIHSAND KLVSCRHERV WMCEVCEHAP | 55 |
| SEQ-ID-NO-466 | CKSAAAI FC RSDSAFLCIN CDSKIHAANK --LSSRHERV WMCEVCEQAP | 77 |
| SEQ-ID-NO-508 | CKLTPAALFC RSDSAFLCVN CDSNQAANK --LASRHARV WLCEVCEQAP | 74 |
| SEQ-ID-NO-488 | CKSATGTLFC RSDSAFLCIT ---------- --LASRHARV WMCEVCEQAP | 72 |
| SEQ-ID-NO-494 | CKSTKATLFC RSDSAFLCIT ---------- --LASRHHRV TLCEVCEQAP | 56 |

| | | | | | | |
|---|---|---|---|---|---|---|
| SEQ-ID-NO-1842 | DSLLDVGDAA | AGGLDGIMGS | LTVDVESGTA | ARSDDSILSS | SGIHPYLRRL | 243 |
| SEQ-ID-NO-456 | AAYLFNSATD | STISSIHDLL | PSS---AATD | VDCGGERNNL | ---SPYYDR- | 167 |
| SEQ-ID-NO-511 | DSWLLLERDS | DDNN------ | ------CTNN | IDQYXNLFGY | ---DMYYDKF | 180 |
| SEQ-ID-NO-498 | DSWLLRRNSD | ---------- | ---------- | ANKIDRYYNL | VGYNMYYDNI | 179 |
| SEQ-ID-NO-478 | ASWLFPKNSD | YH-------- | ---DNNC--- | NQNNELLFS- | ---DDYLDL- | 173 |
| SEQ-ID-NO-481 | ASWLLPSSVK | NC-------- | ---NNNN--- | NNTENNRFSV | G--EEYLDL- | 165 |
| SEQ-ID-NO-485 | ASWLLPSSLK | NSGDNN---- | ---GDNN--- | NNNSENRFSV | G--DEYVD-- | 167 |
| SEQ-ID-NO-496 | ASWLLLNPPV | K--------- | ---NNNN--- | NNNYGMLFGG | EVVDDYLDL- | 189 |
| SEQ-ID-NO-510 | ASWLLLNPPV | KNNNKNNI-- | N--NNNN--- | NNNYGMLFGG | EVVDEYLDL- | 206 |
| SEQ-ID-NO-536 | ASWLLLNPGK | NS-------- | ---GNNN--- | NQNNGFFFDG | EA-DEYLDL- | 185 |
| SEQ-ID-NO-474 | ASWLLLNPVK | ---------- | ---NSKN--- | QNNNGFLFGG | EV-DEYLDL- | 176 |
| SEQ-ID-NO-475 | ASWLLLNPVK | ---------- | ---NSKN--- | QNNNGFLFEG | EV-DEYLDL- | 179 |
| SEQ-ID-NO-457 | VSWLLLPHPKI | ---------- | ---SITNS-- | LIRGSAAADE | MGSSPFHD-- | 161 |
| SEQ-ID-NO-532 | ASWLLPEP-- | ---------- | ---GDSP--- | EDSAATFFAD | S--DAYLD-- | 176 |
| SEQ-ID-NO-466 | GSWLLPNPKL | TM-------- | ---ETNQ--- | VKTGDFFFSD | M--DPFID-- | 178 |
| SEQ-ID-NO-508 | AAWLIPNPNF | GSKLN----- | ---ETQD--- | IKTREMFFSD | M--DPFLD-- | 183 |
| SEQ-ID-NO-488 | ASWLLPNPKA | M--------- | ---ENPD--- | LNSGQYLFPE | M--DPYMD-- | 167 |
| SEQ-ID-NO-494 | ASWLLQTPAN | P--------- | ---KGPD--- | LNSSHYSFTE | IDATDL---- | 150 |

| | | | | | | |
|---|---|---|---|---|---|---|
| SEQ-ID-NO-1842 | MVVGLAGRFE | LGLGSQHGAR | PSLNRALKRR | DDDGAWWMWP | AVPVKDLTIA | 293 |
| SEQ-ID-NO-456 | S-----QD-- | HCSSSSLLR | TAMRKGASEE | E--------- | ---------- | 190 |
| SEQ-ID-NO-511 | S-----CN-- | PGPGEEYRLQ | EQDVQNMYRE | N--------- | ---------- | 204 |
| SEQ-ID-NO-498 | T-----CD-- | PRPEEQYRMQ | EQHVQNRYIE | K--------- | ---------- | 203 |
| SEQ-ID-NO-478 | ------AD-- | YNSSMDYKFT | SQYNQPRHKQ | D--------- | ---------- | 196 |
| SEQ-ID-NO-481 | ------VD-- | YSSSIDKRFX | GQ--TNQYQQ | D--------- | ---------- | 186 |
| SEQ-ID-NO-485 | ---------- | ---------- | -LVDYNKYQQ | D--------- | ---------- | 177 |
| SEQ-ID-NO-496 | ------AE-- | YGG------- | DQYSVNQQQQ | H--------- | ---------- | 210 |
| SEQ-ID-NO-510 | ------AE-- | YGG------- | DQYSVNQQQQ | H--------- | ---------- | 227 |
| SEQ-ID-NO-536 | ------VE-- | YNSSMENQFS | DQYSQ--YHQ | Q--------- | ---------- | 206 |
| SEQ-ID-NO-474 | ------VE-- | Y--------- | NQCSDQYNQQ | H--------- | ---------- | 195 |
| SEQ-ID-NO-475 | ------VE-- | Y--------- | NQCSDQYNQQ | H--------- | ---------- | 198 |
| SEQ-ID-NO-457 | ------RP-- | ESPKPKKQKV | ELPADLFSDV | M--------- | ---PFLDL-- | 189 |
| SEQ-ID-NO-532 | ---------- | ---------- | --LDFVRS-- | ---------- | ---------- | 183 |
| SEQ-ID-NO-466 | ---------- | ---------- | FEYQDSFQQH | D--------- | ---------- | 189 |
| SEQ-ID-NO-508 | ---------- | ---------- | FDYSNNFQNN | N--------- | ---------- | 194 |
| SEQ-ID-NO-488 | ---------- | LDYGHV---- | DPKLEDAQEQ | N--------- | ---------- | 184 |
| SEQ-ID-NO-494 | ---------- | NFVCV----- | DAKTDSPEQH | S--------- | ---------- | 166 |

| | | | | |
|---|---|---|---|---|
| SEQ-ID-NO-1842 | ---LR Q ALEEE T--------- | --------- | --------- | 485 |
| SEQ-ID-NO-456 | --------- | --------- | --------- | 339 |
| SEQ-ID-NO-511 | E--LDQML T I P ALP------ | --------- | WF------ | 369 |
| SEQ-ID-NO-498 | E--EDHML S PP ALP------ | D-SGHATVL | WF------ | 369 |
| SEQ-ID-NO-478 | E--DQEYNT M LMY------ | DT-SSYNT VP | SFYGQK | 366 |
| SEQ-ID-NO-481 | --ADHAL S TM VMF------ | CD-TGYGI VP | SFS--- | 342 |
| SEQ-ID-NO-485 | EEADKA F SSM VMF------ | D-TGYGI VP | SF---- | 335 |
| SEQ-ID-NO-496 | E--VDQMFSTQ LMT------ | D-TGYGI VP | SF---- | 391 |
| SEQ-ID-NO-510 | E--VDQMFSTQ LMT------ | D-SNYGI VP | SF---- | 413 |
| SEQ-ID-NO-536 | E--VDQ A FST T LMQ------ | D-SSYGI VP | SF---- | 381 |
| SEQ-ID-NO-474 | E--DDQMFSST LMA------ | E-TGYGI VP | SF---- | 369 |
| SEQ-ID-NO-475 | E--DDR T FSST LMA------ | E-SGYGI VP | SF---- | 372 |
| SEQ-ID-NO-457 | E--Q--- F GSV DSS------ | G--GCGI VP | SF---- | 358 |
| SEQ-ID-NO-532 | E--QDGPFSPA SSA----HLA | F-GVVP | SF---- | 325 |
| SEQ-ID-NO-466 | E--VDHMYNSA SSAATAAAFM | SD-GDYGVVP | SF---- | 368 |
| SEQ-ID-NO-508 | D--VDRLYNPA DPLSVPSSML | YD-NQYGI VP | SF---- | 375 |
| SEQ-ID-NO-488 | E--AE P M--------- | MD-CPYGVVP | TF---- | 340 |
| SEQ-ID-NO-494 | N-VN-L I GED ESY------ | ---CRYGI VP | SF---- | 312 |
| | | ---DGYGVVP | S C ---- | |

Figure 7

```
                                                                           20            70
                                                                           50           100
SEQ-ID-NO-634  ----------  --------  -MEESKKY-  --------  --------
SEQ-ID-NO-637  MHVKLSLWLK  HFVVTILIYK  YRPPSRPLHH  NSVFISKKAM  KSM
                                                              VKQTMNKKKK
                                                              EESRSNREQR

SEQ-ID-NO-634  NNNKKGHCSG  SRSGLLQMKV  RRLQILIPGG  QTCNHPDLLL  SKTVDYIVHL
SEQ-ID-NO-637  KQTKKKTGRG  SGSGSIQIKM  RKLRVLIPGG  RRLNQPDLLL  TKTADYIMHL 86
                           117
SEQ-ID-NO-634  KLKLRFLKAI  SEMYSL-
SEQ-ID-NO-637  ELRIRFLKAI  SDIYSLS
```

| SEQ ID | Sequence | # |
|---|---|---|
| SEQ-ID-NO-826 | LASSCPKKLA GRKKFRETRH PIYRGVRQRN SGKWVCEVRE PNKKSRI WLG | 81 |
| SEQ-ID-NO-813 | LAASCPKKPA GRKKFRETRH PVYRGVRLRN SGKWVCEVRE PNKKSRI WLG | 78 |
| SEQ-ID-NO-809 | LATSCPKKPA GRKKFRETRH PIYRGVRQRN SGKWVCEVRE PNKKSRI WLG | 78 |
| SEQ-ID-NO-811 | LATSCPKKPA GRKKFRETRH PVYRGVRQRN SGKWVSELRE PNKKTRI WLG | 78 |
| SEQ-ID-NO-808 | LATSCPKKPA GRKKFRETRH PIYRGVRQRN SGKWVSEVRE PNKKTRI WLG | 78 |
| SEQ-ID-NO-804 | LATSCPKKPA GRKKFRETRH PIYRGVRQRN SGKWVCELRE PNKKTRI WLG | 75 |
| SEQ-ID-NO-644 | LASSCPKKPA GRKKFRETRH PIYRGVRQRN SGKWVCEVRE PNKKTRI WLG | 78 |
| SEQ-ID-NO-796 | LASSCPKKPA GRKKFRETRH PIYRGVRRRS SGKWVCEVRE PNKKTRI WLG | 78 |
| SEQ-ID-NO-797 | LASSCPKKPA GRKKFRETRH PIYRGVRRRN SGKWVCEVRE PNKKTRI WLG | 78 |
| SEQ-ID-NO-645 | LASSCPKKPA GRKKFRETRH PIYRGVRRRN SCKWVCEVRE PNKKTRI WLG | 78 |
| SEQ-ID-NO-767 | LASSCPKKPA GRKKFRETRH PIYRGVRRRN SGKWVCEVRE PNKKTRI WLG | 78 |
| SEQ-ID-NO-1843 | LASCYPKKRA GRKKFRETRH PVFRGVRRRN SGKWVCEVRE PYKKSRI WLG | 86 |
| SEQ-ID-NO-834 | LASKNPKKRA CRKKFRETRH PIYRGVRRRD SGKWVCEVRE PNKKTRV WLG | 92 |
| SEQ-ID-NO-837 | LASTHPKKRA GRKKFRETRH PVYRGVRRRN SGKWVCEVRE PNKTSRI WLG | 84 |
| SEQ-ID-NO-838 | LASTRNPKKRA GRKKFRETRH PVYRGVRRRN SGKWVCEVRE PNKKSRI WLG | 93 |
| SEQ-ID-NO-830 | LASTCPKKRA GRKKFRETRH PVFRGVRRRN SCKWVCEVRE PNKKSRI WLG | 85 |
| SEQ-ID-NO-840 | LASNNPKKRPA GRKKFRETRH PIYRGIRKRN SGKWVCEVRE PNKKTRI WLG | 85 |
| SEQ-ID-NO-832 | LASNNPKKPA GRKKFRETRH PIYRGIRKRN SGKWVCEVRE PNKKKTRI WLG | 82 |
| SEQ-ID-NO-835 | LASNNPKKPA GRKKFRETRH PVYRGVRKRN SGKWVCEVRE PNKKSRI WLG | 88 |
| SEQ-ID-NO-831 | LASNNPKKRA GRKKFRETRH PVYRGVRKRN SDKWVCEVRE PNKKSRI WLG | 87 |
| SEQ-ID-NO-839 | LASNNPKKRA GRKKFRETRH PVYRGVRKRN SDKWVCELRE PNKKSRI WLG | 87 |

Figure 8 (continued)

| SEQ ID | Sequence | Length |
|---|---|---|
| SEQ-ID-NO-826 | TFPTVEMAAR AHDVAALALR GRSACLNFAD SAWRLRIPES TCPKEI QRAA | 131 |
| SEQ-ID-NO-813 | TFLLTAEIAAR AHDVAAIALR GKSACLNFAD SAWRLRIPET TCPKEI QKAA | 128 |
| SEQ-ID-NO-809 | TFPTAEMAAR AHDVAAIALR GRSACLNFAD SAWRLRIPES TCAKDI QKAA | 128 |
| SEQ-ID-NO-811 | TFPQTAEMAAR AHDVAALALR GRSACLNFAD SVWRLRIPES ACAKDI QKAA | 128 |
| SEQ-ID-NO-808 | TFPQTAEMAAR AHDVAAIALR GRSACLNFAD SAWRLRIPES TCAKEI QKAA | 125 |
| SEQ-ID-NO-804 | TFPQTAEMAAR AHDVAALALR DRSACLNFAD SAWRLRIPES TCAKEI QKAA | 128 |
| SEQ-ID-NO-644 | TFPQTAEMAAR AHDVAAIALR GRSACLNFAD SAWRLRIPES TCAKDI QKAA | 128 |
| SEQ-ID-NO-796 | TFPQTAEMAAR AHDVAAIALR GRSACLNFAD SAWRLRIPES TCAKDI QKAA | 128 |
| SEQ-ID-NO-797 | TFPQTAEMAAR AHDVAALALR GRSACLNFAD SAWRLRIPES TCAKDI QKAA | 128 |
| SEQ-ID-NO-645 | TFPTAEMAAR AHDVAALALR GRLACLNFAD SAWRLPVPAS TCAKDI QKAA | 128 |
| SEQ-ID-NO-767 | TFPTEEMAAR AHDVAALAMR GRGACLNFAD SLWRLPIPES TDPKDI QKAA | 136 |
| SEQ-ID-NO-1843 | TYPTADMAAR AHDVAALALR GRGACLNFAD SAWRLHVPSS SNVKDI QKAA | 142 |
| SEQ-ID-NO-834 | TFPTADMAAR AHDVAALALR GRSACLNFAD SAWRLPTPAS RDAKDI QKAA | 134 |
| SEQ-ID-NO-837 | TFPTAEMAAR AHDVAALALR GRSACLNFAD SARRLPVPAS SDAKDI QTAA | 143 |
| SEQ-ID-NO-838 | TFPTADMAAR AHDVAAIALR GRSACLNFSD SAWRLPIPAS SNAKDI QKAA | 135 |
| SEQ-ID-NO-830 | TFPTAEMAAR AHDVAALALR GRSACLNFSD SAWRLPVPAS SNSKDI QKAA | 135 |
| SEQ-ID-NO-840 | TFPTAEMAAR AHDVAAIALR GRSACLNFAD SAWRLPIPAS SDTKDI QKAA | 132 |
| SEQ-ID-NO-832 | TFPTAEMAAR AHDVAAIALR GRSACLNFAD SAWRLPVPAS SDTKDI QKAA | 138 |
| SEQ-ID-NO-835 | TFPSAEMAAR AHDVAAIALK GRSACLNFAD SAWKLLPIPAS SDTKDI QKAA | 138 |
| SEQ-ID-NO-831 | TFPSAEMAAR AHDVAAIALR GRSACLNFAD SAWKLPIPAS TDAKDI QKAA | 137 |
| SEQ-ID-NO-839 | TFPSAEMAAR AHDVAAIALR GRSACLNFAD SAWKLPIPAS TDAKDI QKAA | 137 |

| SEQ-ID-NO | | | | | | |
|---|---|---|---|---|---|---|
| SEQ-ID-NO:826 | LGMPRFLENM | GEEMLLPPPE | LGWNH | DLAG-DADV | SLWSF- | 220 |
| SEQ-ID-NO:813 | LEMPALLASM | AEGMLLPPPS | -VHFGH---N | YDFDG-DADV | SLWSY- | 214 |
| SEQ-ID-NO:809 | FGMPRLLANM | AEGMLLPPPS | -VQWGH---N | YDCDG-DADV | SLWSY- | 216 |
| SEQ-ID-NO:811 | FGMPSLMANM | AEGMLLPLPS | -IQWI-N | YDVEG-DADM | PLWSY- | 216 |
| SEQ-ID-NO:808 | FGMPTLLDNM | AEGMLLPPPS | -VQMNH---N | YDGEG-DGEV | PLWSY- | 213 |
| SEQ-ID-NO:804 | LGMSSLLDNM | AEGMLLPSPS | -VQMNH---N | FDVKG-DDDM | SLWSY- | 216 |
| SEQ-ID-NO:644 | FEMPSLLANM | AEGMLLPLPS | -VQMNY---N | HEVDGGDDDV | SLWSY- | 216 |
| SEQ-ID-NO:796 | FEMPSLLANM | AEGMLLPLPS | -VQMNH---N | HEVDGDDDDV | SLWSY- | 216 |
| SEQ-ID-NO:797 | FEMPSLLANM | AEGMLLPLPS | -VQMNH---N | HEVDGDDDDV | SLWSY- | 216 |
| SEQ-ID-NO:645 | FEMPSLLANM | AEGMLLPLPS | -VQMNH---N | HEVDGGDDDV | SLWSY- | 216 |
| SEQ-ID-NO:767 | FGREKFLANM | AAGMMMSPPH | -SGYEK---DE | QELEFVDDCV | QLWSYSI | 222 |
| SEQ-ID-NO:1843 | FEMQGFLADM | AEGMMLPPPR | TLEYDN---C | QDDLEFVDA | SLWSF- | 219 |
| SEQ-ID-NO:834 | FGMPGLLVNM | AEGLLMPPPH | SVADGY---G | GDDMAADADM | SLWSY- | 218 |
| SEQ-ID-NO:837 | FGMPGLLANI | AEGMLLPPPN | CCGYSGGDSL | DNMENNDTDM | SLWSFSV | 233 |
| SEQ-ID-NO:838 | FGMPGLLADM | AEGMLLPPPH | --YSD----D | DDVDV-CADV | PLWSF- | 219 |
| SEQ-ID-NO:830 | FFMPGLLANM | AEGLMLPPPQ | -CAEMG---D | HYVETDAYML | TLWNYSI | 222 |
| SEQ-ID-NO:840 | FFMPGLLANM | AEGLMLPPPQ | -CAEMG---D | HCVETDAYML | TLWNYSI | 210 |
| SEQ-ID-NO:832 | FCMPGLLANI | AEGLMLPPPQ | -CAEIG---D | HI-VETADADT | PLWSFSI | 215 |
| SEQ-ID-NO:835 | FCMPGLLADM | AEGLMLPPPQ | -CAEIG---D | HI-VETADADT | PLWSFSI | 215 |
| SEQ-ID-NO:831 | FCMPGLLTNM | AEGLMLPPPQ | -CSQIG---D | HMED-DFDM | PLWSYSI | 219 |
| SEQ-ID-NO:839 | FFMPGLLVNM | AEGLMLPPPQ | -CSQIG---D | HMEA-DVDM | PLWSYSI | 219 |

Figure 9

```
SEQ-ID-NO-850  ------MEKS--------------------------------------------PRYRD------------------------------------KA  11
SEQ-ID-NO-881  ------MEPCTKQ------FLPM--------------------------P-PQDPNSPSSSTSSSSSSSTSPSHPYHRA--------------  40
SEQ-ID-NO-895  ------MEVSTKQ------LLPM--------------------------PHQQDPNSPSSSTSSSSSSSTSPSHPHHRA--------------  41
SEQ-ID-NO-885  ------MEVAPAV------KQLL--------------------------PMARGPNSPSPSSTSSSSPSPSAA-------------------  34
SEQ-ID-NO-898  -----------------------------------------------------MAHDPNSPSSSTSSSSPSSAAAAASSSPS-----------  29
SEQ-ID-NO-876  ------MDSIS----------------------------------------PKPQENNNN-NNNI-------------------------S-  19
SEQ-ID-NO-877  ------MDSTSSMRYQ-EEQKSSLTSL----------------------PSPKTQSNGHNHSHNQIPSPRPISLPSPKT--------------  50
SEQ-ID-NO-853  ------METSPRQTT--NPN---FLAS----------------------PKSLSPNSSTSSTSGS--------------------NT------  35
SEQ-ID-NO-857  ------METSPRHRD--NQNPQSLFPS----------------------PTSYSSSSNSNSNSSTTATNNVALNNNI---------------  49

SEQ-ID-NO-850  -----------------------------------------------------------TTP----------YETTFIRTDP-----------  43
SEQ-ID-NO-881  -----------------KNL------LPSPSSCT---------------------PRPVPRTIETTPFPTTFVQADT---------------  73
SEQ-ID-NO-895  -----------------QPP------HPHNLPPS---------------------PRPIPRTIDTTPFPTTFVQADT---------------  71
SEQ-ID-NO-885  -----------------Q---------PHNLPPS---------------------QAPIPRTIDTTPFPTTFVQADT---------------  67
SEQ-ID-NO-898  -----------------APS------PPPRQQQS---------------------SPRTVVPRTIDTTPFPTTFVQADT-------------  72
SEQ-ID-NO-876  -----------------SHR------PPPPPPSSSS-------------QPALPPSPRTMTRSEPANSYPTTFVQADT--------------  41
SEQ-ID-NO-877  -----------------------------------------------------PKPTRSEPGNPYPTTFVQADT------------------  90
SEQ-ID-NO-853  -----------------QTQSNGHNHN------HNHNQIPS--------------PKPTRSESANPYPTTFVQADT----------------  68
SEQ-ID-NO-857  -----------------NHP------PPTPPPQQ---------------------PKPLSRSESTNPYPTTFVQADS---------------  79

SEQ-ID-NO-850  SSFKQVVQLL------TGIPK--------------------N---PTHQPDPRFPPFHSIPPIKA---------G-----------------  79
SEQ-ID-NO-881  TSFKQIVQML------TGSEQS-------------------S---KSAAAATTNGSAGNQAASGS--------------------------- 110
SEQ-ID-NO-895  TSFKQVVQML------TGAEQPTKND---------------A---TTAAAAPAGNGGGGQAA---G------------------------- 110
SEQ-ID-NO-885  ASFKQVVQRL------TGSD-----------------------T-PPPAQKPAKTHGHHHHH---G------------------------- 100
SEQ-ID-NO-898  ASFKQVVQML------TGSD---------------------A---TPPSQRPPAKSNHHQHHHSG-------------------------- 107
SEQ-ID-NO-876  TSFKQVVQML------GSSETAK------------QAAAAAA--AASSSSSSKKPANPIPPMKS-------------------------- 86
SEQ-ID-NO-877  TSFKQVVQML------GSSETAK------------LASSTK--AKQASTSTKANHNHNIPP----------------------------- 124
SEQ-ID-NO-853  SSFKQVVQML------GSSETAK--------TTTTTTTT----PTPSPLSDSNLKTHIPPIKS---------------------------- 112
SEQ-ID-NO-857  SSFKQVVQML------GSPKPKPTC------------------A-PNTSQVDPLPKTHNIPPIKS-------------------------- 129

SEQ-ID-NO-850  VTNKKQSSSF------RLSERRNS-------MKHYLNIN---PTH-------GP---SPRNAS------- 111
SEQ-ID-NO-881  GPCRPKKPSF------KLYERRSS-------LKNLKMA----PLA----M--GAPPSPRR--------- 150
SEQ-ID-NO-895  GPCRPKKPSF------KLYERRSS-------MKNLKMA----PLA----M--GPPPSPRK--------- 148
SEQ-ID-NO-885  GGVGKKPAF-------KLYERRLG-------KNLKMA-----PL-----A--CPSPSPRK--------- 137
SEQ-ID-NO-898  APCRPKKQAF------KLYERRSGV------HKNFKMA----PLAMAAAAAAGASSSPRK--------- 152
SEQ-ID-NO-876  IPNKKQQPHF------SKLYERRNS------LNRNSLHI---PLTSFF---S-NHTNSPRK--------- 131
SEQ-ID-NO-877  ---KKQQGF------KLYERRNS-------FHKNLNIN---PLLPPIF--S-NSTFSPRNK-------- 163
SEQ-ID-NO-853  IPKNKQNSGF------RLYERRSS-------LKNLK-I----PLNPAFGS--N-NSIGFSPRK------- 154
SEQ-ID-NO-857  MPKKNQSSGF------KLYERRNS-------LKNLK-N----PLNPIFAQ-P-SSGFSSRK-------- 171
```

Figure 9 (continued)

| SEQ ID | | | | | | | | | |
|---|---|---|---|---|---|---|---|---|---|
| SEQ-ID-NO-850 | ---------- | PEIL | TPTILNFPAL | DL-SPDTPLM | SDPFYRPGSF | SQSP--SDSK | 152 |
| SEQ-ID-NO-881 | AA------ | PEIL | SPSVLDFPSL | KLSSPVTPLT | GDPFFPSPAS | SSGD---- | 190 |
| SEQ-ID-NO-895 | AA------ | PEIL | SPSVLDFPSL | RLSSPVTPLT | GDPFNRSPAS | TSSS---- | 188 |
| SEQ-ID-NO-885 | AA------ | PEVL | SPSVLDFPSL | ALGSPVTPLL | ADPFNRSASA | SPGE---- | 177 |
| SEQ-ID-NO-898 | AAQHQQEAL | ---- | SPSVLDFPSL | AL-SPVTPLV | ADPFNRSPAS | ASSS---- | 195 |
| SEQ-ID-NO-876 | ---------- | ADIL | SPSILDFPSL | VL-SPVTPLI | PDPFDRSNAA | -DSE---- | 168 |
| SEQ-ID-NO-877 | ---------- | QEIL | SPSILDFPSL | VL-SPVTPLI | PDPFNRSGSS | SSSAARNGS | 206 |
| SEQ-ID-NO-853 | ---------- | PEIL | SPSILDFPSL | AL-SPVTPLI | PDPFDRSGSG | NYTNCINNNV | 197 |
| SEQ-ID-NO-857 | ---------- | KFIL | SPSILDFPAL | VL-SPVTPLI | PDPFDRSGSA | KYTN---- | 208 |

| SEQ ID | | | | | | | | | |
|---|---|---|---|---|---|---|---|---|---|
| SEQ-ID-NO-850 | PSFDDDQERS | KEKGFYLRP | SPST--TPRD | TEPRLISLFP | MTPIHSPAPS | 200 |
| SEQ-ID-NO-881 | -AAERAA-- | ADKGFFFHP | SPRGA-EP- | -PRLLPLFP | VSSPRMAAAS | 231 |
| SEQ-ID-NO-895 | -EEAERAA-- | AERGFFLHP | SPRGA-EP- | -PRLLPLFP | VTSPRMAAPA | 230 |
| SEQ-ID-NO-885 | ---------- | AQRGFFLHP | SPRGAVEP- | -PRLLPLFP | VTSPKMAQ-- | 219 |
| SEQ-ID-NO-898 | -QDEAEAAA- | AQKGFFLHP | SPRSA-EP- | -PRLLPLFP | VTSPRVASSS | 239 |
| SEQ-ID-NO-876 | -ASPE----- | AEVKA---- | SPRD----K | AQPLLPLFP | TTSPRASSGP | 208 |
| SEQ-ID-NO-877 | SLDSLAEDKA | REKGFFLHP | SPRAASTSRD | SEPRLLPLFP | TSSPRASGPS | 256 |
| SEQ-ID-NO-853 | NLDKEAEEKA | KEKGFYLHP | SPAS--TPRD | SEPRLLPLFP | VTSPRVSGSS | 245 |
| SEQ-ID-NO-857 | ---------- | KEKGFYLHP | SPGS--SPRE | TEPRLLPLFP | LTSPRISGSV | 250 |

| SEQ ID | | | |
|---|---|---|---|
| SEQ-ID-NO-850 | ----PHD--- | ---------- | -----H | 204 |
| SEQ-ID-NO-881 | AT-APAE--- | ---------- | ------ | 238 |
| SEQ-ID-NO-895 | AA--PSE--- | ---------- | ------ | 235 |
| SEQ-ID-NO-885 | ---------- | ---------- | ------ | 219 |
| SEQ-ID-NO-898 | SSSAAAVAV | ASPSFE---- | ------ | 255 |
| SEQ-ID-NO-876 | SSSAPPS-- | ---------- | ------ | 215 |
| SEQ-ID-NO-877 | SSSKYSAS-- | ---------- | ------ | 264 |
| SEQ-ID-NO-853 | TS-------- | ---------- | ------ | 247 |
| SEQ-ID-NO-857 | N---PSS--- | ---------- | ------ | 254 |

```
SEQ-ID-NO-948              GGLPVPVAKL  AGN-------  ----------  ----------  ----------   33
SEQ-ID-NO-950              GGLPVPLEKQ  LGD-------  ----------  ----------  ----------   33
SEQ-ID-NO-932              GGLPAVPLEK  MCN-------  ----------  ----------  RFSSASS---  132
SEQ-ID-NO-931              AGLCLLYQLP  NPNGVFTPAT  MNACATDSPS  TLLSITPYPH  RFSSASS---  144
SEQ-ID-NO-1844             EGLSHFYQLQ  NPSGIFG---  ---NSGDMV   NLYGTTSFPP  RFSSTAS---  139
SEQ-ID-NO-911              EGFSHFNQLQ  NPNGMFG---  ---NSSDMV   NFYGTTPFPS  NNLIEKSLNF  147
SEQ-ID-NO-907              EGLSHFYQLQ  NPNSMFG---  ---HSSDTV   NFYGSSSFPS  SNLPFSMLNS  160
SEQ-ID-NO-922              ARFFHNYPLL  EVE-------  ----------  ----------  SNLEFSLLNS  152
SEQ-ID-NO-923              TGVVVEDES   ATR-------  ----------  ----------  SNLDFSVLNS  156
SEQ-ID-NO-929              GARPRLEDAL  APE-------  ----------  ----------  PFHQLH----  126
SEQ-ID-NO-936              ----------  ----------  ----------  ----------  MMDKQKA---  118
SEQ-ID-NO-947              ----------  ----------  ----------  ----------  ----------  106

SEQ-ID-NO-948              ----------  ----------  ----------  TRQPYNCT--  ----------   50
SEQ-ID-NO-950              ----------  ----------  ----------  TRQPYNCT--  ----------   50
SEQ-ID-NO-932              SAA-------  -TKDV       EGKNLELRLG  ACSH-GDGAE  ERLDLQLRLG  168
SEQ-ID-NO-931              AAATN-----  -DYYS       EVKNLELRMG  ACSHGGDGTE  ERLDLQLRLG  183
SEQ-ID-NO-1844             AAT-------  -NDYS       EGKTLELRMG  ACSHGGDGTE  ERLDLELRLG  176
SEQ-ID-NO-911              LVAPPEINTS  HCYSIKAEPS  ASIDNSNN-N  SDNNFKELAH  EELDLELRLG  197
SEQ-ID-NO-907              PVEVPP----  ---RLIEYST  GDDESIGSMK  EATGTSVD--  ELDLELRLG-  200
SEQ-ID-NO-922              SVEVPP----  ---RLIQYPT  GDDEKAGSMK  ETILRTSVN-  EPDLELRLG-  192
SEQ-ID-NO-923              PVEVPP----  ---RFIEYST  GDDESIGSMK  ETKRTSVG--  EPDLELRLG-  196
SEQ-ID-NO-929              ----------  ---A        GTSISHEYD   TPPPAEPSDH  ANLDLTLRL-  156
SEQ-ID-NO-936              PAA-------  -DDDA       PATASSSNMK  RSSYGYG-V   EELDLSLRL-  153
SEQ-ID-NO-947              ----------  -RS         SRLLLRDKKG  SSEHGGVERA  DELDLSLRL-  137

SEQ-ID-NO-948              ----------  ----------  ----------  ----------  FCRRGFPTAQ   60
SEQ-ID-NO-950              ----------  ----------  ----------  ----------  FCRRGFPTAQ   60
SEQ-ID-NO-932              ----------  ----------  ----------  ----------  ----------  170
SEQ-ID-NO-931              YS--------  ----------  ----------  ----------  ----------  184
SEQ-ID-NO-1844             Y---------  ----------  ----------  ----------  ----------  177
SEQ-ID-NO-911              Y---------  ----------  ----------  ----------  ----------  200
SEQ-ID-NO-907              HRS-------  EDSKSSSEET  DKSEQSIDDM  RTGRRSYECV  FCKRGFSTAQ  250
SEQ-ID-NO-922              HHPPMEANHL  ----------  ----------  ----------  ----------  195
SEQ-ID-NO-923              HKP-------  ----------  ----------  ----------  ----------  199
SEQ-ID-NO-929              HNP-------  ----------  ----------  ----------  ----------  156
SEQ-ID-NO-936              ----------  ----------  ----------  ----------  ----------  153
SEQ-ID-NO-947              ----------  ----------  ----------  ----------  ----------  137
```

Figure 10 (continued)

```
SEQ-ID-NO-948   ALGGHMNVHR KDRVGRATPS SSSSTTAAAA RRSVSYDTLV GLFLPPASCG   110
SEQ-ID-NO-950   ALGGHMNVHR KDRVGRATPS SSSSTTAAAA RRSVSYDTLV RLFRPPASCG   110
SEQ-ID-NO-932   ---------- ---------- ---------- ---------- ----------   170
SEQ-ID-NO-931   ---------- ---------- ---------- ---------- ----------   184
SEQ-ID-NO-1844  ---------- ---------- ---------- ---------- ----------   177
SEQ-ID-NO-911   ---------- ---------- ---------- ---------- ----------   200
SEQ-ID-NO-907   ALGGHMNIHR KDRVKSRPSS VPIVSLSGNK ADDKNYPSFR PYSYPPIHSY   300
SEQ-ID-NO-922   ---------- ---------- ---------- ---------- ----------   195
SEQ-ID-NO-923   ---------- ---------- ---------- ---------- ----------   199
SEQ-ID-NO-929   ---------- ---------- ---------- ---------- ----------   156
SEQ-ID-NO-936   ---------- ---------- ---------- ---------- ----------   153
SEQ-ID-NO-947   ---------- ---------- ---------- ---------- ----------   137

SEQ-ID-NO-948   SEDAAASTAA GGGGSLRSRT AEPAPQELRL FGRGAGRREE GGGRDRRDRY   160
SEQ-ID-NO-950   SEDAAASTAA GGGASLRSRT AEPAPQELRL FGRGAGRREE GGGRDRRDRY   160
SEQ-ID-NO-932   ---------- ---------- ---------- ---------- ----------   170
SEQ-ID-NO-931   ---------- ---------- ---------- ---------- ----------   184
SEQ-ID-NO-1844  ---------- ---------- ---------- ---------- ----------   177
SEQ-ID-NO-911   ---------- ---------- ---------- ---------- ----------   200
SEQ-ID-NO-907   QPHYSIAPEV ------HV SYQAFLPVSG WGFRLPPHTA QLFVDNSKHR   342
SEQ-ID-NO-922   ---------- ---------- ---------- ---------- ----------   195
SEQ-ID-NO-923   ---------- ---------- ---------- ---------- ----------   199
SEQ-ID-NO-929   ---------- ---------- ---------- ---------- ----------   156
SEQ-ID-NO-936   ---------- ---------- ---------- ---------- ----------   153
SEQ-ID-NO-947   ---------- ---------- ---------- ---------- ----------   137

SEQ-ID-NO-948   GCCSKDGDGN GGHDHGEEEE LDLELRLGGS GSAGS   195
SEQ-ID-NO-950   GCCSKDGDGN GGHDHGEEEE LDLELRLGGS GSAGS   195
SEQ-ID-NO-932   ---------- ---------- ---------- -----   170
SEQ-ID-NO-931   ---------- ---------- ---------- -----   184
SEQ-ID-NO-1844  ---------- ---------- ----------TT -----   177
SEQ-ID-NO-911   ---------- ---------- ---------- PPPSS   207
SEQ-ID-NO-907   NPFGEDDHEN KKADGYNDKE DELDLELRLG HDP--   375
SEQ-ID-NO-922   ---------- ---------- ---------- --P--   196
SEQ-ID-NO-923   ---------- ---------- ---------- --P--   200
SEQ-ID-NO-929   ---------- ---------- ---------- -----   156
SEQ-ID-NO-936   ---------- ---------- ---------- -----   153
SEQ-ID-NO-947   ---------- ---------- ---------- -----   137
```

Figure 11

| SEQ:ID:NO:1005 | ME-S-L-S | --- | --- | --- | -SKKRV | RNSD--- | --- | SV-EAKRL | -RD | 26 |
|---|---|---|---|---|---|---|---|---|---|---|
| SEQ:ID:NO:953 | MEKKLLDITR | TDSA-EKKRV | RDE-SFD--- | -ESVVD | SPEVKRLR | -RD | 39 |
| SEQ:ID:NO:971 | MAEETLTRTD | SAEPTDKKRV | RDE-S-D--- | -EAVLD | SPEVKRLR | -RD | 39 |
| SEQ:ID:NO:963 | ME-LLN--- | --- | -HKKRV | RDG-S--N--- | -GAVLD | SPEVKKIR | -RD | 30 |
| SEQ:ID:NO:955 | MD-ELN--- | --- | -SKKRV | RDD-S-D--- | -ES-DLD | FPEVKKLR | -RD | 29 |
| SEQ:ID:NO:977 | MD-------- | --- | -CKKRV | RDD-S-D--- | -ES-GLD | SPDVKRLR | -RD | 26 |
| SEQ:ID:NO:979 | MD-------- | --- | -CKKRV | RDD-S-D--- | -ES-VLE | SPEAKRLR | -RD | 26 |
| SEQ:ID:NO:999 | MEDSR--- | --- | -DRKRR | RDEAE-E--- | -ES-I-LE | SPEAKRLR | -RD | 28 |
| SEQ:ID:NO:985 | MESSSSSLLL | SSYAGNNKRA | RDADLE--- | -QE--- | AEAAKRMRPE | 42 |
| SEQ:ID:NO:995 | MESSSSLLL | SSYTGGNKRA | READLD--- | -VC-SAE | AEAAKRI-RPE | 42 |
| SEQ:ID:NO:1015 | MDSSNNNN | --- | -SHKRA | RDAE--- | -VA-SSAE | ADEAKRLRAE | 29 |
| SEQ:ID:NO:1009 | MESS--- | --- | -SHKRA | REAA-D--- | -E-KRLRPE | 31 |
| SEQ:ID:NO:991 | METS--- | --- | -SHKRA | REAV-D--- | LAAAGDGALP | EADAKRLRPQ | 35 |
| SEQ:ID:NO:993 | METS--- | --- | -SHKRA | REAV-DLAAA | AAAAGEAVWP | ESDAKRLRPQ | 38 |

| SEQ:ID:NO:1005 | -LLDIL DDSD | VC-TPS-HDLD | SF-MKTFQDEI | SPSPAPEF--- | -TG--- | -SST- | 68 |
|---|---|---|---|---|---|---|---|
| SEQ:ID:NO:953 | DLFFDVLDDSD | PE-PVSQDLD | SVMKSFEDEL | STVTT-T-A--- | -QG--- | -SSTA | 82 |
| SEQ:ID:NO:971 | DLFFDVFDDSD | PE-PVSQDLD | SVMKSFEDEL | SS--- | --- | AQPR | 74 |
| SEQ:ID:NO:963 | DLFGLLDDSD | PD-SLGQDLD | SVMKSFEQEI | SASSSSPV--- | -PVVDLT-SES | 76 |
| SEQ:ID:NO:955 | DLF--LDDSD | SL-PLNQDLA | SVMKSFEEEI | SAVPSTSTES | MPVVDLTSDS | 76 |
| SEQ:ID:NO:977 | DLLEFFDDAD | DA-PISSQDLD | SVMKSLQEEI | SGV--- | --- | ASDS | 62 |
| SEQ:ID:NO:979 | DLLEFFDDAD | DA-ASTQDLD | SVMKSLQEEI | SGV--- | -TSPDY | 62 |
| SEQ:ID:NO:999 | LFDILDDDA | EA--GDQDIA | SVMRSLEEEI | ALSSPPPP--- | -RALV | 71 |
| SEQ:ID:NO:985 | DLLDLLDDDA | DA-AAAGDLA | SVMRSLEEEI | C--- | -PPT--- | ADEL | 76 |
| SEQ:ID:NO:995 | DLLDLLDDDA | DAGGAAGDLA | SVMRSLEEEI | C--- | --- | AGDL | 76 |
| SEQ:ID:NO:1015 | DLLDMLDDDT | DA-AAAGDLA | SVMRSFEEEL | VAGDVA--- | --- | GDVA | 69 |
| SEQ:ID:NO:1009 | DLLDMLDDDA | DAGGAAGDLA | SVMRSLEEEI | GSFDEAGA--- | -PDA--- | AAAP | 75 |
| SEQ:ID:NO:991 | DLLDMLDDDT | EA-AAAGDLA | SVMRSLEEEI | ASFDEA--- | --- | AEAA | 74 |
| SEQ:ID:NO:993 | DLLDMLEDDT | DA-AAAGDLA | SVMRSLEEEI | ASFDEA--- | --- | AEAA | 77 |

Figure 11 (continued)

| SEQ ID NO | | | | | | |
|---|---|---|---|---|---|---|
| SEQ-ID-NO-1005 | SGERPELGFL | FEASDDELGL | | | ERVLA---- | 99 |
| SEQ-ID-NO-953 | GETQPDLGYL | LEASDDELGL | PPTE------ | --TN------ | VTDLVRASS- | 131 |
| SEQ-ID-NO-971 | GETQPDLGYL | LEASDDELGL | PPPPSISPVP | VAKEEVTTET | VADLVRASS- | 121 |
| SEQ-ID-NO-963 | GESQPDLGFL | LEASDDELGL | PPPP---PPVS | VVEEVTTET | ETELARVDSA | 122 |
| SEQ-ID-NO-955 | CDSQPDLGYL | LEASDDELGL | PPVS----IN | LSSGEVKGGV | ATDLVRADS- | 120 |
| SEQ-ID-NO-977 | GESQAQIGYL | LEASDDDLGL | PPPT-----A | STTDAEGRSE | ETELVRVAS- | 105 |
| SEQ-ID-NO-979 | GESQAQIGYL | LEASDDDLGL | PPAG------ | NSSAPEEKNV | EAELVRVAS- | 105 |
| SEQ-ID-NO-999 | KTDQPDLGFL | LEASDDELGL | PPPV----LS | NSSAPQEKNV | ADDPAAEGVA | 117 |
| SEQ-ID-NO-985 | MPPQPELGFL | LEASDDELGL | PPAA----- | SSDDGGEAPA | GWEPE----- | 115 |
| SEQ-ID-NO-995 | AAPQPELGFL | LEASDDELGL | PPAA-----G | GASSSSDDAG | GWEPE----- | 116 |
| SEQ-ID-NO-1015 | PTTQPELGFL | LEASDDELGL | PPAA------ | AASSSSDDAG | AGEPE----- | 107 |
| SEQ-ID-NO-1009 | PAHQPELGFL | LEASDDELGL | PPAT------ | -ASSSEEEAG | AGAPD----- | 114 |
| SEQ-ID-NO-991 | PSQQPELGFL | LEASDDELGL | PPAG----SA | ASSSEEEAVA | AGPPE----- | 115 |
| SEQ-ID-NO-993 | PSQQPELGFL | LEASDDELGL | PPAG-----S | AAASSEEAGL | AGPPEPAAP- | 121 |
| SEQ-ID-NO-1005 | ESVCL-SE-L | WGLDDEFIK- | | VY--DGDNNI | NNGEYVALDG | 142 |
| SEQ-ID-NO-953 | DSSGI-DE-T | WGFEDHVSN- | -YDSFESGF | GV----GDGG | -DYVAVEG | 169 |
| SEQ-ID-NO-971 | DSSGI-DE-T | WGFEDHVPD- | -YGGLDFGS | GV----GDCG | -DYVTVEG | 159 |
| SEQ-ID-NO-963 | QSSGVGGE-L | WGFEDQIPT- | -YGSLDFGS | GD---SNYSS | -DYVGFDD | 162 |
| SEQ-ID-NO-955 | NSSGIHD-L | WGFEEQNPN- | -YDSFGLGV | VDNFNDGT- | -VAYDG | 158 |
| SEQ-ID-NO-977 | DSSGI-GE-T | MEFEEEQIPR- | -YDSFEFGF | GFGYECDTT- | -EYAAFGG | 146 |
| SEQ-ID-NO-979 | DSSGI-GE-T | MEFEDQIPR- | -YDSFDLGM | GFGYECDAT- | -EYAAFCE | 146 |
| SEQ-ID-NO-999 | VEGVFGQ-T | WGLDDD-IGY | -YDIGFDLGI | GPDDRVDTTH | -EYDGVFYDG | 164 |
| SEQ-ID-NO-985 | EAAGLFGEQI | WGFEDEIDGA | YAFGGVAYSP | EAAAAAAAAA | AEWGDDGFDA | 165 |
| SEQ-ID-NO-995 | EPAGVFGEQI | WGFEDEIDGA | YAFGGVASSP | EAAAAAAAAA | AEWGDDGFDA | 166 |
| SEQ-ID-NO-1015 | DAIGFGQQ-T | WGFEDEIGGG | G--YAGFALTS | PEAVAAAAAA | AEWDDDFDA | 155 |
| SEQ-ID-NO-1009 | VAAGLDGQ-T | WGFEDEIDGG | FGGYSPEA | AA------ | AAWDDDFDA | 158 |
| SEQ-ID-NO-991 | PAAALYGQ-T | WGFDDEIDGG | FGGYSPEA | AA------ | AAWDDDVFGA | 159 |
| SEQ-ID-NO-993 | AAAALYGQ-T | WAFDDEIDGG | FGGYSPEA | AA------ | AAWDDDVFGA | 165 |

Figure 11 (continued)

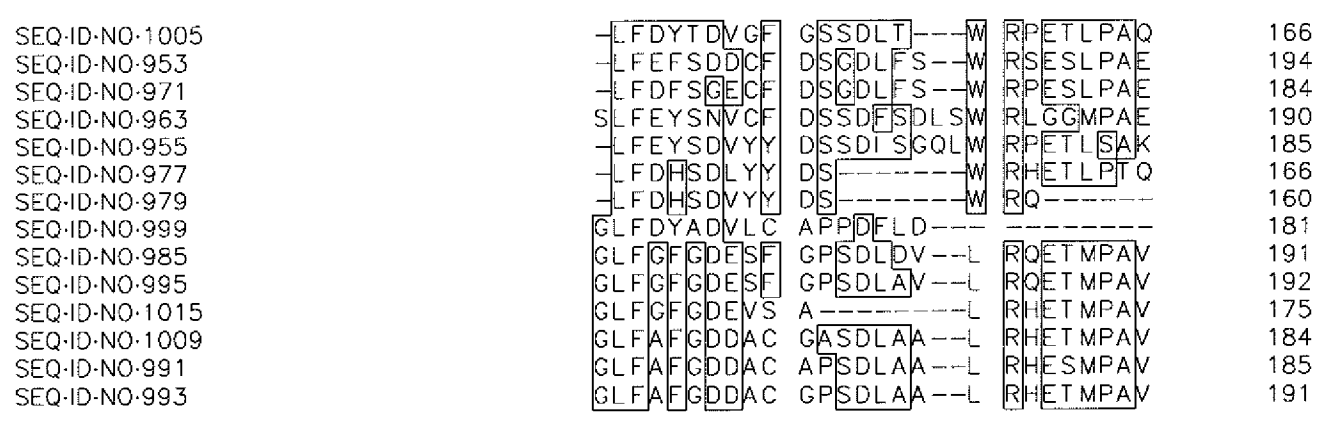

| | | | | |
|---|---|---|---|---|
| SEQ ID NO:1005 | LFDYTDVGF | GSSDLT--- | -W | RPETLPAQ | 166 |
| SEQ ID NO:953 | LFEFSDDCF | DSGDLFS-- | -W | RSESLPAE | 194 |
| SEQ ID NO:971 | LFDFSGECF | DSGDLFS-- | -W | RPESLPAE | 184 |
| SEQ ID NO:963 | SLFEYSNVCF | DSSDFSDLSW | | RLGGMPAE | 190 |
| SEQ ID NO:955 | LFEYSDVYY | DSSDISGQLW | | RPETLSAK | 185 |
| SEQ ID NO:977 | LFDHSDLYY | DS------- | -W | RHETLPT  | 166 |
| SEQ ID NO:979 | LFDHSDVYY | DS------- | -W | RQ------ | 160 |
| SEQ ID NO:999 | GLFDYADVLC | APPDFLD-- | -- | -------- | 181 |
| SEQ ID NO:985 | GLFGFGDESF | GPSDLDV-- | -L | RQETMPAV | 191 |
| SEQ ID NO:995 | GLFGFGDESF | GPSDLAV-- | -L | RQETMPAV | 192 |
| SEQ ID NO:1015 | GLFGFGDEVS | A-------- | -L | RHETMPAV | 175 |
| SEQ ID NO:1009 | GLFAFGDDAC | GASDLAA-- | -L | RHETMPAV | 184 |
| SEQ ID NO:991 | GLFAFGDDAC | APSDLAA-- | -L | RHESMPAV | 185 |
| SEQ ID NO:993 | GLFAFGDDAC | GPSDLAA-- | -L | RHETMPAV | 191 |

Figure 12

| | | | | | | |
|---|---|---|---|---|---|---|
| SEQ-ID-NO-1024 | MSRVLTCPPL | VFARNHVGVQ | NLVESTKLKR | | LEKKEKKEKR | 50 |
| SEQ-ID-NO-1039 | MSRYFTSPPPP | VYARNWANGQ | NLVESTKIER | TLDSKKAHR | KEKKERKKDK | 50 |
| SEQ-ID-NO-1042 | MSRCFPYPPP | VYLGNPV--- | AVAEAESTAK | QIVTSKKVHP | -KKDKRSDK | 45 |
| SEQ-ID-NO-1043 | MSRCFPFPPP | GYVRNPVAV | AAAEAQATTK | LQKERERAHK | -KKEKRSDR | 48 |
| SEQ-ID-NO-1040 | MSRCFPFPPP | GYMKLRFDL | DTPKKDRKKK | LQKEREKAEK | KEKREKRKRE | 49 |
| SEQ-ID-NO-1029 | MSRCFPYPPP | GYQIE---- | SIKRKEKEK | NRKEIDKNER | KEKKERRKHR | 45 |
| | | | | SITESHKDIK | | |

| | | | | | | |
|---|---|---|---|---|---|---|
| SEQ-ID-NO-1024 | KEKKETKREK | SHKHSIKAT- | -DNHHKLIFL | PSKKVS-DES | DSLEKSGLTD | 97 |
| SEQ-ID-NO-1039 | KQKNEKTIEH | --------- | -------VYL | PTKQVS-DES | EQLEKSCLTE | 82 |
| SEQ-ID-NO-1042 | KAPQLGETSK | HSKHNHKRK | LEDVSTGDQE | PKKVFK-ESA | ELLEKSGLSE | 94 |
| SEQ-ID-NO-1043 | KALPHGEISK | HSKRTHKKRK | HEDINNADQK | SRKVSSMEPG | EQLEKSGLSE | 98 |
| SEQ-ID-NO-1040 | KELKQKDSIT | SHASFGGAMK | LKDINGKLLM | GED---YEN | EQLERSGITE | 95 |
| SEQ-ID-NO-1029 | KENKDQCYT | VGKSHQKGK- | -------TFL | PR-----EKK | EEAEKSDLTE | 82 |

| | | | | | | |
|---|---|---|---|---|---|---|
| SEQ-ID-NO-1024 | ELEEP--QKH | LGYLSDGSQN | SKKRIRDDSP | PAVESLIKAA | PVAGKPLRIR | 145 |
| SEQ-ID-NO-1039 | EHEK------ | --YLSDGSQS | SKKR--REAS | PSVESNIKAT | PVTGNPLRIR | 123 |
| SEQ-ID-NO-1042 | EHGAPCFVQM | FRDSPESSQD | SSKKR--RKAVL | PSPSQA---- | -KNGNIIRIK | 138 |
| SEQ-ID-NO-1043 | EHGAPCFTQT | VHGSPESSQD | SSKKR--RKVVL | PSPSQA---- | -KNGNILRIK | 142 |
| SEQ-ID-NO-1040 | ELEQPVSSPQ | EPYSSDSTQS | SKRK-RCTLL | PNQDHE---- | -DAIKDR--- | 136 |
| SEQ-ID-NO-1029 | EHNEPVCLQN | CYLSDDGIR | SNKK-RKLEQ | ATNDDK---- | -PRNVFRIR | 125 |

| | | | | | | |
|---|---|---|---|---|---|---|
| SEQ-ID-NO-1024 | ----- | VFKKPKEEVP | TLPR-EAVVC | STTVAKSLS- | --------- | 174 |
| SEQ-ID-NO-1039 | F---- | VFKKPKEAEF | VVPQ-EDLVC | STS------- | --------- | 146 |
| SEQ-ID-NO-1042 | LKSNQDPQSV | LEKPRVLEQ | PLVQ-QMSSV | SSLSSKQNSI | -NRKVNVR | 184 |
| SEQ-ID-NO-1043 | RRDQDSSAS | LSEKSNVVQT | PI-VH-QMGSV | SSLPSKKNSM | QPHNTEMMWR | 190 |
| SEQ-ID-NO-1040 | L-------- | PLTKHSEPEK | SKQGFQFGSC | STSVGIGDSL | TQETRRIDRP | 177 |
| SEQ-ID-NO-1029 | L-------- | PLTRHKEPDV | PLN--SEGLC | STS-GRADSV | SGQNEGVHLS | 163 |

| | | | | | | |
|---|---|---|---|---|---|---|
| SEQ-ID-NO-1024 | ---------- | ---------- | ---------- | ---------- | ---------- | 174 |
| SEQ-ID-NO-1039 | ---------- | ---------- | ---------- | ---------- | ---------- | 146 |
| SEQ-ID-NO-1042 | S-TAGQQWVN | GDSQAVQKSL | VTETLSRAMQ | RTVPQPAVKV | TRRADPQLSV | 233 |
| SEQ-ID-NO-1043 | TASTQQQSIK | CDFQAV---- | ------LK | QGMPTPA-KV | MPRVDVPPSM | 227 |
| SEQ-ID-NO-1040 | L--------- | ---------- | ---------- | ---------- | ---------- | 178 |
| SEQ-ID-NO-1029 | ---------- | ---------- | ---------- | ---------- | ---------- | 163 |

Figure 12 (continued)

```
SEQ-ID-NO-1024  ----------  ----------  ----------  ----------  ----------  DVITSSISSS  186
SEQ-ID-NO-1039  ----------  ----------  ----------  ----------  ------HQGT  EISSSVSGHD  158
SEQ-ID-NO-1042  KAPVGRSDL-  PPKFSGSVGP  SPARVTCRFC  ----------  PAPVKTQQRI  EHPPSMVSQR  282
SEQ-ID-NO-1043  RASKERVGLR  PAEMLANVGP  SPSKAKQIVN  ----------  PAAAKVTQRV  DPPPAKASQR  277
SEQ-ID-NO-1040  ----------  ----------  ----------  ----------  -------TKV  ETPNQQLHRN  191
SEQ-ID-NO-1029  ----------  ----------  ----------  ----------  ------HQ--  ETVNSKAGTV  175

SEQ-ID-NO-1024  KTS-------  ----------  ----------  ----------  ---ELEKNL-  PSTSIAAIDE  205
SEQ-ID-NO-1039  ENL-------  ----------  ----------  ----------  -----LPASL  ESVETAILSE  176
SEQ-ID-NO-1042  VDP---QAKVS  QKEMGSAVCL  PQAP-----H  PPVLQKPKDL  PVPKQREPIN  325
SEQ-ID-NO-1043  LDPLLPSKVH  IDATRSFTKL  SQTEIKPEVQ  ----------  PPIPKVPVAM  PTINRQQIDT  327
SEQ-ID-NO-1040  SAS-------  ----------  ----------  ----------  -KVCKPLQNL  VPVDALEANK  213
SEQ-ID-NO-1029  VGE-------  ----------  ----------  ----------  ---LASPEKM  PCLSVSEKKS  195

SEQ-ID-NO-1024  TKKRK-----  ----------  ----------  ----------  --KHRSSKED  QYNALFDGWT  228
SEQ-ID-NO-1039  SKKKK-----  ----------  ----------  ----------  --KIHKTSKES  RYSSLFDFPV  199
SEQ-ID-NO-1042  SLPKEEPCFS  GRTVEADQGK  EAKLSRSDRK  KIHKTEKKNK  KFRDLFVTWN  375
SEQ-ID-NO-1043  SQPKEFPCSS  CRNAEAASVS  VEKQSKSDRK  KSRKAEKKEK  KFKDLFVTWD  377
SEQ-ID-NO-1040  TVDDE-----  ----------  ----------  ----------  ---SRCVES  LYKSLL---H  231
SEQ-ID-NO-1029  IVCHESGISR  FKLPN-----  ----------  ----------  --KKMRKADS  PYKVLIEDMV  228

SEQ-ID-NO-1024  PPSMCIADAS  SNDNGDYWLF  GNKTQEVLKP  KA----AVKV  DDDTMMRPGD  274
SEQ-ID-NO-1039  IPCLSIEEDD  GNS--DDWLL  SGRRQENSST  KS----TMDED  MVMNLQKSGE  244
SEQ-ID-NO-1042  PLLMENEGSD  LGG---QDWLF  SSTRSSDGSM  AQPTVPDGLG  PIHPMVQQQP  423
SEQ-ID-NO-1043  PPSMEMDDMD  LGD---QDWLL  GSTRKPDAGI  GN----CREIVD  PLTSQSAEQF  423
SEQ-ID-NO-1040  IQPIAYELFD  ALD---QDWLF  SSVKIEAKHV  SK-------K  QKTDAFRCSK  272
SEQ-ID-NO-1029  SPPPQFELND  SDD---QEWLS  EASKRERHGN  ------LN  ACRDVLCHES  270

SEQ-ID-NO-1024  SSWPRAQFLS  EVGLYSLPYT  VPF  297
SEQ-ID-NO-1039  SCFPSSQFLS  EVGTFSLPYT  VLF  267
SEQ-ID-NO-1042  YLQPRATELP  DLHIYQLPYV  VPF  446
SEQ-ID-NO-1043  SLQPRALHLP  DLHVYQLPYV  VPF  446
SEQ-ID-NO-1040  SLWPRAQFMP  EVNILALPYT  IPF  295
SEQ-ID-NO-1029  SLFPRGHYLP  EADVYALPYT  IPF  293
```

Figure 13

```
SEQ:ID:NO:1099  MAFLQDQFQR  H-YQQQQQPQ  P--------  ----------  ----------  28
SEQ:ID:NO:1139  MALPHHHLQL  H-IQQQPQQQ  S--------  ----------  ----------  27
SEQ:ID:NO:1100  MALPHHHLQL  H-IQQQPHQQ  Q--------  ----------  QTKSFRNL    30
SEQ:ID:NO:1101  MALPHHHLQL  HIQQQQPHQQ  Q--------  ----------  ---KSYRDIY  29
SEQ:ID:NO:1105  MAVQAQHLSH  A-FPHDLHAY  N--------  ----------  QQSKSYRDLY  22
SEQ:ID:NO:1134  MAVQAQYLSH  ASFPHDLYGL  R--------  ----------  ---SKSYRDLY 21
SEQ:ID:NO:1111  MAVEAHSLLL  A-GGHKQLTS  A--GWPWTT  ----------  -----SV     42
SEQ:ID:NO:1131  MAVEAHLLLH  A-GGQRPQLL  APHEGWAW-A ----------  ----------  48
SEQ:ID:NO:1047  MAVQAHHMN-  -FSQFISPN   R--------  GDEARC---   ATARPSHQQA  21
SEQ:ID:NO:1083  MPVQARHMN-  -FSPQLLSN   R--------  GDAACCEAPA  ATAAGQGQRR  19
SEQ:ID:NO:1085  MAVEASYMNL  -LPSQLLTN   R--------  ----------  ---DC       29
SEQ:ID:NO:1053  -MH-------  -EGSQLLPL   Y--------  ----------  ELIKSNQQLQ  11
SEQ:ID:NO:1057  MAVEAPHTNL  N-FPSHLLTN  R--------  ----------  DFAKVNQANM  30

SEQ:ID:NO:1099  QTEGQMSQQ   MAFYNPT--D  LQDQSQHPPY  PPF---GFA   PGPVIPA--D  71
SEQ:ID:NO:1139  NNMDGQISTP  VAYFNGS--N  LPEQSQHPPY  PPFQVVGLA   PG------L   68
SEQ:ID:NO:1100  NNMDGQITNP  VVYFNGS--N  LPEQSQHPPY  PPFQVVGLA   PG------T   71
SEQ:ID:NO:1101  NNMDGQITTP  VVYFNGS--N  LPEQSQHPPY  PPEQVVGLA   PG------T   70
SEQ:ID:NO:1105  GALEDEMTGG  SLFF-----  -PENLKRGPE  LEGAGNTVFG  DIPRVDP--T  63
SEQ:ID:NO:1134  -ALEGATAAG  SLFLDDH--G  CCAPATPAAA  AAGIGHTVLS  DLPRSELT-C  67
SEQ:ID:NO:1111  FQLQQASCVG  VGVGLPA--A  APVSSAAAAP  PAPMIAQQYA  AGCRLFVG-D  89
SEQ:ID:NO:1131  LAGKQQQQQH  YRFQQPC--A  A-TPAAAAGP  RLVAPTGRYA  PGPQLCAA-D  94
SEQ:ID:NO:1047  VKFQENMNHG  EFEFTGG--  -EVPLIT     GESFAVEPLA  AKANF---N   60
SEQ:ID:NO:1083  VNFKQDMNHG  EFITGET--L  AVDPLSNAAA  KPSF-----   CDP------N  52
SEQ:ID:NO:1085  HQLNSDYMYN  TTTQMDSSSA  LPQPATMPES  LSFYQSNF-   -QPL-----N  72
SEQ:ID:NO:1053  ----------  ---------  ----------  ----------  CHPNISA--N  23
SEQ:ID:NO:1057  SLYNTQMDSG  LVFNEP---   ----MPET    MPET        LSFYQSSLG   CDPVSAKASN 70
```

Figure 13 (continued)

| SEQ-ID | Seq1 | Seq2 | Seq3 | Seq4 | Seq5 | # |
|---|---|---|---|---|---|---|
| SEQ-ID-NO-1099 | GSDGGV-DLH | WNFGLE--- | ---PERKRLKE | QDFLENNSQ- | ISSVDFLQPR | 113 |
| SEQ-ID-NO-1139 | VDDGGL-DLQ | WNYGLE--- | -PKRKKRPKE | QDFLENNNSQ | ISSIDFLQPR | 111 |
| SEQ-ID-NO-1100 | ADDGGL-DLQ | WNYGLE--- | -PKKKRPKE | QDFMENNNSQ | ISSVDLLQRR | 114 |
| SEQ-ID-NO-1101 | ADDGGL-DLQ | WNYGLE--- | -PKKKRPKE | QDFMENNNSQ | ISSVDLFQRR | 113 |
| SEQ-ID-NO-1105 | WHDNTTRSHG | F--------- | -AQRKRARV | VPEAPSYLE- | ---------- | 91 |
| SEQ-ID-NO-1134 | NDNNGA-GYG | F--------- | -VPRKRARL | -DADESAGAL | MAAAAAQQQR | 104 |
| SEQ-ID-NO-1111 | AAESGV-TFG | GGGAV-QQE- | -APRKRKRA | ---------- | ---------- | 114 |
| SEQ-ID-NO-1131 | ASESCV-TFG | GGGGG-AQQQ | AMAPRKRKRA | ---------- | ---------- | 122 |
| SEQ-ID-NO-1047 | KAESGL-SYN | FTVPP----- | -LSTKRQRD | FQFSDSNAPV | ---------- | 92 |
| SEQ-ID-NO-1083 | KSESGL-TYN | FNSFNVVP-- | PPPRKRPRV | SQYLDSDARF | ASAV------ | 91 |
| SEQ-ID-NO-1085 | KADSGL-TYH | -P-------- | -LQRKRSRD | FTTELTSL-- | ---------- | 99 |
| SEQ-ID-NO-1053 | KADSGLTTYN | MSIPVS---- | -APRKRSRD | SFTNGFDS-- | ---------- | 55 |
| SEQ-ID-NO-1057 | KDDSGL-TYN | VPAVV----- | -APRKRSRD | SINDNFDAF- | ---------- | 101 |
| SEQ-ID-NO-1099 | SVSTGLGLSL | DNTRLASTGD | SALLSLIG-- | ----DDI--- | DRELQ-QQDL | 153 |
| SEQ-ID-NO-1139 | SVSTGLGLSL | DNGRLASSGD | SAFLGLVG-- | ----DDI--- | ERELQ-RQDA | 151 |
| SEQ-ID-NO-1100 | SVSTGLGLSL | DNGRLASSCD | SAFLGLVG-- | ----DDI--- | ERELQ-RQDA | 154 |
| SEQ-ID-NO-1101 | SVSTGLGLSL | DNGRLASSCD | SAFLGLVG-- | ----DDI--- | ERELQ-RQDA | 153 |
| SEQ-ID-NO-1105 | -NQRGQGLVP | VGDVLTRAVG | SGTASTSGRM | INAACPPQDL | LSQLY-RQGM | 139 |
| SEQ-ID-NO-1134 | MVLPPHGLVF | PGDVQSRAVG | CGAASTSGRA | GNAAGLSQGL | LSQLY-HQGV | 153 |
| SEQ-ID-NO-1111 | ---------- | ---EQGQTP | PPVLGTGA-- | ----ADV--- | AAQFQ-QQLV | 140 |
| SEQ-ID-NO-1131 | ---------- | ---GEGQ-P | APALRLAS-- | ----ADV--- | AARFQ-QQLV | 147 |
| SEQ-ID-NO-1047 | ---------- | ---KRRSVAFD | SSSPSLIN-- | ----VEL--- | VSQI-QNQQQS | 121 |
| SEQ-ID-NO-1083 | ---------- | ---KLGSGPFG | SPS-SLIN-- | ----AEL--- | VSHI-QNQQQL | 119 |
| SEQ-ID-NO-1085 | ---------- | ---PAHQKNKI | SSDPSFLN-- | ----QEI--- | LYQFQ-NQQS | 127 |
| SEQ-ID-NO-1053 | ---------- | ---YSLPQNNN | LSGASSDV-- | ----DDV--- | FSQIQ-QQH | 82 |
| SEQ-ID-NO-1057 | ---------- | ---HASQKTKV | CPFSSFID-- | ----QDI--- | FQIQ-QQQS | 129 |

Figure 13 (continued)

| SEQ-ID-NO-1099 | EMDRFLKLQG | EQLRQTILEK | VQATQLQSVS | IEDKVLQKL | REKETEVEN | 203 |
|---|---|---|---|---|---|---|
| SEQ-ID-NO-1139 | EIDRYIKVQG | DRLRQAJLEK | VQANQLQTVT | YVEEKVLQKL | REKETEVEDI | 201 |
| SEQ-ID-NO-1100 | EIDRYIKVQG | DRLRQAVLEK | VQANQIQAIT | YVEEKVLQKL | RERDTEVDDI | 204 |
| SEQ-ID-NO-1101 | EIDRYIKVQG | DRLRQAVLEK | VQANQIQAIT | YVEEKVLQKL | RERDTEVDDI | 203 |
| SEQ-ID-NO-1105 | EIDAVLRLET | DRMRAGLEEA | RQQHVRALVS | AAERAAARRL | RAAEAALELA | 189 |
| SEQ-ID-NO-1134 | EIDALVRLES | ERMRAGLEEA | RRRHVRAVVS | TVERAAAGRL | RAAEAELERA | 203 |
| SEQ-ID-NO-1111 | DVDRLVLQHT | AKMWAGLTEQ | RRRHARQVVA | TVEAAAAPRL | RAKEEEIQRM | 190 |
| SEQ-ID-NO-1131 | DVDRLVLQHT | SKMWADLREQ | RRRHAGQVVA | AVEAAAAKRL | RAKDEEIEHI | 197 |
| SEQ-ID-NO-1047 | EIDRFVAQQT | EKLRIEIEAR | QQTQTRMLAS | AVQNMLAKKL | KEKDDEIVRI | 171 |
| SEQ-ID-NO-1083 | EIDRFVAQQT | EKLRIEIEAR | QQTQTQMLAS | AVQNALAMKL | KEKDDEILRM | 169 |
| SEQ-ID-NO-1085 | EIDRVLAHHT | EKVRMELEEQ | KMRQSRMFVS | AIQEAMAKKL | KEKDQEIQRM | 177 |
| SEQ-ID-NO-1053 | DIDRFISDHT | EKLRLEVEER | RKRQSRMFTT | AIQERVMKKL | KEKDEEIQRI | 132 |
| SEQ-ID-NO-1057 | EIDRFIAEHN | QKVRMELEDR | RKRQSRMLVS | AIQGGMVRKL | TEKDEEIQRM | 179 |

| SEQ-ID-NO-1099 | NKRNMELEDQ | MEQLSVEAGA | WQQRARYNEN | MIAALKFNLQ | QAYLQGRDSK | 253 |
|---|---|---|---|---|---|---|
| SEQ-ID-NO-1139 | NKKNMELELR | TEQLALEANA | WQQRAKYNEN | LINTLKVNLQ | HVYAQSRDSK | 251 |
| SEQ-ID-NO-1100 | NKKNMELELR | MEQLALEANA | WQQRAKYNEN | LINTLKVNLQ | HVYAQSRDSK | 254 |
| SEQ-ID-NO-1101 | NKKNMELELR | MEQLDLEANA | WQQRAKYNEN | LINTLKVNLQ | HVYAQSRDSK | 253 |
| SEQ-ID-NO-1105 | RCRNAKLSER | TQICAEGQA | MTRVAKSHEA | VAAGLQATLD | QLLQSPCAAV | 239 |
| SEQ-ID-NO-1134 | RCRNMELEER | LRQMTAEGQA | WLSVAKSHEA | VAAGLRAITLD | QLLQSPCAAL | 253 |
| SEQ-ID-NO-1111 | RRVNWALEER | VKSMYVEAHM | WRDLAQSNDA | AVTIALRGELQ | QALDAQQTRR | 240 |
| SEQ-ID-NO-1131 | GRLNWALEER | VRSLYVEAQV | WRDLAQSNEA | AANALRGELQ | QALDAQQAR— | 246 |
| SEQ-ID-NO-1047 | RNLNWVLQER | VKSLYVENQI | WRDIAQTNEA | NANTLRTNLD | QVLAQIEFFP | 221 |
| SEQ-ID-NO-1083 | RNLNCVLQER | VKSLCMENQI | WRELAQTNES | QANNLRTNLD | QVLAQIELLP | 219 |
| SEQ-ID-NO-1085 | GKLNWALQER | VKSLYVENQL | WRDIAQTNEA | TANYLRSNLE | QVLAHVGEER | 227 |
| SEQ-ID-NO-1053 | GKLNWVLQER | VKSLYVETQI | WRDLAQTNEA | TANSLRNNLE | QVLAHAGDS— | 181 |
| SEQ-ID-NO-1057 | GKLNWVLQEK | VKSLYVETQI | WRDLAQANEA | TANSLRSNLE | QVLAHVSEDR | 229 |

Figure 13 (continued)

| SEQ-ID-NO | | | | | | |
|---|---|---|---|---|---|---|
| SEQ-ID-NO-1099 | EGCG---- | -------- | DSEVDDTAS | -CCNGRSLD- | -------- | -NSNMKDLMK-- | 290 |
| SEQ-ID-NO-1139 | EGCG---- | -------- | DSEVDDTAS | -CCNGRATD- | -FHLLSNE- | -SNEMKELMT-- | 288 |
| SEQ-ID-NO-1100 | EGCG---- | -------- | DSEVDDTAS | -CCNGRATD- | -LHLLCRD- | -SKEMKELMT-- | 291 |
| SEQ-ID-NO-1101 | EGCG---- | -------- | DSEVDDTAS | -CCNGRATD- | -LHLLCRD- | -SKEMKELMT-- | 290 |
| SEQ-ID-NO-1105 | AATGADG- | -------- | DGDAEDARS | -CCFETPAG- | -LHLLCRD- | -DAAASKASA-- | 273 |
| SEQ-ID-NO-1134 | AVAGAAGAGG | -------- | AEGDAEDAQS | -CCYETPCG- | -------D | -DAAASKTPAA-- | 297 |
| SEQ-ID-NO-1111 | -------- | -------- | -RADDADS | CCCGENDVFI | -GDNAGAD | -EAGTSSSSG-- | 276 |
| SEQ-ID-NO-1131 | ---CG-- | -GGVL | ADGGAGDAES | CCCGENDVA- | TEAGAAENEE | -DEGEDEAGT-- | 287 |
| SEQ-ID-NO-1047 | TAS----- | -------- | -AVVEDDAES | -SCGSC--- | -AGGTGAG | -EAVTAVGGG-- | 253 |
| SEQ-ID-NO-1083 | -------- | -------- | -TAVENDVES | -SCGSCVEG- | -CGDGCC | -EAITAVSGG-- | 246 |
| SEQ-ID-NO-1085 | ---GG-- | -------- | -ATVADDAQS | -SCGSNDAA- | ------G | -ASAAAATGRG-- | 260 |
| SEQ-ID-NO-1053 | -------- | -------- | -AALADDAES | -SCGSSDQGW | -EAGNDTA | -SCGAQDNNKA | 223 |
| SEQ-ID-NO-1057 | YING--- | -------- | -ATVADDAES | -SCGSSDHG- | REVVTPQAQG | -EEGAVKDKLV | 269 |

| SEQ-ID-NO | | | | | | |
|---|---|---|---|---|---|---|
| SEQ-ID-NO-1099 | -------- | -------- | -CKAC | RVNEVTMVLL | PCKHLCLCKD | C-ESK-LSFC | 322 |
| SEQ-ID-NO-1139 | -------- | -------- | -CKVC | RVNEVSMLLL | PCKHLCLCKE | C-ESK-LSLC | 320 |
| SEQ-ID-NO-1100 | -------- | -------- | -CRVC | RTNEVCMLLL | PCKHLCLCKE | C-ESK-LSLC | 323 |
| SEQ-ID-NO-1101 | -------- | -------- | -CRVC | RTNEVCMLLL | PCKHLCLCKE | C-ESK-LSLC | 322 |
| SEQ-ID-NO-1105 | -------- | -AACRAC | GEGESCVLLL | PCRHLCLCSA | C-DAA-VDTC | 307 |
| SEQ-ID-NO-1134 | -------- | -ALCKAC | GAGEASMLLL | PCRHLCLCRC | C-EAA-VDAC | 331 |
| SEQ-ID-NO-1111 | -------- | -HVI RACAVC | GDNAADVLLL | PCRHLCACAP | C-AAA-ARAC | 313 |
| SEQ-ID-NO-1131 | -PGT--- | -RRMCTVG | CEGAAEVLML | PCRHLCACAP | C-AGA-ARAC | 325 |
| SEQ-ID-NO-1047 | -------- | -CKRC | GEREASVLVL | PCRHLCLCTV | CGGSALL-RTC | 287 |
| SEQ-ID-NO-1083 | -------- | -RLCKNC | GEREASVLVL | PCRHLCLCTV | C-GSALL-RTC | 279 |
| SEQ-ID-NO-1085 | -------- | -CKRC | GLRESVLLL | PCRHLCLCTM | C-GST-VRNC | 294 |
| SEQ-ID-NO-1053 | VVVGNN-- | -NRKCRKC | GEKESSVLLL | PCRHLCLCTM | C-GST-MVGTC | 265 |
| SEQ-ID-NO-1057 | VVKDNNSSKN | I NHNRMCKKC | GERESSVLLL | PCRHLCLCTL | C-GSNL-GTC | 318 |

Figure 13 (continued)

| SEQ-ID-NO | Sequence | # |
|---|---|---|
| SEQ-ID-NO-1099 | PLCQSSKFIG MEVYM- | 337 |
| SEQ-ID-NO-1139 | PLCQSTKYIG MEIYM- | 335 |
| SEQ-ID-NO-1100 | PLCQSTKYIG MEVYM- | 338 |
| SEQ-ID-NO-1101 | PLCQSTKYIG MEVYM- | 337 |
| SEQ-ID-NO-1105 | PLCATTKNAS LHVLLS- | 323 |
| SEQ-ID-NO-1134 | PVCAATKNAS LHVLLS- | 347 |
| SEQ-ID-NO-1111 | PACGCAKNGS VCVNFS- | 329 |
| SEQ-ID-NO-1131 | PACGCAKNGS VCVNFS- | 341 |
| SEQ-ID-NO-1047 | PVCDMVMNAS VHVNMSS- | 304 |
| SEQ-ID-NO-1083 | PVCDSVMNAS VHVNMSS- | 296 |
| SEQ-ID-NO-1085 | PICDSDMDAS VHVNLS- | 310 |
| SEQ-ID-NO-1053 | PVCLSLTNAS VHVNML- | 281 |
| SEQ-ID-NO-1057 | PVCDSVMDAS VHVNMA- | 334 |

[Figure: Multiple sequence alignment showing protein sequences for SEQ-ID-NO-1258, 1263, 1211, 1215, 1264, 1209, 1223, 1246, 1151, 1155, and 1172.]

Figure 14 (continued)

| SEQ ID | Sequence | # |
|---|---|---|
| SEQ-ID-NO-1258 | R----WEQEM--------QQQQ YQQQ-MACYT QSQI PAG----TVWMVPSS | 255 |
| SEQ-ID-NO-1263 | R----RSEDKD LQHNNYHMSN MLQSSTYGSI PASHQIGHIP | 226 |
| SEQ-ID-NO-1211 | R----PEQEL---SQMGS YLIQSSTGSL PASHASN---- ATTLYMMTNN | 295 |
| SEQ-ID-NO-1215 | RTSSGGSEQD LSSLQHQMGS YLMQSSAGSI PASHTQI---- TAAFWMVAGH | 319 |
| SEQ-ID-NO-1264 | R----AEQELQ QHQ-HHQIGN YLVQSSTGPM AASHASI---- PANIWMVANS | 285 |
| SEQ-ID-NO-1209 | ----------DEMGS FATPACFWAV PARPDFG---- PANFMTLANS | 180 |
| SEQ-ID-NO-1223 | ----------VTAAM APAP-GFWAL PARGDFG---- QVWSFASH | 201 |
| SEQ-ID-NO-1246 | ----------EPTVA APAP-GFWAL PCRADLG---- QLWSFAPP | 165 |
| SEQ-ID-NO-1151 | S---------ETSGP TAAP-MWAVA PPSRSGA---- QLWSFAAA | 263 |
| SEQ-ID-NO-1155 | RTGMPEQEPG LF---QITNV MPAPAMWAVA PATTNGG---- GNTFWMLPVP | 246 |
| SEQ-ID-NO-1172 | RAGVQDQETA GSI-RPTTNM LPTPMWAVA PAATTNG---- NAFWMLPVG | 299 |
| | | |
| SEQ-ID-NO-1258 | ---NAQAAGG GAPPGGGG--- -----ESIWT FPQSC-SCGG GGAATVYRGV | 294 |
| SEQ-ID-NO-1263 | ---NNNTSHH DPNN------ ----CSMWA SPSNS---- --NIENS | 252 |
| SEQ-ID-NO-1211 | ---GNQAMSG GGSVGGCNNG SSDN-NPIWA LPSVG---- --NSGVYRGA | 334 |
| SEQ-ID-NO-1215 | ---NNQIMSG G--------- -----DPIWT FPSVN NNSA NSAAALYRGA | 347 |
| SEQ-ID-NO-1264 | ---SNNNNNN NNNNNNNGMG S---DPIWT QQAAM AAAAXLYRGT | 328 |
| SEQ-ID-NO-1209 | ---QEMFLQQ QQQQQQQPAA AALFVHQQQQ APAMA | 212 |
| SEQ-ID-NO-1223 | ---P------ ----------VAAAA EMMAA | 212 |
| SEQ-ID-NO-1246 | ---PEMM--- ---------- ---------- TPAMA | 179 |
| SEQ-ID-NO-1151 | TTAGNQMESS SNNNTAAGHR A-----PPMWP FVNSAGGGAG GGGGAATHFM | 309 |
| SEQ-ID-NO-1155 | ---GGATAAS ATVPE----- -----AQMWT FPAHY---- | 268 |
| SEQ-ID-NO-1172 | ---GGATPLS SVQE------ -----PQMWT FPAAA---- AGVPSMQRVN | 330 |
| | | |
| SEQ-ID-NO-1258 | ---PSGLHFM NFPATPM--- ------AL-- PGGQQLGLAG AGGG-GEGHP | 330 |
| SEQ-ID-NO-1263 | NIRGGLLNFM NFHQPTL--- ---------- -GTRGGGGGGG TA---AEGQW | 285 |
| SEQ-ID-NO-1211 | MSAPGCIHFM NF-ASPMNLM PGGQLGSGIV GGGGGGGNL- GAQLLSESNL | 383 |
| SEQ-ID-NO-1215 | VS-TSGLHFM NF-PQPMALL PGGQLG-NSS GGGGGGNL-- MNMMMNEGHL | 394 |
| SEQ-ID-NO-1264 | V---SSGLHFM NF-PAPV--- ------AL-- PSQQIGGNV- -LGEGQL | 360 |
| SEQ-ID-NO-1209 | ---------- ---------- ---------- GEASAARVG NYLP-GHL | 228 |
| SEQ-ID-NO-1223 | ---------- ---------- ---QLG-SFL GEASAARVG NYLPMAQANL | 231 |
| SEQ-ID-NO-1246 | ---------- ---------- ---QLG-SMI GEASAARVG NYLPMAQGNL | 198 |
| SEQ-ID-NO-1151 | AGTGFSFPMD QYRGSPL--- ---QLG-SMI AQPQPTQNLG LSMP--DSNL | 350 |
| SEQ-ID-NO-1155 | --SGGGR--- ---GNPV--- ---------- LQQQQAGQQ LGLGVTETNM | 303 |
| SEQ-ID-NO-1172 | FGGGGGRV-- ----SSPV--- ---------- VQQQVGANQQ LGLGISESNM | 368 |

Figure 14 (continued)

| | | | | | | | |
|---|---|---|---|---|---|---|---|
| SEQ-ID-NO-1258 | GIL-AALNAY | RAQAAQPDAG | AAAQNGAQGS | SQHRQHQHHG | GGGGGDERH | 379 |
| SEQ-ID-NO-1263 | GMLT-AAMNSY | RQ------- | ---SGG---- | ----HASGSS | NQHNGGDDHQ | 316 |
| SEQ-ID-NO-1211 | GML-AALNAY | RQIPAN---- | ---GVS---- | ----EPPGSA | GQHHGGDDGR | 417 |
| SEQ-ID-NO-1215 | SML-AGLSPY | RPVSDHHQQH | HQPSGS---- | ----QSHHHR | SGSHEHDDRH | 435 |
| SEQ-ID-NO-1264 | G---NFMNPY | RNIGG----- | ---------- | ----ASESQA | SGSHGGDDRH | 391 |
| SEQ-ID-NO-1209 | NLL-ASLS-- | ---------- | ---GGA---- | -------PG | SGRREDDQR- | 249 |
| SEQ-ID-NO-1223 | NLL-ASFS-- | ---------- | ---GGP---- | ----GCAGQA | TGRAEEETAH | 257 |
| SEQ-ID-NO-1246 | NLL-AYFS-- | ---------- | ---GGP---- | ----APTAT | AGRAEEESAR | 223 |
| SEQ-ID-NO-1151 | GML-AALNSA | YSRGGNAN-- | ---ANAEQAN | NAVEHQEKQQ | QSDHDDDSRE | 394 |
| SEQ-ID-NO-1155 | GLLGSGMNVY | SN-------- | ---NNRVGLK | MNLEQQHHHE | NQTQGSDSGD | 342 |
| SEQ-ID-NO-1172 | GMLGGVNPY | SSSRVGLG-- | ---MNL---- | ----EHHNQD | NQPQGSDSGD | 405 |

| | | |
|---|---|---|
| SEQ-ID-NO-1258 | ESMSASDS | 387 |
| SEQ-ID-NO-1263 | HHS----- | 319 |
| SEQ-ID-NO-1211 | DSTSQHS- | 424 |
| SEQ-ID-NO-1215 | DN------ | 437 |
| SEQ-ID-NO-1264 | DSTSHHS- | 398 |
| SEQ-ID-NO-1209 | -------- | 249 |
| SEQ-ID-NO-1223 | -------- | 257 |
| SEQ-ID-NO-1246 | -------- | 223 |
| SEQ-ID-NO-1151 | ENSNSSE- | 401 |
| SEQ-ID-NO-1155 | ENPATDSQ | 350 |
| SEQ-ID-NO-1172 | ENPNDSQ- | 412 |

| | | | | | | |
|---|---|---|---|---|---|---|
| SEQ-ID-NO-1301 | SGDVGT | LLKWRAR | YGS | TLQSCVI | LGG | TL V DR | 180 |
| SEQ-ID-NO-1317 | SGDVGT | LLKWRAE | YGS | TLQSCVI | LGG | TR V DR | 178 |
| SEQ-ID-NO-1303 | AGEL D | MLKWKA | DFGS | TLGSCVI | LGA | SSASASPSPS | 233 |
| SEQ-ID-NO-1326 | AGEL S | LLKWKA | DFGS | TLGSCVI | LGA | SSA GK | 236 |
| SEQ-ID-NO-1279 | G GEL GI | LLKWRA | DFGS | TLDSCVI | LGA | ASVF NNVHFQ | 219 |
| SEQ-ID-NO-1285 | SGEL GI | LLKWRA | DFGS | TLDNCVI | LGA | ASVI TNN--K | 228 |
| SEQ-ID-NO-1294 | SGEL GI | LLKWRA | EFGS | TLENCVI | LGA | SSVI P-- | 213 |
| SEQ-ID-NO-1277 | SGEL GI | LLKWRA | EFGS | TLDNCVI | LGA | SSVI | 228 |

| | | | | | | |
|---|---|---|---|---|---|---|
| SEQ-ID-NO-1301 | ---- | EPSAAED | GGS | MPESFYTNGG | S | KLRVVWTI S | 226 |
| SEQ-ID-NO-1317 | ---- | HEPSLED | NGS | MPESFYTNGG | S | KLRVVWTI S | 224 |
| SEQ-ID-NO-1303 | PS--- | EPDECV | DSGS | IPESFYTNGG | S | F KLRVVWTI S | 281 |
| SEQ-ID-NO-1326 | PA--- | D | -- E T GS | IPESFYTSGG | S | KLRVVWTI S | 279 |
| SEQ-ID-NO-1279 | INGS | NVGNG D | --- | IPESFYTNGG | S | KLRVVWTI S | 264 |
| SEQ-ID-NO-1285 | AA-- | AAAADD | --- | IPESFYTNGG | S | KLRVVWTI S | 271 |
| SEQ-ID-NO-1294 | SS-- | AP VAAV | E-- | IPESFYTNGG | S | KLRVVWTI S | 256 |
| SEQ-ID-NO-1277 | VE--- | APGSGS | D-- | IPESFYTNGG | S | KLRVVWTI S | 271 |

| | | | | | | |
|---|---|---|---|---|---|---|
| SEQ-ID-NO-1301 | LLRSI | KEHP | TL RSLVLA DA | DGQGT L CMGA | EQLA E FRESR | LSASAC SNRT | 276 |
| SEQ-ID-NO-1317 | LLRSI | KDHP | TL TSLVLTDA | DGQGT L CMGA | EQLKEFRENQ | SASACSNRT | 274 |
| SEQ-ID-NO-1303 | LLQPI | ADHK | TLER DL TDA | DGQGVLT MDK | CQLQELRVRP | VS T SRGSHRT | 331 |
| SEQ-ID-NO-1326 | LLQPI | ADHT | TLESLDL TDA | DGQGVLT MDK | WQLQELRVKP | VSASGGSHRT | 329 |
| SEQ-ID-NO-1279 | LLQSI | AEHK | TLDSLVLTDA | DGQGVLCMNG | EQLEELRVKP | LSASSASKRT | 314 |
| SEQ-ID-NO-1285 | LLQPI | AEHK | TLDSLVLA DA | DGQGVLCMNR | EQLEELRVKP | LSASSASKRT | 321 |
| SEQ-ID-NO-1294 | LLQPI | AEHK | TLDSLVLTD V | DGQGVLCMNR | DQLEELRVKP | LSASSASKRT | 306 |
| SEQ-ID-NO-1277 | LLQPI | AEHK | TLDSLVLTDS | DGQGVLCMNR | DQLEELRVKP | LAASSASKRT | 321 |

| | | | | | | |
|---|---|---|---|---|---|---|
| SEQ-ID-NO-1301 | QVPA C SMKLK | YAPYLELPGG | L GL QGATLVA | IKPSG D GA CG | CH V GRKETE A | 326 |
| SEQ-ID-NO-1317 | QVPA C NMKLK | YAPYLELPGG | A L QGATLVA | KPST EGSNG | GHTSRKETDA | 324 |
| SEQ-ID-NO-1303 | L MPE L SM W L W | YAPC ELPGG | LVL NGATLVA | KPSEEGTGD | TVWNGA AGAA | 381 |
| SEQ-ID-NO-1326 | L MPALSMRLW | YAPHI ELPCG | LVL NGATLVA | KPTEEATRD | TVGS G I AGSA | 379 |
| SEQ-ID-NO-1279 | L VPALNMRLW | YAPH L DLPDG | VVL QGATLVA | RPSEQS ASK | KEVSD A S | 361 |
| SEQ-ID-NO-1285 | L VPALNMRLW | YAPH L ELPDG | VVLKGATLVA | RPSEQ AATK | KDVSDVS | 368 |
| SEQ-ID-NO-1294 | L VPALNMRLW | YAPS L ELPDG | T VLKGATLVA | RPSE -- SK | KEV C DVS | 350 |
| SEQ-ID-NO-1277 | L VPALNMRLW | YAPT L ELPDG | TVLKGATLVA | RPSE --- SK | KEVSDIS | 365 |

Figure 15 (continued)

| | | | | | |
|---|---|---|---|---|---|
| ---FVSGAFD | GPFRFAAKAL | MKRRTYLLEM | NGF | 356 | SEQ-ID-NO-1301 |
| ---FISGAFD | GPFKVAVKAL | TKRRTYLLEM | NGF | 354 | SEQ-ID-NO-1317 |
| ---WVLDAFE | EPYRTAVRML | LKQRTYSLEM | NSF | 411 | SEQ-ID-NO-1303 |
| GGCWVSDAFE | EPYRTAVGML | LKRRTYSLEM | NSF | 412 | SEQ-ID-NO-1326 |
| ---WLSSAFE | EPYGTAAKML | VKRRTYCLEM | NSF | 391 | SEQ-ID-NO-1279 |
| ---WVSTIFE | EPYGTAAKML | VKRRTYCLEM | NSF | 398 | SEQ-ID-NO-1285 |
| ---WVSSAFD | EPYGVAAKML | VKRRTYCLEM | NSF | 380 | SEQ-ID-NO-1294 |
| ---WVSSAFE | EPYETAAKML | VKRRTYCLEM | NSF | 395 | SEQ-ID-NO-1277 |

| SEQ-ID-NO-1427 | -GG|FVKVSM|DGAPYLRKID|LRVYGGYSEL|LKALETMFK-|LT|GEYSERE| | 138 |
|---|---|---|---|---|---|---|---|
| SEQ-ID-NO-1430 | -GG|FVKVSM|DGAPYLRKID|LRVYGGYSEL|LKALETMFK-|LT|GEYSERE| | 138 |
| SEQ-ID-NO-1419 | QGF|LYVKVSM|DGAPYLRKID|LKT|YKNYKDL|STALE|KMFSG|FIST|GKDGLSE| | 185 |
| SEQ-ID-NO-1422 | QGF|LYVKVSM|DGAPYLRKID|LKT|YKNYKDL|STALE|KMFSG|FIST|GKDGSXE| | 187 |
| SEQ-ID-NO-1347 | RSSMYVKV|KM|DGVA|ARKVD|KLFNSYES|L|TNSL|TMFT-|----|EY|EDC| | 200 |
| SEQ-ID-NO-1431 | SKPLYVKVNM|EGVGMGRQIN|LRLYNSYQTL|KDSL|SMFV-|----|KC|QNF| | 166 |
| SEQ-ID-NO-1429 | SNSMY|KVKM|EGVGI ARKID|VS|VYRC|PTL|KHTL|DMFG-|----|CQ--| | 191 |

| SEQ-ID-NO-1427 | GYK|GSEYAPT|YEDKDCGDWML|VGDVPWDMFV|TSCKRLRI MK|GTEAKGLGCG | 188 |
|---|---|---|---|---|---|---|
| SEQ-ID-NO-1430 | GYK|GSEYAPT|YEDKDGGDWML|VGDVPWD--V|TSCKRLRI MK|GTEAKGLGCG | 186 |
| SEQ-ID-NO-1419 | YRKDGEYVLT|YEDKDGDWML|VGDVPWEMFA|DSCRRLRI MK|GSDA|GLAPR | 235 |
| SEQ-ID-NO-1422 | YRKDGEYVLT|YEDKDGDWML|VGDVPWEMFA|GSCRRLRI MK|GSDA|GLAPR | 237 |
| SEQ-ID-NO-1347 | DRED|TNY|FT|FQ|KEGDWLL|RGDVT|WKI FA|ESVHRI|S|IR|DRPCAYTRCL | 250 |
| SEQ-ID-NO-1431 | EETGANY|LT|FQNK|QGEWK|TSH|TWQ|SF|GT|VRRLA|LR|NGE|CETI-- | 213 |
| SEQ-ID-NO-1429 | -ENS|SNY|RLT|YQDREGDWLL|AE|DVPWRNFL|GS|VQRL KLMR|S|SN------ | 233 |

| SEQ-ID-NO-1427 | V-------- | 189 |
|---|---|---|
| SEQ-ID-NO-1430 | V-------- | 187 |
| SEQ-ID-NO-1419 | AADKSKNRN | 244 |
| SEQ-ID-NO-1422 | AADKSKNRN | 246 |
| SEQ-ID-NO-1347 | F-------- | 251 |
| SEQ-ID-NO-1431 | --------- | 213 |
| SEQ-ID-NO-1429 | --------- | 233 |

| SEQ-ID-NO | | | | | | |
|---|---|---|---|---|---|---|
| SEQ-ID-NO-1480 | VAVRGS--VYS | PGQSVTSPSQ | HTYPGAV--TN | WPLSRSASFI | ASPRWPGHSS | 227 |
| SEQ-ID-NO-1475 | VAVRGS--VYS | PGQSATSPGH | HAYQGAV--TS | WPLSRSASFI | ASPRWPGHSS | 225 |
| SEQ-ID-NO-1477 | VAVRGS--GYS | PGQSATSPGQ | HAYQGAV--TS | WPLSRSTSFI | ASPRWPGHSN | 232 |
| SEQ-ID-NO-1471 | ASSRGSPLYP | PVHNSGSTGP | HSYTGTM--AS | WTYPR--GSFI | PSPRWQSPSN | 244 |
| SEQ-ID-NO-1457 | VP-------- | ---------- | QSYPL------ | WS----R-ASFI | ASPRWQDPSS | 192 |
| SEQ-ID-NO-1467 | VP-------- | ---------- | QSYPL------ | WS----R-ASFI | ASPRWQDPSS | 192 |
| SEQ-ID-NO-1460 | VSLRGSPIYQ | TVPSPATPGQ | QSHPGGI--TN | WS----R-ASFI | PSPRWQGPSS | 224 |
| SEQ-ID-NO-1462 | VPLRGSPIYP | TVSSPTTPGQ | QSYPGGLAIT | WS----R-ASFI | TSPRWQAPSS | 223 |
| SEQ-ID-NO-1480 | YAQVIVPPGL | VQVPGWNPYA | AQIGSISSSDD | QQ-RTACGAQ | YYTGSRHSET | 276 |
| SEQ-ID-NO-1475 | YAQVIVPPGL | VQVPGWSPYA | AQIGSISSSDD | QQ-RTPGAAQ | YYTGSRQSCT | 274 |
| SEQ-ID-NO-1477 | YAQVLVPPGL | VQVPGWNPYT | AQIGSISSSED | QQ-QTPGAAQ | YYTGSRQSGT | 281 |
| SEQ-ID-NO-1471 | YTPMIVPQGL | VQVPNWNSYP | CQMVPVSSPE | SRLQSPGAQQ | YYGTSROGEA | 294 |
| SEQ-ID-NO-1457 | YASLIMPRGV | VPVQGWNPYS | CQLGSVSPSG | -------TGNDQ | NYRNLQQNET | 237 |
| SEQ-ID-NO-1467 | YASLIMPQGV | VPVQCWNPYS | CQLGSVSPSG | -------TGNDQ | NYRNLQQNET | 237 |
| SEQ-ID-NO-1460 | YASLILPQGM | VSVPGWNAYS | CQLASVSSSE | NLQQTNVNHQ | IHGTSRQNES | 274 |
| SEQ-ID-NO-1462 | YTPLILPQGV | VSVPGWNAYS | CQLGSVSSPE | SQ-QQTGNSQ | IYGTSRHSES | 272 |
| SEQ-ID-NO-1480 | -DQGM | FSSYQAG--SV | PL--GLYTVQR | ESIFPERPDQ | PECQFYMKTG | 322 |
| SEQ-ID-NO-1475 | -DRCM | FSSYQAG--SV | PV--GLYAVQT | ENVFPERPDQ | PECQFYMKTG | 320 |
| SEQ-ID-NO-1477 | -DQGM | FSSYQAG--SV | PV--GLYAVQR | ENVFPERPDQ | PECQFYMKTG | 327 |
| SEQ-ID-NO-1471 | -NQGM | QSPYRSS--SF | PA-PQYALQR | ENVFPERPDQ | PECIYYIKTG | 339 |
| SEQ-ID-NO-1457 | ESGSQSQGS | FSGYNPGSSV | PLGGYYALPR | ENVFPERPGQ | PECQFYMKTG | 287 |
| SEQ-ID-NO-1467 | ESGSQSQGS | FSGYNPGCSV | PLGGYYALPR | ENVFPERPGE | PECQFYMKTG | 287 |
| SEQ-ID-NO-1460 | ATAG--SQAS | FSELRSG--SV | PV--GVYALQR | ENVFPERPCE | PECQFYMKTG | 320 |
| SEQ-ID-NO-1462 | VNAG--SQGT | FSPYRSG--SA | PL--GFYALQR | ESVFPERPGQ | PECQFYMKTG | 318 |
| SEQ-ID-NO-1480 | DCKFGAVCKF | HHPKERIIPT | PNCALSSLGL | PLRPGEPICT | FYSRYGICKF | 372 |
| SEQ-ID-NO-1475 | DCKFGSVCKF | HHPRERIIPT | PNCALSPLGL | PLRPGEPICS | FYNRYGMCKF | 370 |
| SEQ-ID-NO-1477 | DCKFGVMCKF | HHPRERIPA | PNCALSSLGL | PLRPGEPICS | FYSRYGMCKF | 377 |
| SEQ-ID-NO-1471 | DCKFGAVCKF | HHPRVRSQPP | PDCILSPMGL | PLRPGEELCK | FYTRYGICKF | 389 |
| SEQ-ID-NO-1457 | DCKFGTVCKF | HHPRDRQAPP | PDCLLSSIGL | SLRPGEPLCV | FYTRYGICKF | 337 |
| SEQ-ID-NO-1467 | DCKFGTVCKF | HHPRDRQAPP | PDCLLSSIGL | PLRPGEPLCI | FYSRYGICKF | 337 |
| SEQ-ID-NO-1460 | DCKFGAVCKF | HHPRERVLPA | PDCVLSPIGL | PLRPGEPLCI | FYSRYGICKF | 370 |
| SEQ-ID-NO-1462 | DCKFGAVCRF | HHPRERLIPA | PDCVLSPIGL | PLRPGEPLCI | FYSRYGICKF | 368 |

Figure 17 (continued)

| | | | | | |
|---|---|---|---|---|---|
| SEQ·ID·NO·1480 | GPNCKFDH------ | --PMGTVMYG | LATSPTGDVS | ARRM------ | -APVPAHSEV | 412 |
| SEQ·ID·NO·1475 | GPNCKFHH------ | --PMGNPMYG | HASSPTSEAQ | TSRRM------ | LAHVPSHPEV | 411 |
| SEQ·ID·NO·1477 | GPNCKFDH------ | --PIGTVMYG | HVSSPTSEVP | TSRRM------ | LAYVPSHPEV | 418 |
| SEQ·ID·NO·1471 | GVNCKFDHPM | AAPMGVYAYG | YSASASPNAP | M--------- | ---------- | 420 |
| SEQ·ID·NO·1457 | GPSCKFDH------ | --PMRVFTYD | NTASETDEV- | ---------- | ---------- | 362 |
| SEQ·ID·NO·1467 | GPSCKFNH------ | --PMRVFTYD | NTASETDEV- | ---------- | ---------- | 362 |
| SEQ·ID·NO·1460 | GPSCKFDH------ | --PMGIFTYS | YSPSSPSDAP | VHCFLGSSSG | TAGLNLSSEG | 416 |
| SEQ·ID·NO·1462 | GPSCKFDH------ | --PMGVFTYN | LTASSADAP | VRRLLGSSSG | SPGLTLSSEG | 414 |

| | | | | | |
|---|---|---|---|---|---|
| SEQ·ID·NO·1480 | SPDNVSGRSR | RITHSDSQQI | PSGERGTERE | AS-------- | 444 |
| SEQ·ID·NO·1475 | SPDSGSGRSR | RIVHSDSQQI | PSVERITERE | AS-------- | 443 |
| SEQ·ID·NO·1477 | LPDNGSGRSR | RITHSDSQQI | PSGERSTERE | AS-------- | 450 |
| SEQ·ID·NO·1471 | -------GR | RLLESPSGSA | YAS------- | ---------- | 435 |
| SEQ·ID·NO·1457 | -VETSTGKSR | RLSVSETRQA | ATTSSGKDTT | IDNTQQ | 397 |
| SEQ·ID·NO·1467 | -VETSTGKSR | RLSVSETRQA | ATTSSGKDTT | IDNTQQ | 397 |
| SEQ·ID·NO·1460 | LVEAVPTKPR | RLSLSENRQL | SPSDD-IDAE | G--------- | 446 |
| SEQ·ID·NO·1462 | LVEAGPTKPR | RLSLSEPRQM | PPGDDNIDTG | G--------- | 445 |

Figure 18

| SEQ-ID-NO | | | | | | |
|---|---|---|---|---|---|---|
| SEQ-ID-NO:1512 | MSVSSSMGG | GGGDAGGRT | VWFRRDLRV | EDNPALAAAA | RAGGEVVPAY | 50 |
| SEQ-ID-NO:1499 | ---MSG | ------ | VWFRRDLRV | EDNPALAACV | RA-GAVAVF | 36 |
| SEQ-ID-NO:1506 | ---MSNCSC | G------ | VWFRRDLRV | EDNPALAAAV | RA-GPVIAVF | 41 |
| SEQ-ID-NO:1497 | MSGSVSGCGS | GGCS | VWFRRDLRV | EDNPALAAAV | RA-GPVIALF | 43 |
| SEQ-ID-NO:1502 | MSGSVSGCGS | GGCS | VWFRRDLRV | EDNPALAAAV | RA-GPVNALF | 43 |

| SEQ-ID-NO:1512 | VWAPEEDGPY | YPGRVSRWWL | SQSLKHLDAS | LRRGACKLV | TRRSADAVVA | 100 |
|---|---|---|---|---|---|---|
| SEQ-ID-NO:1499 | VWAPEEEGHY | YPGRVSRWWL | KQSLAHLDSS | LRSLCTS--LV | TKRSTDSVST | 85 |
| SEQ-ID-NO:1506 | VWAPEEEGHY | QPGRVSRWWL | KNSLAQLDSS | LRSLGTC--LI | TKRSTDSVAS | 90 |
| SEQ-ID-NO:1497 | VWAPEEEGHY | HPGRVSRWWL | KNSLAQLDSS | LRSLGTC--LI | TKRSTDSVAS | 92 |
| SEQ-ID-NO:1502 | VWAPEEEGHY | HPGRVSRWWL | KNSLAQLDSS | LRSLGTC--LI | TKRSTDSVAS | 92 |

| SEQ-ID-NO:1512 | LLQLVRDTGA | TRLFFNHLYD | PISLVRDHRL | KEMMAEGIL | VQSFNADLLY | 150 |
|---|---|---|---|---|---|---|
| SEQ-ID-NO:1499 | LLEVIKSTGA | TQLFFNHLYD | PLSLVRDHRA | KEVLTAQGIA | VRSFNADLLY | 135 |
| SEQ-ID-NO:1506 | LEVVKSTGA | SQIFFNHLYD | PLSLVRDHRA | KDALTAEGIA | VKSFNADLLY | 140 |
| SEQ-ID-NO:1497 | LDVVKSTGA | SQIFFNHLYD | PLSLVRDHRA | KDVLTAQGIA | VRSFNADLLY | 142 |
| SEQ-ID-NO:1502 | LDVVKSTGA | SQIFFNHLYD | PLSLVRDHRA | KDVLTAQGIA | VRSFNADLLY | 142 |

| SEQ-ID-NO:1512 | EPWEVVDDEG | QSFTMFAPFW | NRCLSMPYDP | AAPLLPPKR | NSGDLSMCPS | 200 |
|---|---|---|---|---|---|---|
| SEQ-ID-NO:1499 | EPWDVNDAQG | RPFTTFATFW | DRCLSMPFDP | EAPLLPPKKI | SGDASRCPS | 185 |
| SEQ-ID-NO:1506 | EPWEVTDELG | RPFSMFAAFW | ERCLSMPYDP | ESPLLPPKKI | SGDVSKCVA | 190 |
| SEQ-ID-NO:1497 | EPWEVTDELG | RPFSMFAAFW | ERCLSMPYDP | ESPLLPPKKI | SGDVSKCVA | 192 |
| SEQ-ID-NO:1502 | EPWEVTDELG | RPFSMFAAFW | ERCLSMPYDP | ESPLLPPKKI | SGDVSKCVA | 192 |

| SEQ-ID-NO:1512 | DDLIFEDDSE | RGSNALLARA | WSPGWQNADK | ALTAFLNGPL | HYSMNRKKA | 250 |
|---|---|---|---|---|---|---|
| SEQ-ID-NO:1499 | EMLVFEDELE | KGSNALLARA | WSPGWSNADR | ALTFINGPL | EYSKNRRKA | 235 |
| SEQ-ID-NO:1506 | DTLIFEDESE | KGSNALLARA | WSPGWSNADK | ALTFINGPL | EYSKNRRKA | 240 |
| SEQ-ID-NO:1497 | DPLVFEDDSE | KGSNALLARA | WSPGWSNGDK | ALTFINGPL | EYSKNRRKA | 242 |
| SEQ-ID-NO:1502 | DPLVFEDDSE | KGSNALLARA | WSPGWSNGDK | ALTTFINGPL | EYSKNRRKA | 242 |

| SEQ-ID-NO:1512 | DSASTSLLSP | YLHFGELSVR | KVFHLVRMKQ | LVWSNEGNRA | AEESCTLFLR | 300 |
|---|---|---|---|---|---|---|
| SEQ-ID-NO:1499 | DSATTSFLSP | HLHFGEVSVR | KVFHLVRIKQ | VLWANEGNKA | GEESVNLFLK | 285 |
| SEQ-ID-NO:1506 | DSATTSFLSP | HLHFGEVSVR | KVFHLLRIKQ | VAWANEGNQA | GEESVNLFLK | 290 |
| SEQ-ID-NO:1497 | DSATTSFLSP | HLHFGEVSVR | KVFHLVRIKQ | VAWANEGNEA | GEESVNLFLK | 292 |
| SEQ-ID-NO:1502 | DSATTSFLSP | HLHFGEVSVR | KVFHLVRIKQ | VAWANEGNEA | GEESVNLFLK | 292 |

Figure 18 (continued)

| SEQ ID NO | Sequence | Position |
|---|---|---|
| SEQ-ID-NO-1512 | SIGLREYSRY LSFNHPCSHE KPLLAHLRFF PWMNECYFK IWRQGRTGYP | 350 |
| SEQ-ID-NO-1499 | SIGLREYSRY LSFNHPYSHE RPLLGHLKFF PWMVDGGYFK AWRQGRTGYP | 335 |
| SEQ-ID-NO-1506 | SIGLREYSRY ISFNHPYSHE RPLLGHLKFF PWAVDENYFK AWRQGRTGYP | 340 |
| SEQ-ID-NO-1497 | SIGLREYSRY ISFNHPYSHE RPLLGHLKFF PWAVDENYFK AWRQGRTGYP | 342 |
| SEQ-ID-NO-1502 | SIGLREYSRY SFNHPYSHE RPLLGHLKFF PWAVDENYFK AWRQGRTGYP | 342 |
| | | |
| SEQ-ID-NO-1512 | LVDAGMRELW ATGWLHDRIR VVVSSFFVKV LQLPWRWGMK YFWDTLLDAD | 400 |
| SEQ-ID-NO-1499 | LVDAGMRELW ATGWLHDRIR VVVASFFVKV LQLPWRWGMK YFWDTLLDAD | 385 |
| SEQ-ID-NO-1506 | LVDAGMRELW ATGWLHDRIR VVVSSFFVKV LQLPWRWGMK YFWDTLLDAD | 390 |
| SEQ-ID-NO-1497 | LVDAGMRELW ATGWLHDRIR VVVSSFFVKV LQLPWRWGMK YFWDTLLDAD | 392 |
| SEQ-ID-NO-1502 | LVDAGMRELW ATGWLHDRIR VVVSSFFVKV LQLPWRWGMK YFWDTLLDAD | 392 |
| | | |
| SEQ-ID-NO-1512 | LESDALGWQY SGSLPDGRE LDRIDNPQLE GYKFDPHGEY VRRWLPELAR | 450 |
| SEQ-ID-NO-1499 | LESDALGWQY ITGTLPDGRE FDRIDNPQFE GYKFDPNGEY VRRWLPELAR | 435 |
| SEQ-ID-NO-1506 | LESDALGWQY ITGTLPDSRE FDRIDNPQFE GYKFDPNGEY VRRWLPELSR | 440 |
| SEQ-ID-NO-1497 | LESDALGWQY ITGTLPDSRE FDRIDNPQFE GYKFDPNGEY VRRWLPELSR | 442 |
| SEQ-ID-NO-1502 | LESDALGWQY ITGTLPDSRE FDRIDNPQFE GYKFDPNGEY VRRWLPELSR | 442 |
| | | |
| SEQ-ID-NO-1512 | LPTEWIHHPW DAPASVLQAA GVELGSNYPL PIVGLDAANA RLQEALSEMW | 500 |
| SEQ-ID-NO-1499 | LPTEWIHHPW NAPESVLQAA GIELGSNYPL PIVGIDAAKV RLEEALSEMW | 485 |
| SEQ-ID-NO-1506 | LPTEWIHHPW NAPESVLQAA GIELGSNYPL PIVGLDEAKA RLHEALSQMW | 490 |
| SEQ-ID-NO-1497 | LPTDWIHHPW NAPESVLQAA GIELGSNYPL PIVGLDEAKA RLHEALSQMW | 492 |
| SEQ-ID-NO-1502 | LPTDWIHHPW NAPESVLQAA GIELGSNYPL PIVGLDEAKA RLHEALSQMW | 492 |
| | | |
| SEQ-ID-NO-1512 | QLEAASRAAM DNGMEEGLGD SSE--VPPIE FPRELQMEVD REPARVTANV | 548 |
| SEQ-ID-NO-1499 | QQEAASRAAI ENGTEEGLGD SSE--SAPIA FPQDINMEEN HEPVRN---NP | 531 |
| SEQ-ID-NO-1506 | QLEAASRAAI ENGSEEGLGD STEFVEAPIE FPRDITMEET -EPTRL---NP | 537 |
| SEQ-ID-NO-1497 | QLEAASRAAI ENGSEEGLGD SAEVEAPIE FPRDITMEET -EPTRL---NP | 539 |
| SEQ-ID-NO-1502 | QLEAASRAAI ENGSEEGLGD SAEVEAPIE FPRDITMEET -EPTRL---NP | 539 |
| | | |
| SEQ-ID-NO-1512 | LTTARRREDQ MVPTMTSSLN RA--ETELSA DFMNSVLDSR AEVPITR-VNF | 594 |
| SEQ-ID-NO-1499 | PATNRRYEDQ MVPSMTSSFL RI--EDEETSS DVRNSTGDGR AEVPRDL-VNV | 579 |
| SEQ-ID-NO-1506 | ---VRRYEDQ MVPSITTSSLI RPEEDQESSL SLRNSCGDSR AEVPRNMVNT | 584 |
| SEQ-ID-NO-1497 | ---NRRYEDQ MVPSITSSLI RPEEDEESSL NLRNSVGDSR AEVPRNMVNT | 586 |
| SEQ-ID-NO-1502 | ---NRRYEDQ MVPSITSSLI RPEEDEESSL NLRNSVGDSR AEVPRNMVNT | 586 |

Figure 18 (continued)

| | | | | | | | | |
|---|---|---|---|---|---|---|---|---|
| SEQ-ID-NO-1512 | EPA | EREE | NF | RTT | AGN | ART | NG | HEH | NNFQ | QPQ | HRMRN | VL | APS | VSE | ASSG | 644 |
| SEQ-ID-NO-1499 | NQQPRRDT | LN | QGF | VQS | HND | NSL | PPFN | --- | V | RGLAN | VE | DSTAESSSSG | 625 |
| SEQ-ID-NO-1506 | NQARQQE | ARA | DPV | SNQV | --- | T | AMI | PEFN | --- | RI | VAENTE | ESTAESSSSG | 628 |
| SEQ-ID-NO-1497 | NQAQQR | --- | RA | EPA | SNQV | --- | T | AMI | PEFN | --- | RI | VAESTE | DSTAESSSSG | 628 |
| SEQ-ID-NO-1502 | NQAQQR | --- | RA | EPA | SNQV | --- | T | AMI | PEFN | --- | RI | VAESTE | DSTAESSSSG | 628 |

| | | | | | | |
|---|---|---|---|---|---|---|
| SEQ-ID-NO-1512 | WTG | REGGVVP | VWSPPAASDH | SE | LFA | SDEAD | --- | SSRSY | LDR | HPQS | HRL | 690 |
| SEQ-ID-NO-1499 | RRERDGGI | VP | VWSPPASS | --- | Y | SEQFV | GDENG | G | --- | A | SSY | LPR | HPQS | HQI | 671 |
| SEQ-ID-NO-1506 | RRERDGGI | VP | EWSG | --- | --- | SEQFA | SEENG | GGGSTTSSY | --- | LQNH | --- | HEI | 670 |
| SEQ-ID-NO-1497 | RRERSGGI | VP | EWSPG | --- | Y | SEQFP | SEENG | GGGSTTSSY | --- | LQNH | --- | HEI | 671 |
| SEQ-ID-NO-1502 | RRERSGGI | VP | EWSPG | --- | Y | SEQFP | SEENG | GGGSTTSSY | --- | LQNH | --- | HEI | 671 |

| | | |
|---|---|---|
| SEQ-ID-NO-1512 | MNWS | QL | SQSL | 700 |
| SEQ-ID-NO-1499 | LNWRRL | P | QTG | 681 |
| SEQ-ID-NO-1506 | VNWRRLSQTG | 680 |
| SEQ-ID-NO-1497 | LNWRRLSQTG | 681 |
| SEQ-ID-NO-1502 | LNWRRLSQTG | 681 |

Figure 19

| SEQ ID | Seq | # |
|---|---|---|
| SEQ-ID-NO-1612 | MDEAL--------------------- | 5 |
| SEQ-ID-NO-1597 | MDGASGGSGG-----GEGST------ | 19 |
| SEQ-ID-NO-1609 | MAAEHATAAV-----GEPPP------ | 23 |
| SEQ-ID-NO-1614 | MGEPSPPPPA----------ATSQPAEG | 17 |
| SEQ-ID-NO-1589 | -MAPPPVEQN-----PAAEA---AG | 14 |
| SEQ-ID-NO-1587 | ------MPGEQT---GDATT------ | 46 |
| SEQ-ID-NO-1596 | -MAPLPAEQT----GET-PTVAGVG | 14 |
| SEQ-ID-NO-1591 | -MPPLPVEQT-----GESAP------ | 26 |
| SEQ-ID-NO-1603 | ---------------GE-SPA------ | 1 |
| SEQ-ID-NO-1605 | --------------------------- | 0 |
| SEQ-ID-NO-1606 | --------------------------- | 0 |

| SEQ ID | Seq | # |
|---|---|---|
| SEQ-ID-NO-1612 | ----GSSCSL P-PFLAKTYE MVDDLSTNSI VSWSVSSKSF VWNPPEFAR | 50 |
| SEQ-ID-NO-1597 | APTPMLNANA PPPFLSKTYD MVDDPSTDAI VSWSATNNSF VVWDPPEFAR | 69 |
| SEQ-ID-NO-1609 | VTAAAGQRSV PTPFLSKTYQ LVDDPAVDDI SWNDDGSAF VVWRPAEFAR | 73 |
| SEQ-ID-NO-1614 | VGVGQQQRTV PTPFLTKTYQ LVDDPAVDDV SWNDDGSTFF VVWRPAEFAR | 67 |
| SEQ-ID-NO-1589 | -GTAESQRSI PTPFLTKTYQ LVDDHTI DDV VWNPTVFAR VWRPAEFAR | 63 |
| SEQ-ID-NO-1587 | GGGGDSQRSI PTPFLTKTYQ LVEDPVYDEL SWNEDGTFF VWRPAEFAR | 96 |
| SEQ-ID-NO-1596 | ---TELQRSI PTPFLTKTYQ LVDDPSADDL SWNEDGTSF VWRPAEFAR | 61 |
| SEQ-ID-NO-1591 | SGSGDSQRSL PTPFLTKTYQ LVDDPSVDDL SWNDDGSTFF VWRPAEFAR | 76 |
| SEQ-ID-NO-1603 | VFTMESQKSV PAPFLTKTYQ LVDDPLTDH VSWSDDETTF VVWRPPEFAR | 51 |
| SEQ-ID-NO-1605 | ------MSQRTA PAPFLLKTYQ LVDDAATDDV I SWNEL GTIF VVWKTAEFAK | 46 |
| SEQ-ID-NO-1606 | ------MSQRTV PAPFLTKTYQ LVDDATTDDV VSWNESGTTF VVWKTAEFAK | 46 |

| SEQ ID | Seq | # |
|---|---|---|
| SEQ-ID-NO-1612 | DLLPRFFKHN NFSSFIRQLN TYGFKKIDPE QWEFANDDFV RGQPHLMKNI | 100 |
| SEQ-ID-NO-1597 | DLLPKFFKHN NFSSFVRQLN TYGFRKVDPD RWEFANEGFL RGQKQLLKS | 119 |
| SEQ-ID-NO-1609 | DLLPKYFKHN NFSSFVRQLN TYGFRKIVPD RWEFANDCFR RGEKRLLCDI | 123 |
| SEQ-ID-NO-1614 | DLLPKYFKHN NFSSFVRQLN TYGFRKIVPD RWEFANDCFR RGERRLLCEI | 117 |
| SEQ-ID-NO-1589 | DLLPKYFKHN NFSSFVRQLN TYGFRKVVPD RWEFSNDYFR RGEKRLLCEI | 113 |
| SEQ-ID-NO-1587 | DLLPKYFKHN NFSSFVRQLN TYGFRKVVPD RWEFSNDCFR RGEALLRDI | 146 |
| SEQ-ID-NO-1596 | DLLPKYFKHN NFSSFVRQLN TYGFRKVVPD RWEFANDCFR RGEKALLRDI | 111 |
| SEQ-ID-NO-1591 | DLLPKYFKHN NFSSFVRQLN TYGFRKVVPD RWEFANDYFK RGERALLRDI | 126 |
| SEQ-ID-NO-1603 | DLLPNFFKHN NFSSFVRQLN TYGFKKVVVA RWEFANENFK KGAKHLLCEI | 101 |
| SEQ-ID-NO-1605 | DLLPKYFKHN NFSSFVRQLN TYGFRKIVPD KWEFANENFK RCQKELLTAI | 96 |
| SEQ-ID-NO-1606 | DLVPTYFKHN NFSSFVRQLN TYGFRKIVPD KWEFANENFK RGQKELLTAL | 96 |

Figure 19 (continued)

```
SEQ-ID-NO-1612  HRRKPVHSHS  LQNLQAQGPL  GDSERQGFTD  GIEKLKRDKE  RLLVELQ-KF  149
SEQ-ID-NO-1597  SRRKPAHGHT  QQQAQQPHGQ  SSSVGACVEV  GKFGLEEEVE  RLKRDKNVLM  169
SEQ-ID-NO-1609  HRRKV-----  -------SPATGA  VTTAAAVA-AA  ----LP----  ------MA    148
SEQ-ID-NO-1614  HRRKV-----  -------TPPAPA  ATTAAVA-AA  ----LP----  ------MA    141
SEQ-ID-NO-1589  QRRKL-----  ---SSPTAAA   VTVAPVTVAA  ----LP----  ------MA    139
SEQ-ID-NO-1587  QRRKISQPAM  AAAAAAAAA    VAASAVTVAA  ----VP----  ------VV    180
SEQ-ID-NO-1596  QRRKL-----  --LPVPPAAAA  PAAVTANTVT  ----VA----  ------VA    139
SEQ-ID-NO-1591  QRRKI-----  ---STMAASA   VTSASVTVAA  ----LP----  ------TV    152
SEQ-ID-NO-1603  HRRKT-----  ----------   SVAACAS--   ---------   -------PQ   108
SEQ-ID-NO-1605  RRRKT-----  -VTSTPAGGK   --------    ---------   ---------   117
SEQ-ID-NO-1606  RRRKT-----  -VTPTPAGGK   SVVPGTS--   ---------   ---------   117

SEQ-ID-NO-1612  QHEWQTYEIQ  IHCSNDRLEK  L-----EQK   QHKMVSSISH  VLQKPVLAVN  193
SEQ-ID-NO-1597  QELVRLRQQQ  QTTDGQLQTM  VQRLQGMEQR  QQQMMSFLAK  AVQSPGFFAQ  219
SEQ-ID-NO-1609  LPV-------  GSPVYSGEEQ  V-------   ----LSS    SSPEPPSLQQ  175
SEQ-ID-NO-1614  LPVTTTRDGS  PVLSGEEQ    V-------   ------S    SSSSPEPPLV  172
SEQ-ID-NO-1589  KPI-------  ISPSNSGDEQSP  V-------   ------S    SASSP-----  162
SEQ-ID-NO-1587  AHI-------  VSPSNSGEEQ  V-------   ------S    SNSSPAAAA-  206
SEQ-ID-NO-1596  APAVRT----  VSPTTSGDEQ  V-------   ------LS   SNSSP-----  163
SEQ-ID-NO-1591  ARA-------  VSPANSGDDQ  G-------   ------S    STSSP-----  173
SEQ-ID-NO-1603  HYQQQYYEQS  PQIFQPDE    S-------   ------LC   WIDSP-----  134
SEQ-ID-NO-1605  AS--------  PDNSGDD     G-------   ------SS   STSSP-----  135
SEQ-ID-NO-1606  AS--------  PDNSGEDL    G-------   ------SS   STSSP-----  135

SEQ-ID-NO-1612  ILPLTETMDR  KRRLPRSGHY  YDESSIEDAI  ETSQMLPREN  AENTTVLTLN   243
SEQ-ID-NO-1597  FVQQONDSNR  RITEVNKKRR  ---LKQDGTA  ETIEQATPPD  GQIVKYQPMM   266
SEQ-ID-NO-1609  HPPAPSGSG-  ---SGG      VVSGDVG     EENERLRREN  ARLARELCQM   214
SEQ-ID-NO-1614  LPQAPSGSG-  ---SGG      VASGDVG     DENERLRREN  AQLARELSQM   211
SEQ-ID-NO-1589  --SRLNQAG-  ---------   TVMAELM     KENEKLRKEN  VQLNKQLSEM   196
SEQ-ID-NO-1587  AIGGVVGGG-  ---------   TTAPELV     ERLRKEMTKL  ERLRKEMTKL   250
SEQ-ID-NO-1596  --GGAGTAGG  ---------   TTAPELL     EENERLRKEN  IQLSNELSQL   206
SEQ-ID-NO-1591  --GGAGTAGG  ---------   TTPEIL      EENERLRKEN  SALSHELTQL   218
SEQ-ID-NO-1603  -LPSPKSNT-  ---------   DILTALS     EDNQRLRRKN  FMLLSELSHM   169
SEQ-ID-NO-1605  ---DSKNPG-  --SVDTPGKL  SQFTDLS     DENEKLKKDN  QMLSSELVQA   176
SEQ-ID-NO-1606  ---DSKNPG-  --SVDTPGK-  SQFADLS     DENEKLKKDN  QMLSSELAQA   175
```

| SEQ ID | Sequence | # |
|---|---|---|
| SEQ-ID-NO-1612 | --ASETQEVQ --- --- --- --KDCDGRKN EGKPNDHSKF WWNIRNANNL | 389 |
| SEQ-ID-NO-1597 | YMAPETDDGF MDPSSLGSLP IDLDCLSPGA DIDDLLSNSI WDDLLQTPIP | 455 |
| SEQ-ID-NO-1609 | --GVCAAEVK AEP------- VDARPDQQ RQRNATEPQS WPIYRPRPVY | 348 |
| SEQ-ID-NO-1614 | --DDHAATVK AEP------- MDGRPHGK DEQSA-ETQA WPIYRPRPVY | 349 |
| SEQ-ID-NO-1589 | --PGGSEIK LEP------- LDCQNRGR DDDRGIQDAP WLRQFHRANQ | 322 |
| SEQ-ID-NO-1587 | --GEQSSDVK AEP------- ME------ ENNSGNHNGS WLELGK---- | 377 |
| SEQ-ID-NO-1596 | --PDHGSDVK SEP------- LD-----GD DSDYQDHDPH WLEL------ | 355 |
| SEQ-ID-NO-1591 | --KEHESDVK AEP------- LD-----GS SGNSDHQDQR ---------- | 337 |
| SEQ-ID-NO-1603 | --PSN----- --------- --------- ---------- ---------- | 243 |
| SEQ-ID-NO-1605 | --PDENLETC GGR------- LD-----GK MMKTVDYNGP WMKMSSPAGE | 295 |
| SEQ-ID-NO-1606 | --PDENADIS GSR------- -------GK MMKTMDYNLP WMKMSSAPGE | 285 |

| SEQ ID | Sequence | # |
|---|---|---|
| SEQ-ID-NO-1612 | SEPMGHVGQA EKT------- NGWDNNTQPL DQLTEQMGLL ---------- | 402 |
| SEQ-ID-NO-1597 | EDFEANIDEI SRGNEVQPTE DSR------- ---------- SSDAKRI--- | 502 |
| SEQ-ID-NO-1609 | HPLRACNGSG SAGSDHDGSN SNST------ ---------- ---------- | 371 |
| SEQ-ID-NO-1614 | QPIRACNGYE YDRAGSDQDG --------- ---------- ---------- | 373 |
| SEQ-ID-NO-1589 | RVCN------ ---------- --------- ---------- ---------- | 326 |
| SEQ-ID-NO-1587 | ---------- ---------- --------- ---------- ---------- | 377 |
| SEQ-ID-NO-1596 | ---------- ---------- --------- ---------- ---------- | 355 |
| SEQ-ID-NO-1591 | ---------- ---------- --------- ---------- ---------- | 337 |
| SEQ-ID-NO-1603 | ---------- ---------- --------- ---------- ---------- | 243 |
| SEQ-ID-NO-1605 | SSKVCN---- ---------- --------- ---------- ---------- | 301 |
| SEQ-ID-NO-1606 | SNKVCN---- ---------- --------- ---------- ---------- | 292 |

Figure 20

| SEQ ID | Sequence | # |
|---|---|---|
| SEQ-ID-NO-1646 | MPANPKLAAK | 15 |
| SEQ-ID-NO-1648 | MPANPKLAAK | 10 |
| SEQ-ID-NO-1650 | MSSKFN- | 12 |
| SEQ-ID-NO-1642 | | 15 |
| SEQ-ID-NO-1644 | | 28 |
| SEQ-ID-NO-1651 | PSPSPPTAAA --MSFPTAAS ----MVAA[A] AG[D]AET[D]LTL | 49 |
| SEQ-ID-NO-1653 | PSPSTAEPPP -AASRPKATA KPPLGAGYRD ----MA MAT VDC PLPS | 50 |
| SEQ-ID-NO-1637 | QTASRPKATA KPPLGAGYRD --MA TA[D]GD PPQF | 22 |
| SEQ-ID-NO-1635 | --SSQF[SS] -MDF[SD] EDDDENC[FGS] | 14 |
|  |  |  |
| SEQ-ID-NO-1646 | | 16 |
| SEQ-ID-NO-1648 | | 11 |
| SEQ-ID-NO-1650 | | 13 |
| SEQ-ID-NO-1642 | | 16 |
| SEQ-ID-NO-1644 | | 29 |
| SEQ-ID-NO-1651 | [P]---PRASS RAARALKPSG NGAASRRPSK RLKPSSSCCS GKENLPAAAG | 95 |
| SEQ-ID-NO-1653 | [P]---PRASS RAARALKPSG NGAASRRPSK RLKPSSSCCS GKENRPAAAG | 96 |
| SEQ-ID-NO-1637 | [P]LSQTPKQTL SIRN--KPAD --NPRRPS K-KPKKPPNP GKENI--- | 60 |
| SEQ-ID-NO-1635 | [P]---PSSQL SIRKPLHPTN ANNISHRPPN K-KPRLCRYP GKENV--- | 54 |
|  |  |  |
| SEQ-ID-NO-1646 | | 16 |
| SEQ-ID-NO-1648 | | 11 |
| SEQ-ID-NO-1650 | | 13 |
| SEQ-ID-NO-1642 | | 16 |
| SEQ-ID-NO-1644 | | 29 |
| SEQ-ID-NO-1651 | SKGAGVGETL GVVSRVSSGV PGGDKARGGG ICGLLRCGSD | 145 |
| SEQ-ID-NO-1653 | SKGAGVGETL GVVSRVSSGV PGGDKARGGG ICGLLRCGSD | 146 |
| SEQ-ID-NO-1637 | | 60 |
| SEQ-ID-NO-1635 | | 54 |
|  |  |  |
| SEQ-ID-NO-1646 | | 16 |
| SEQ-ID-NO-1648 | | 11 |
| SEQ-ID-NO-1650 | | 13 |
| SEQ-ID-NO-1642 | | 16 |
| SEQ-ID-NO-1644 | | 29 |
| SEQ-ID-NO-1651 | DFSSVSNGKK GLDRYWRRDG GLHSRPNPMD STVSMPDATC DLENGGSQVA | 195 |
| SEQ-ID-NO-1653 | DFSSVSNGKK GLDRYWRRDG GLHSRPNPMD STVSMPDATC DLENGGSQVA | 196 |
| SEQ-ID-NO-1637 | | 60 |
| SEQ-ID-NO-1635 | | 54 |

Figure 20 (continued)

```
SEQ-ID-NO-1646                                                                          16
SEQ-ID-NO-1648                                                                          11
SEQ-ID-NO-1650                                                                          13
SEQ-ID-NO-1642                                                                          16
SEQ-ID-NO-1644                                                                          29
SEQ-ID-NO-1651  QMLSSNDRIS         VQLEGNAKVE  LGKSESDPTT  MRKERNGSGA  CESDHPARLI      245
SEQ-ID-NO-1653  QMLSSNDRIS         VQLEGNAKVE  LGKSESDPTT  MRKERNGSGA  CESDHPARLI      246
SEQ-ID-NO-1637                                 ---DPNSLL   LYQKTESGAN  DFNLDE---       82
SEQ-ID-NO-1635                                 ----TPPP-   ---SPDPDLF  CSSSTP---       71

SEQ-ID-NO-1646                                                                          16
SEQ-ID-NO-1648                                                                          11
SEQ-ID-NO-1650                                                                          13
SEQ-ID-NO-1642                                                                          16
SEQ-ID-NO-1644                                                                          29
SEQ-ID-NO-1651  EPRLLTLVTN         CDFGGADSMD  SKELGSAI HP  SVSKDRNVEN  ESGGASVCTF     295
SEQ-ID-NO-1653  EPRLLTLVTN         CDFGGADSMD  SKELGSAI HP  SVSKDRNVEN  ESGGASVCTF     296
SEQ-ID-NO-1637                                                                          82
SEQ-ID-NO-1635                                                                          71

SEQ-ID-NO-1646                                                                          16
SEQ-ID-NO-1648                                                                          11
SEQ-ID-NO-1650                                                                          13
SEQ-ID-NO-1642                                                                          16
SEQ-ID-NO-1644                                                                          29
SEQ-ID-NO-1651  ALHNRNCHSS         CVESELELLN  AKYDLGPRDC  KESQEGPGLC  SLI SEERTVA     345
SEQ-ID-NO-1653  ALHNRNCHSS         CVESELEMLN  AKYDLGPRDC  KESQEGPGLC  SLI SEERTVA     346
SEQ-ID-NO-1637  ----NCSLD          FIESSID---                ---C     TVS----S        99
SEQ-ID-NO-1635  ----HCI LD         CI PSSVD---                ---C     SLGDFNGPI S    94

SEQ-ID-NO-1646                                                                          16
SEQ-ID-NO-1648                                                                          11
SEQ-ID-NO-1650                                                                          13
SEQ-ID-NO-1642              -F[N]   DGVNE---                           EE---           25
SEQ-ID-NO-1644                                                                          29
SEQ-ID-NO-1651  AEGDATFTFE         ERGNTSSGLE  ACKGSHCLDP  VEPKLMDSCA  TH----ALEG     391
SEQ-ID-NO-1653  AEGDATFTFE         ERGNTSSGLE  ACKGSHCLDP  VEPKLMDSCA  TH----ALEG     392
SEQ-ID-NO-1637  KVGNEKF---         SGSGKKEKLE  VS-GGYLCNS  I EARLMKSRV  DY--SGVNV     143
SEQ-ID-NO-1635  SLGEEDK---[E]     D---KDDCI K  VNREGYLCNS  MEARLLKSRI  CLGFDSGI HE    139
```

| | | | | | |
|---|---|---|---|---|---|
| SEQ-ID-NO-1646 | GIEKP---AS | GMTEKVC--- | -------GPPVQ | KNLFQAWGIQ | KPPREEAAQG | 123 |
| SEQ-ID-NO-1648 | GIEKPRR-DG | RGAGDSS--- | ---------LVQ | RSLFQAWGIE | RPQRE----- | 113 |
| SEQ-ID-NO-1650 | GIERPRREEG | AGAGDSS--- | ---------LVQ | RSLFQAWGIE | RPKRE----- | 121 |
| SEQ-ID-NO-1642 | CLQENSPDTT | KKKMK----- | ---------- | TDLFQSWGLQ | KP-------- | 110 |
| SEQ-ID-NO-1644 | GFKRNVEFES | PNQGGYCDVV | GEGSVSSEKK | SVKRGNWGSI | LRD------- | 145 |
| SEQ-ID-NO-1651 | NLENTKKAKI | PMNG------ | -------N | KLITEYFRCP | SSDQ------ | 594 |
| SEQ-ID-NO-1653 | NLENTKKAKI | PMNG------ | -------N | KLITEYFRCP | SSDQ------ | 595 |
| SEQ-ID-NO-1637 | EVGSRRSHGA | EMQVEASKII | GDDTSKPTAN | KLITDYFPGS | VPIK------ | 376 |
| SEQ-ID-NO-1635 | GHVTERQRDK | STTRKAS--- | --EPKKPTAN | KLITEFFPGQ | AT-------- | 354 |

| | | | | | |
|---|---|---|---|---|---|
| SEQ-ID-NO-1646 | VPVGAGASSS | SPSPSVAGS | --GRKRRWGGS | DEN--CASRK | PVACPFYKQI | 169 |
| SEQ-ID-NO-1648 | ---GLGAGDS | SPSSLSGSL | LARKRRRGST | EEERVAAK-K | PLACPFYKKI | 159 |
| SEQ-ID-NO-1650 | ---GGGAGDA | SPSPSRSGSW | SGRKRRRGGP | EEEVAAAAMN | PRTCPFYKKI | 168 |
| SEQ-ID-NO-1642 | ---SPFTSPA | SNSAKKTTSA | LGKRRRDSSF | SND------S | PRPCPFYKKL | 151 |
| SEQ-ID-NO-1644 | ---TGKVVEN | SKSTGKRKSF | HGEKRI---- | ------V | TRSCPFYKKM | 178 |
| SEQ-ID-NO-1651 | ---RQKKACK | VNTPSNLNSQ | KNSNAKATGG | RRTVKG---K | VKDTPIWCCI | 638 |
| SEQ-ID-NO-1653 | ---RQKKACK | VNTPSNLNSQ | KKSNAKATGG | RRTVKG---K | VKDTPIWCCI | 639 |
| SEQ-ID-NO-1637 | ---KKTSVIS | KEQRCAEKSQ | PGYVRKQGVK | NYTKKC---K | FKDIPLWCSI | 420 |
| SEQ-ID-NO-1635 | ---EGTKIRT | APKFVAEKSP | SDSSSRRAVR | RNGNG----K | SKVIPHWNCL | 398 |

| | | | | | |
|---|---|---|---|---|---|
| SEQ-ID-NO-1646 | PGTPFTVDAF | RYGAVEMCSA | YFLSHFHYDH | YGGLTKKWCH | GPIYCTALTA | 219 |
| SEQ-ID-NO-1648 | PGTPFTVDAF | RYGQVEGCSA | YFLSHFHHDH | YGGLTKKWCH | GPIYCSALTA | 209 |
| SEQ-ID-NO-1650 | PGTPFTVDAF | RYGEVEGCSA | YFLSHFHHDH | YGGLTKKWCH | GPIYCSALTA | 218 |
| SEQ-ID-NO-1642 | PGTPFTVDAF | RYGCVQGCSA | YFLTHFHADH | YIGLTKAWSH | GPIYCSSLTS | 201 |
| SEQ-ID-NO-1644 | PGTPFTVDAF | RYGCVEECSA | YFLSHFHADH | YGGLSKKMSH | GPIYCSPLTG | 228 |
| SEQ-ID-NO-1651 | PGTPFRVDAF | RY-LRGDCCH | WFLTHFHVDH | YQGLTKSFCH | GKIYCSSVTA | 687 |
| SEQ-ID-NO-1653 | PGTPFRVDAF | RY-LRGDCCH | WFLTHFHVDH | YQGLTKSFCH | GKIYCSSVTA | 688 |
| SEQ-ID-NO-1637 | PGTPFRVDAF | KY-LRGDCSH | WFLTHFHMQH | YQGLTRSFCH | GKIYCSLTA | 469 |
| SEQ-ID-NO-1635 | PGTPFRVDAF | KY-LTRDCCH | WFLTHFHLDH | YQGLTKSFSH | GKIYCSLVIA | 447 |

| | | | | | |
|---|---|---|---|---|---|
| SEQ-ID-NO-1646 | RLVKMLSTD | SAYVCPLELD | TEYVDGVKV | TFLEANHCPG | AALIHFRPSD | 269 |
| SEQ-ID-NO-1648 | RLVKMCLSVN | SEYICPLELD | TEYVEGVTV | TLLEANHCPG | AALIHFRLSD | 259 |
| SEQ-ID-NO-1650 | RLVKMCLSVN | SDYICPLELD | TEYVEGVTV | TLLEANHCPG | AALIHFRLSD | 268 |
| SEQ-ID-NO-1642 | RLLRLSLSVN | PSSIHPLELD | VEYTNGIKV | TLIEANHCPG | AALIHFRLLD | 251 |
| SEQ-ID-NO-1644 | RLVQMCLYVN | PSYICPLEFD | TEYVDGIKV | TLLDANHCPG | AALIHFELPN | 278 |
| SEQ-ID-NO-1651 | NLVHYKIGIP | WDRLHVLPLN | EKITAGVNL | TCFDANHCPG | AVIILFEPSN | 737 |
| SEQ-ID-NO-1653 | NLVHYKIGIP | WDRLHVLPLN | EKITAGVNL | TCFDANHCPG | AVIILFEPSN | 738 |
| SEQ-ID-NO-1637 | KLVNLKIGIP | WDSLHVLPLN | QKIVCIAGVDV | TCLDANHCPG | AVIILFEPPN | 519 |
| SEQ-ID-NO-1635 | KLVNMKIGIP | WERLQVLDLG | QKIVNSGIDV | TCFDANHCPG | SIMILFEPAN | 497 |

| SEQ-ID-NO | Sequence | Pos |
|---|---|---|
| SEQ-ID-NO-544 | MSNSCSGGGG CSIVWFRRDL RVEDNPALAA AVRAGPVIAV FVWAPEEEGH | 50 |
| SEQ-ID-NO-539 | ----------MAA CIIVWFRRDL RLEDNPALAA AARAGTVVPV FVWSPAEDGQ | 43 |
| SEQ-ID-NO-549 | -------MAGSE RTVVWFRRDL RIDDNPALAS AARDGAVLPV FIWCPADEGQ | 45 |
| SEQ-ID-NO-543 | -------MSTNK KTIVWFRRDL RIEDNPALAA AAHEGSVFPV FIWCPEEEGQ | 45 |
| SEQ-ID-NO-538 | -------MKMDK KTIVWFRRDL RIEDNPALAA AAHEGSVFPV FIWCPEEEGQ | 45 |
| SEQ-ID-NO-542 | -------MTTNK KTIVWFRRDL RIEDNPALAA AAHQGSVFPV FIWCPEEEGQ | 45 |
| SEQ-ID-NO-547 | -------MESNY KTIVWFRRDL RIEDNPALAA AARNGSVFPV FIWCPKEEGQ | 45 |
| SEQ-ID-NO-548 | -------MESNS KTIVWFRRDL RIEDNPALAA AARNGSVFPV FIWSPKEEGQ | 45 |
| SEQ-ID-NO-541 | -------MDRS- KTIVWFRRDL RIEDNPALAA AARDGCVFPV FI GA | 44 |
| SEQ-ID-NO-545 | ---------MN- RTIVWFRRDL RIEDNPALAA AARDGSVFPV FICPKEEGQ | 42 |
| SEQ-ID-NO-546 | -------MGSN- RTIVWFRRDL RIEDNPALAA AARDGSVFPV FIWCPKEEGQ | 44 |

| SEQ-ID-NO | Sequence | Pos |
|---|---|---|
| SEQ-ID-NO-544 | YQPGRVSRWW LKNSLAQLDS SLRSLGTCLI TKRSTDSVAS LLEVVKSTGA | 100 |
| SEQ-ID-NO-539 | FHPGRVSRWW LKQSLTHLEL SLKKLGSPLI LRKSPDTLSV LLEIAEALGA | 93 |
| SEQ-ID-NO-549 | FYPGRCSRWW LKQSLPHLSQ SLESLGCPLV LIRAESTLEA LDCVRATGA | 95 |
| SEQ-ID-NO-543 | FYPGRASRWW MKQSLAHLTQ SLKALGSEPT LIKTHNTVSA LDCIRVTGA | 95 |
| SEQ-ID-NO-538 | FYPGRASRWW MKQSLAHLSQ SLKALGSDLT LIKTHNTISA LDCIRVTGA | 95 |
| SEQ-ID-NO-542 | FYPGRASRWW MKQSLAHLSQ SLKSLGAELV LMKAQSTLSA LTECVDAVGA | 95 |
| SEQ-ID-NO-547 | FYPGRVSRWW LKQSLHLEQ SLKSLGAELV LIKAQSTLSA LDCIEAVGA | 95 |
| SEQ-ID-NO-548 | FYPGRVSRWW LKQSLAHLSQ SLKSLGAELV LIKTHSTVAA LDCIED GA | 94 |
| SEQ-ID-NO-541 | FYPGRVSRWW LKQSLYHLDQ SLKSLGAGLV LIKTDSTLKA LLECVNAVQA | 92 |
| SEQ-ID-NO-545 | FYPGRVSRWW LKQSLAHLDQ SLKSLGAKLV LIKTDSTLNA LLECVNAIQA | 94 |
| SEQ-ID-NO-546 | FYPGRVSRWW LKQSLAHLDQ SLKSLGAKLV LIKTDSTLNA LLECVNAIQA | 94 |

| SEQ-ID-NO | Sequence | Pos |
|---|---|---|
| SEQ-ID-NO-544 | SQIFNHLYD PLSLVRDHRA KDALTAEGI VKSFNADLLY EPWEVIDELG | 150 |
| SEQ-ID-NO-539 | TQVEYNHLYD PVSLVRDHRV KQGLSQRGI VHITFNGDLLY EPWEVYDEEG | 143 |
| SEQ-ID-NO-549 | TRLVYNHLYD PVSLVRDHDKI KKELSALGIS QSFNGDLLY EPWEIYDDSG | 145 |
| SEQ-ID-NO-543 | TKVVFNHLYD PVSLVRDHTV KEKLVERGIS VQSYNGDLLY EPWEIYCEKG | 145 |
| SEQ-ID-NO-538 | TKVVFNHLYD PVSLVRDHTV KEKLVERGIS VQSYNGDLLY EPWEIYCEKG | 145 |
| SEQ-ID-NO-542 | TKVVYNHLYD PVSLVRDHNI KQKLVELGIS VQSYNGDLLN EPWEVYDDDG | 145 |
| SEQ-ID-NO-547 | TKVVYNHLYD PVSLVRDHNI KQKLGELGIS VQSYNGDLLN EPWEVYDDDG | 145 |
| SEQ-ID-NO-548 | TKVVYNHLYD PVSLVRDHNI KEKLVELGIS VQSYNGDLLY EPWDIYDERG | 145 |
| SEQ-ID-NO-541 | TRVVFNHLYD PVSLVRDHNI KEKLVELGIS VQSYNGDLLY EPWDIYDESG | 144 |
| SEQ-ID-NO-545 | KKVVFNHLYD PVSLVRDHNI KEKLVELGIS VKSYNGDLLH EPWELYDEKG | 142 |
| SEQ-ID-NO-546 | TKVVFNHLYD PVSLVRDHNI KEKLVELGIS VKSYNGDLLY EPWELYDEKG | 144 |

| | | | | | | |
|---|---|---|---|---|---|---|
| SEQ-ID-NO-544 | MANEGNQAGE | ESVNLFLKSI | GLREYSRYIS | FNHPYSHERP | LLGHLKFFPW | 346 |
| SEQ-ID-NO-539 | WAREGNAGGE | ABVNMFLRAL | GFREYSRYLS | FHFPFTHERS | LLANLKSFPW | 320 |
| SEQ-ID-NO-549 | MENEGTSEAE | ESIHFFMRSI | GLREYSRYLS | FNFPFTHEKS | LLGNLKHYPW | 321 |
| SEQ-ID-NO-543 | WARDKNCOGV | ESAVFLRG | GLRDYSRYI C | FNFPFTHEQS | LLSHLRFFPW | 320 |
| SEQ-ID-NO-538 | WARDKNSEGE | ESADLFLRG | GLREYSRYI C | FNFPFTHEQS | LLSHLRFFPW | 321 |
| SEQ-ID-NO-542 | WARDKNSEGE | ESTDLFLKG | GLREYSRYI C | FNFPFTHEQS | LLNNLRFFPW | 321 |
| SEQ-ID-NO-547 | WTKEGNSVGK | DSAT I YLRAI | GLREYSRYI C | FNFPFTHERS | LLNNLKFFPW | 318 |
| SEQ-ID-NO-548 | WTKEGNSVGD | ESASLYLRAI | GLREYSRYLC | FNFPFTHERS | LLRNLKYFPW | 318 |
| SEQ-ID-NO-541 | WAKEENLMGK | ESVTLFLRSI | GLREYSRYLC | FNFPFTHERS | LLGNLKFFPW | 316 |
| SEQ-ID-NO-545 | WKNEGNLVGE | ESATFLRAI | GLREYSRYLC | FSFPFTVERP | LLGNLKFFPW | 315 |
| SEQ-ID-NO-546 | WGNEGNSVGK | ESVTLFLRAI | GLREYSRYLC | FNFPFTHERA | LLGHLSFFPW | 317 |

| | | | | | | |
|---|---|---|---|---|---|---|
| SEQ-ID-NO-544 | AVDENYFKAW | RQGRTGYPLV | DAGMRELWAT | GWLHDRI RVV | VSSFFVKVQ | 396 |
| SEQ-ID-NO-539 | RADEGYFKAW | RQGRTGYPLV | DAGMRELWAT | GWAHNRI RVV | VASFSVKFLQ | 370 |
| SEQ-ID-NO-549 | KVDEERFKSW | RQGMTGYPLV | DAGMRELWAT | GWTHNRI RVI | I SSFAVKFLL | 371 |
| SEQ-ID-NO-543 | DADVEKFKAW | RQGRTGYPLV | DAGMRELWAT | GWMHNRI RVI | VSSFAVKFLL | 370 |
| SEQ-ID-NO-538 | DADVDKFKAW | RQGRTGYPLV | DAGMRELWAT | GWMHNRI RVI | VSSFAVKFLL | 371 |
| SEQ-ID-NO-542 | DADVDKFKAW | RQGRTGYPLV | DAGMRELWAT | GWMHNRI RVI | VSSFAVKFLL | 371 |
| SEQ-ID-NO-547 | NADQAHFKAW | RQGRTGYPLV | DAGMRELWAT | GWVHNKI RVI | VSSFFVKFLL | 368 |
| SEQ-ID-NO-548 | NADQARFKAW | RQGRTGYPLV | DAGMRELWAT | GWI HNKI RVI | VASFEVKFLL | 368 |
| SEQ-ID-NO-541 | NDNQVHFKAW | RQGRTGYPLV | DAGMRELWAT | GWI HNKI RVI | VASFAVKVL | 366 |
| SEQ-ID-NO-545 | NTDPSKFKAW | RLGRTGYPLV | DAGMRELWAT | GWI HNKMRVI | VSSFAVKML | 365 |
| SEQ-ID-NO-546 | NADPSNFKTW | RQGRTGYPLV | DAGMRELWAT | GWMHNRI RVI | VSSFAVKML | 367 |

| | | | | | | |
|---|---|---|---|---|---|---|
| SEQ-ID-NO-544 | LPWRWGMKYF | WDTLLDADLE | SDALGWQYI T | GTLPDSREED | RI DNPQEGY | 446 |
| SEQ-ID-NO-539 | LPWRWGMKYF | WDVLLDADLE | CDVLGWQYI S | GSLPDGHELD | RI ENPEVEGY | 420 |
| SEQ-ID-NO-549 | LPWIWGMKYF | WDVLLDADLE | SDI LGWQYI S | GSLPDGHELS | RLDNPEVQGQ | 421 |
| SEQ-ID-NO-543 | LPWKWGMKYF | WDTLLDADLE | CDI LGWQYI S | GSLPDGHELD | RLDNPAI QGA | 420 |
| SEQ-ID-NO-538 | LPWKWGMKYF | WDTLLDADLE | CDI LGWQYI S | GSI PDGHELD | RLDNPAI QGA | 421 |
| SEQ-ID-NO-542 | LPWKWGMKYF | WDTLLDADLE | CDI LGWQYI S | GSLPDGHELD | RLDNPALQGA | 421 |
| SEQ-ID-NO-547 | LPWQWGMKYF | WDTLLDADLE | SDI LGWQYI S | GSLPDGHELE | RLDNPEVQGF | 418 |
| SEQ-ID-NO-548 | LPWQWGMKYF | WDTLLDADLE | SDI LGWQYI S | GSLPDGHELE | RLDNPEVQGF | 418 |
| SEQ-ID-NO-541 | LPWRWGMKYF | WDTLLDADLE | SDI LGWQYI S | GSLPDAHELE | RLDNPEI QGS | 416 |
| SEQ-ID-NO-545 | LPWKWGMKYF | WDTLLDADLE | SDI LGWQYI S | GSLPDGHELE | RLDDPEI QGT | 415 |
| SEQ-ID-NO-546 | LPWKWGMKYF | WDTLLDADLE | CDI LGWQYI S | GCLPDGHELE | RLDDPEI LGA | 417 |

Figure 22 (continued)

| SEQ ID | Sequence | # |
|---|---|---|
| SEQ-ID-NO-544 | KFDPN GEYVR RWLPELSRLP TEWI HHPWNA PESVLQAAGI ELGSNYPRPI | 496 |
| SEQ-ID-NO-539 | RFDPDGDYVR RWIPELARLP NEWVHHPWDA PPSAL RAAGV ELGTNYPRPI | 470 |
| SEQ-ID-NO-549 | KYDPDGMYVR TWIPELARMP TEWIHHPWDA PSCILEVAGV ELGFNYPKPI | 471 |
| SEQ-ID-NO-543 | KYDPEGEYIR QWLPELARLP TEWIHHPWDA PLTVLKASGV ELGTNYAKPI | 470 |
| SEQ-ID-NO-538 | KYDPEGEYIR QWLPELARLP TEWIHHPWDA PLTVLKASGV ELGTNYVKPI | 471 |
| SEQ-ID-NO-542 | KFDPEGEYVR QWLPELARLP AEWIHHPWDA PLNVLKAAGV ELGMNYPNPI | 471 |
| SEQ-ID-NO-547 | NYDPEGEYVR HWLPELARMP AEWIHHPWDA PLTVLKAAGV ELGMNYPKPI | 468 |
| SEQ-ID-NO-548 | NYDPEGEYVR HWLPELARMP AEWIHHPWDA SIAVLKAAGV ELGINYPKPI | 468 |
| SEQ-ID-NO-541 | KFDPEGEYVR RWLPELARIP TEWIHHPWDA PLTVLKASGI ELGQNYPKPI | 466 |
| SEQ-ID-NO-545 | KYDPEGEYIR QWLPELARIP TEWIHHPWNA PLSVLRASGV ELGQNYPKPI | 465 |
| SEQ-ID-NO-546 | KFDPEGEYVR QWLPELARMP TEWIHHPWNA PLSVLRASGV ELGQNYPNPI | 467 |

| SEQ ID | Sequence | # |
|---|---|---|
| SEQ-ID-NO-544 | VGIDEAKARL HEALSQMWQL EAASRAAIEN GSEEEGLGDST EFVE------ | 540 |
| SEQ-ID-NO-539 | VEIGAARERL QASLAEMWER DAAMKAALAN GLEEGLGETV EVAGTGGPEH | 520 |
| SEQ-ID-NO-549 | VDLHIAREQL DDSISTMWQL QTAEKLAELD G--TEVVEDN SNI------- | 512 |
| SEQ-ID-NO-543 | VDIDTARELL TKAISRTREA QIMIGAA--- --PDEIVADSF ---------- | 505 |
| SEQ-ID-NO-538 | VDIDTARELL AKAISRTREA QIMIGAA--- --PDEIVADSF ---------- | 507 |
| SEQ-ID-NO-542 | VDIDTARELL TKAISRTREA EAAVNTSHAN GTVEVVFDNS ENVG------ | 507 |
| SEQ-ID-NO-547 | DVDVARDRL MQAIFIMREK EAAANAADAN GTNEVVFDNS ENVG------ | 512 |
| SEQ-ID-NO-548 | DVDVARDRL MEAIFKMWEM EAAARASNTN GTNEVVVDNT DDT------- | 512 |
| SEQ-ID-NO-541 | DIDLAREQL TQAIFKMWED EAAASKASTSE NKHEVVDDS ---------- | 509 |
| SEQ-ID-NO-545 | DIDLAREKL TQAIFKMWEI QAAASKASGSE ARDEVVVDN ---------- | 504 |
| SEQ-ID-NO-546 | | 506 |

| SEQ ID | Sequence | # |
|---|---|---|
| SEQ-ID-NO-544 | APIEEPRDIT MEETEPTRL- NPVRRYEDQM VPSITTSLIR PEEDQESSLS | 589 |
| SEQ-ID-NO-539 | ERMDVPR-VM VHMQRDADM- SCNSSRRDQL VPELVPN--- ---------- | 555 |
| SEQ-ID-NO-549 | KTFDIPK-VV LREITSP--- CA--LPIDQR VPHA------ ---------- | 539 |
| SEQ-ID-NO-543 | EALEAAN--T V-KEHGY--- CPL-SSNDQQ VPSDV----- ---------- | 532 |
| SEQ-ID-NO-538 | EALGANT--- L-KEPGL--- CPSVSSNDQQ VPSAV----- ---------- | 535 |
| SEQ-ID-NO-542 | GALEGNT--- V-KETGL--- CPSVSSNDQQ VPSAV----- ---------- | 535 |
| SEQ-ID-NO-547 | DSASIPKDDV V-KGKEP--- CPSSSYDQR VPSMQ----- ---------- | 543 |
| SEQ-ID-NO-548 | DSVN-PK-V V-KGKVP--- CPSSSYDQR VPSMQ----- ---------- | 540 |
| SEQ-ID-NO-541 | ENLAPK-VV L-KDKVT--- CPTNSSNDQR VPTNQN---- ---------- | 540 |
| SEQ-ID-NO-545 | ENLSIPK-VF L-KDKAPR-- GATSSSNDQK VPLQNP---- ---------- | 537 |
| SEQ-ID-NO-546 | ENQDIPK-VI L-KDKGP--- CMTSANDQK VPALPDP---- ---------- | 538 |

| | | | | |
|---|---|---|---|---|
| SEQ-ID-NO-544 | VNWRRLSQTG | ---------- | ---------- | 704 |
| SEQ-ID-NO-539 | SNKQAEEEDF | YVPKLVKWTQ | PRKRRVKQDG | 727 |
| SEQ-ID-NO-549 | SSTADSGSSL | SRQRKAA--- | ---------- | 651 |
| SEQ-ID-NO-543 | ---TSLGKNG | CK-------- | ---------- | 618 |
| SEQ-ID-NO-538 | ---TSLGKNG | ---------- | ---------- | 612 |
| SEQ-ID-NO-542 | ---TKLGKNG | ---------- | ---------- | 617 |
| SEQ-ID-NO-547 | DT-------- | ---------- | ---------- | 635 |
| SEQ-ID-NO-548 | DMEINSCKNE | KQLHFIV--- | ---------- | 641 |
| SEQ-ID-NO-541 | EMEQSSSKDG | ---------- | ---------- | 646 |
| SEQ-ID-NO-545 | ---------- | ---------- | ---------- | 600 |
| SEQ-ID-NO-546 | DMEQSSGKDG | PT-------- | ---------- | 629 |

Figure 23

```
SEQ-ID-NO-606   ---MDYSSMHQ  -NVMGVSSCS  ----------  ----------  LSATRPAPPE  QSLRCPRCDS   47
SEQ-ID-NO-609   MNPSSGQP--  QQMSSQSVE-  ----------  TQDYQNQKKP  KKPKPKP-HPE  QALKCPRCDS   35
SEQ-ID-NO-607   MGMDSSSGQQ  QQMSNQSLE-  ----------  SMLTCSKGEQ  DKKPKPQPE-  -ALKCPRCDS   48
SEQ-ID-NO-608   ---MDSSSEQQ  HQQMSNQSLE  ----------  SMLTCSKGEQ  DKKAKP-QPE  -ALKCPRCDS   46

SEQ-ID-NO-606   TNTKFCYYNN  YSLSQPRYFC  ----------  KSCRRYWTKG  GL-RNIPIGG  AYRKHKRS-S   96
SEQ-ID-NO-609   TNTKFCYYNN  YSLSQPRYFC  ----------  KSCRRYWTKG  GTLRNVPVGG  GCRKKR---S   82
SEQ-ID-NO-607   NNTKFCYYNN  YSLSQPRYFC  ----------  KSCRRYWTKG  GTLRNVPVGG  GCRKNKRSSS   98
SEQ-ID-NO-608   SNTKFCYYNN  YSLSQPRYFC  ----------  KSCRRYWTKG  GTLRNVPVGG  GCRKNKRSSS   96

SEQ-ID-NO-606   SATKSLRTTP  EPTMTHDGKS  ----------  FPTASFGYNN  NNISNEQME-  ---GLA----  139
SEQ-ID-NO-609   SSLKRAQGQT  LTPNLNPLTT  ----------  LPHLSYDSND  FTLAVARFQK  QSSGOLGYN-  131
SEQ-ID-NO-607   ASSKRSQDQP  FQLNPNPLTC  ----------  FPSLSYDSND  LTLALARLQK  GH-GFDH---  145
SEQ-ID-NO-608   SVSRRIQDQA  FVNNPNPVTC  ----------  FPSLSYDSND  LTLALARLQK  GQLGFDH---  143

SEQ-ID-NO-606   ---YALLNKQ  P---------  ---------  -LGVSSHLG  FG-SSQSPMA  MDGV----YG  170
SEQ-ID-NO-609   DRDLSILGNP  T---------  ---------TG  SFCDILGNSG  MNPSSANPSF  LDAIRTGFL-  174
SEQ-ID-NO-607   EHDFSILGNQ  N---------  ---------N  TSCGILNNHG  MNHSSNNGF  FEAL------MG  183
SEQ-ID-NO-608   EHDFSILGNH  ANSNININN  ----------  TSCAVLNNHG  MNHSSNHGF  FEAL------MG  189

SEQ-ID-NO-606   TISHQMENTG  YAFGNGGGG-  ----------  VDNGNSGVVG  VSGEMMLPYD  QVIMSNATTQ  189
SEQ-ID-NO-609   TQNH-LQNLY  CMYGNGDLGE  ----------  VDNGNANCNG  NGEMMLPYD  HE---ADMSIATTQ  223
SEQ-ID-NO-607   SQNN-VQNLY  V-------MGE  ----------  VDNGNV----  SGEMMLPYD  HE---MSIATTQ  224
SEQ-ID-NO-608   SQNN-VQNLY  YGYGNRDMGE  ----------  VDNGNV----  SGEMMLPYD  HE---MSIATTQ  232

SEQ-ID-NO-606   ----------  MEQMATSDPN  ----------  RVLMGFPWQM  NMGGGSGHGH  GHVDQID-SG  228
SEQ-ID-NO-609   SVSV--MKQE  MCSRREQSER  ----------  RVLGFPWQI  N---------  TNIGELD-SG  263
SEQ-ID-NO-607   AVTVTMKQE  MCNVREQNEN  ----------  RVLGFPWQF  N-------NGD  TNMAEMDHLG  268
SEQ-ID-NO-608   AVTVTMKQE  MCNVREQNES  ----------  RVLLGFPWQF  N-------NGD  SNMDEIDHSG  276

245
SEQ-ID-NO-606   RE---WSSTV  NYINTG----  ALL                                            245
SEQ-ID-NO-609   RT-ASWNSFT  NSW-HGFQS  PLM                                            285
SEQ-ID-NO-607   RAG--WNGLT  SSWGHGLLNS  PLM                                            289
SEQ-ID-NO-608   RAG--WNGLT  SPW-HGLLNS  PLM                                            296
```

Figure 24

MODULATING LIGHT RESPONSE PATHWAYS IN PLANTS, INCREASING LIGHT-RELATED TOLERANCES IN PLANTS, AND INCREASING BIOMASS IN PLANTS

CROSS-REFERENCE TO RELATED APPLICATIONS

This application is a divisional of U.S. patent application Ser. No. 13/630,902 filed Sep. 28, 2012 which application is a continuation-in-part application of and claims priority to U.S. patent application Ser. No. 13/630,902 filed Sep. 28, 2012 which application is a continuation-in-part application of and claims priority to U.S. patent application Ser. No. 12/863,102, filed Apr. 11, 2011, which is a National Stage application under 35 U.S.C. § 371 of International Application No. PCT/US2009/031292, filed Jan. 16, 2009, which claims the benefit of priority under 35 U.S.C. § 119(e) to U.S. Provisional Patent Application Ser. No. 61/021,943, filed Jan. 18, 2008, U.S. patent application Ser. No. 13/630,902 filed Sep. 28, 2012, is also a continuation-in-part application of and claims priority to U.S. patent application Ser. No. 12/373,134, filed Apr. 6, 2010, which is a National Stage application under 35 U.S.C. § 371 of International Application No. PCT/US2007/073154, filed Jul. 10, 2007, which claims the benefit of priority under 35 U.S.C. § 119(e) to U.S. Provisional Patent Application Ser. No. 60/819,763, filed Jul. 10, 2006. U.S. patent application Ser. No. 13/630,902 filed Sep. 28, 2012, is also a continuation-in-part application of and claims priority to U.S. patent application Ser. No. 12/513,086, filed Apr. 23, 2010, which is a National Stage application under 35 U.S.C. § 371 of International Application No. PCT/US2007/083495, filed Nov. 2, 2007, which claims the benefit of priority under 35 U.S.C. § 119(e) to U.S. Provisional Patent Application Ser. No. 60/856,613, filed Nov. 3, 2006, U.S. patent application Ser. No. 13/630,902 filed Sep. 28, 2012, is also a continuation-in-part application of and claims priority to U.S. patent application Ser. No. 12/515,687, filed Apr. 6, 2010, which is a National Stage application under 35 U.S.C. § 371 of International Application No. PCT/US2007/085237, filed Nov. 20, 2007, which claims the benefit of priority under 35 U.S.C. § 119(e) to U.S. Provisional Patent Application Ser. No. 60/860,145, filed Nov. 20, 2006. U.S. patent application Ser. No. 13/630, 902 filed Sep. 28, 2012, is also a continuation-in-part application of and claims priority to U.S. patent application Ser. No. 12/307,561, filed Nov. 23, 2009, which is a National Stage application under 35 U.S.C. § 371 of International Application No. PCT/US2007/072877, filed Jul. 5, 2007, which claims priority under 35 U.S.C. § 119(e) to U.S. Provisional Patent Application Ser. No. 60/818,569, filed Jul. 5, 2006. U.S. patent application Ser. No. 13/630,902 filed Sep. 28, 2012, is also a continuation-in-part application of and claims priority to U.S. patent application Ser. No. 13/119,572, filed Mar. 17, 2011, which is a National Stage application under 35 U.S.C. § 371 of International Application No. PCT/US2009/057116, filed Sep. 16, 2009, which claims the benefit of priority under 35 U.S.C. § 119(e) to U.S. Provisional Patent Application Ser. No. 61/097,789, filed Sep. 17, 2008. The disclosures of these prior applications are considered part of (and are incorporated by reference in their entirety in) the disclosure of this application.

TECHNICAL FIELD

This document relates to methods and materials involved in plant shade and/or low light tolerance, and red light specific responses. For example, this document provides plants having increased shade and/or low light tolerance as well as materials and methods for making plants having increased shade and/or low light tolerance. This document also relates to methods and materials involved in increasing UV-B tolerance in plants and methods and materials involved in modulating biomass levels in plants.

BACKGROUND

Light is the source of energy that fuels plant growth through photosynthesis. Light is also a developmental signal that modulates morphogenesis, such as de-etiolation and the transition to reproductive development. Since plants cannot choose their surroundings, they are forced to adapt their growth to ambient light conditions and have evolved complex mechanisms for monitoring the quantity and quality of the surrounding light. For example, many kinds of plants respond to growth under dense canopies or at high densities by growing faster and taller (Cerdan and Chory (2003) Nature, 423:881). Densely planted crops tend to place energy into stem and petiole elongation to lift the leaves into the sunlight rather than putting energy into storage or reproductive structures. The response to low light conditions and/or shade conditions negatively affects crop yields by reducing the amount of harvestable products such as seeds, fruits and tubers. In addition, tall spindly plants tend to be less wind resistant and lodge more easily, further reducing crop yield.

There is a continuing need for plants that can thrive under less than optimal environmental conditions. One strategy to improve a plant's ability to withstand suboptimal environmental conditions relies upon traditional plant breeding methods. Another approach involves genetic manipulation of plant characteristics through the introduction of exogenous nucleic acids conferring a desirable trait.

SUMMARY

The spectral energy distribution of daylight is dramatically altered by vegetation. Light reflected from neighboring vegetation is depleted in red (R) wavelengths, but remains rich in far-red (FR) wavelengths. It is desirable to have plants that exhibit increased shade tolerance. Plants having increased shade tolerance described herein exhibit an increased tolerance to shade conditions, in particular, Short Day plus End-of-Day Far-Red (SD+EODFR) conditions. Wild-type plants typically exhibit shade avoidance responses to SD+EODFR conditions, whereas the SD+EODFR-tolerant plants described herein display a reduction in the level of shade avoidance responses relative to the level of shade avoidance responses displayed by non-SD+EODFR-tolerant plants.

The quantity of light can dictate the eventual biomass and yield of plants. Wild-type plants typically exhibit low light responses, whereas the low light-tolerant plants described herein display a reduction in the level of low light responses relative to the level of low light responses displayed by non-low light-tolerant plants.

Increasing the SD+EODFR and/or low light tolerance of plants can increase the crop yields of such plants, which can benefit both food consumers and producers. This document provides methods and materials related to plants having increased shade and/or low light tolerance. For example, this document provides transgenic plants having increased SD+EODFR and/or low light tolerance, nucleic acids used to generate transgenic plants having increased SD+EODFR and/or low light tolerance, and methods for making plants having increased SD+EODFR and/or low light tolerance. Such plants may be useful to produce biomass which may be converted to a liquid fuel or other chemicals and/or to produce crops with increased yield and/or quality.

Methods of producing a plant are provided herein. In one aspect, a method comprises growing a plant cell comprising an exogenous nucleic acid. The exogenous nucleic acid comprises a regulatory region operably linked to a nucleotide sequence encoding a polypeptide. The Hidden Markov Model (HMM) bit score of the amino acid sequence of the polypeptide is greater than about 20, using an HMM generated from the amino acid sequences depicted in one of FIGS. 1-24. A plant produced from the cell has a difference in low light or SD+EODFR tolerance as compared to a control plant that does not comprise the exogenous nucleic acid.

In another aspect, the exogenous nucleic acid comprises a regulatory region operably linked to a nucleotide sequence encoding a polypeptide having 80 percent or greater sequence identity to an amino acid sequence set forth in SEQ ID NOs:3, 5, 7, 9, 10, 12, 14, 16, 18, 20, 22, 24, 25, 26, 28, 30, 32, 34, 36, 38, 40, 42, 44, 46, 48, 49, 51, 53, 55, 57, 59, 60, 61, 62, 63, 65, 67, 70, 72, 74, 76, 78, 80, 82, 84, 86, 88, 89, 90, 91, 93, 95, 96, 97, 98, 99, 100, 101, 102, 103, 105, 107, 109, 111, 113, 115, 116, 117, 118, 119, 120, 121, 122, 124, 126, 129, 130, 131, 132, 133, 135, 137, 139, 141, 143, 145, 147, 149, 151, 153, 155, 157, 159, 161, 163, 165, 167, 169, 171, 173, 175, 177, 179, 181, 183, 185, 187, 188, 189, 191, 193, 195, 197, 199, 201, 203, 205, 207, 209, 211, 213, 215, 217, 219, 221, 223, 225, 227, 229, 230, 231, 232, 233, 234, 235, 236, 237, 238, 239, 241, 243, 245, 247, 249, 251, 253, 255, 257, 259, 261, 262, 264, 266, 268, 270, 271, 273, 275, 277, 279, 281, 283, 285, 287, 289, 291, 292, 293, 294, 295, 296, 297, 298, 299, 300, 301, 302, 303, 304, 306, 308, 310, 312, 314, 317, 319, 321, 323, 325, 327, 329, 330, 331, 332, 334, 337, 339, 341, 343, 344, 346, 347, 348, 349, 350, 351, 352, 353, 354, 355, 357, 359, 361, 362, 364, 365, 366, 367, 368, 370, 372, 374, 376, 378, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 456, 457, 458, 459, 460, 462, 464, 466, 468, 470, 472, 474, 475, 477, 478, 479, 480, 481, 482, 483, 484, 485, 486, 487, 488, 489, 491, 493, 494, 495, 496, 497, 498, 499, 501, 503, 505, 507, 508, 509, 510, 511, 512, 514, 515, 516, 518, 520, 521, 522, 523, 524, 525, 526, 527, 528, 529, 530, 531, 532, 533, 534, 535, 536, 538, 539, 541, 542, 543, 544, 545, 546, 547, 548, 549, 550, 552, 554, 555, 556, 557, 558, 559, 560, 561, 562, 563, 564, 565, 567, 570, 572, 574, 576, 578, 579, 580, 582, 584, 586, 588, 590, 592, 594, 596, 598, 600, 601, 603, 606, 607, 608, 609, 611, 613, 615, 616, 617, 618, 620, 621, 622, 624, 625, 626, 628, 629, 631, 634, 636, 637, 638, 639, 641, 644, 645, 647, 649, 651, 653, 655, 657, 659, 661, 663, 665, 667, 669, 671, 673, 675, 676, 678, 680, 682, 684, 686, 688, 690, 692, 694, 695, 697, 699, 701, 702, 704, 706, 708, 709, 711, 712, 713, 714, 716, 718, 720, 721, 723, 725, 726, 728, 730, 732, 734, 736, 738, 740, 741, 742, 743, 744, 745, 747, 749, 750, 751, 753, 755, 757, 759, 761, 762, 763, 764, 765, 767, 769, 771, 773, 774, 776, 778, 779, 780, 782, 783, 784, 786, 788, 790, 792, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 826, 827, 829, 830, 831, 832, 833, 834, 835, 837, 838, 839, 840, 841, 843, 845, 847, 850, 851, 853, 855, 857, 859, 861, 862, 863, 864, 865, 866, 868, 870, 872, 874, 876, 877, 879, 881, 883, 885, 887, 889, 891, 893, 895, 897, 898, 900, 902, 904, 907, 909, 911, 913, 915, 917, 919, 920, 922, 923, 924, 926, 928, 929, 930, 931, 932, 934, 936, 937, 938, 939, 940, 941, 943, 945, 947, 948, 949, 950, 953, 955, 957, 959, 961, 963, 965, 966, 967, 969, 971, 973, 975, 977, 979, 981, 983, 985, 987, 989, 991, 993, 995, 997, 999, 1001, 1003, 1005, 1007, 1009, 1011, 1013, 1014, 1015, 1016, 1018, 1024, 1025, 1027, 1029, 1030, 1032, 1033, 1035, 1037, 1039, 1040, 1042, 1043, 1044, 1047, 1049, 1051, 1053, 1055, 1057, 1059, 1061, 1063, 1065, 1067, 1068, 1069, 1071, 1072, 1073, 1074, 1075, 1077, 1078, 1080, 1081, 1083, 1085, 1087, 1089, 1091, 1093, 1095, 1097, 1098, 1099, 1100, 1101, 1103, 1105, 1107, 1109, 1111, 1113, 1115, 1117, 1119, 1121, 1123, 1125, 1127, 1129, 1131, 1133, 1134, 1135, 1136, 1137, 1138, 1139, 1141, 1143, 1145, 1147, 1149, 1151, 1153, 1155, 1157, 1159, 1160, 1161, 1162, 1164, 1166, 1168, 1170, 1172, 1174, 1176, 1178, 1180, 1182, 1184, 1186, 1188, 1190, 1192, 1194, 1196, 1198, 1199, 1200, 1201, 1202, 1203, 1204, 1206, 1208, 1209, 1211, 1213, 1214, 1215, 1216, 1217, 1219, 1221, 1223, 1225, 1227, 1229, 1230, 1232, 1234, 1236, 1238, 1240, 1242, 1244, 1246, 1248, 1250, 1252, 1254, 1255, 1256, 1257, 1258, 1259, 1260, 1261, 1262, 1263, 1264, 1266, 1268, 1270, 1272, 1274, 1277, 1279, 1281, 1283, 1285, 1287, 1289, 1291, 1293, 1294, 1295, 1297, 1298, 1299, 1301, 1303, 1305, 1307, 1309, 1311, 1313, 1315, 1317, 1319, 1321, 1322, 1323, 1324, 1325, 1326, 1327, 1328, 1329, 1330, 1331, 1332, 1334, 1336, 1338, 1340, 1342, 1344, 1347, 1349, 1351, 1352, 1353, 1355, 1357, 1358, 1360, 1362, 1364, 1366, 1367, 1368, 1370, 1372, 1374, 1375, 1377, 1379, 1381, 1383, 1385, 1387, 1389, 1391, 1393, 1395, 1397, 1399, 1401, 1402, 1404, 1406, 1408, 1410, 1411, 1412, 1413, 1414, 1415, 1417, 1419, 1421, 1422, 1423, 1424, 1425, 1426, 1427, 1429, 1430, 1431, 1433, 1434, 1435, 1436, 1438, 1439, 1440, 1442, 1444, 1446, 1448, 1450, 1452, 1457, 1458, 1460, 1462, 1464, 1466, 1467, 1468, 1469, 1471, 1473, 1475, 1477, 1478, 1479, 1480, 1481, 1482, 1483, 1484, 1485, 1486, 1488, 1490, 1492, 1494, 1497, 1499, 1501, 1502, 1503, 1504, 1505, 1506, 1508, 1510, 1511, 1512, 1513, 1514, 1515, 1516, 1518, 1519, 1520, 1521, 1522, 1523, 1524, 1525, 1527, 1528, 1529, 1531, 1532, 1533, 1534, 1535, 1536, 1540, 1541, 1543, 1545, 1547, 1549, 1551, 1553, 1554, 1555, 1556, 1557, 1558, 1559, 1561, 1563, 1564, 1565, 1566, 1567, 1568, 1570, 1572, 1574, 1576, 1578, 1580, 1582, 1584, 1587, 1589, 1591, 1593, 1594, 1596, 1597, 1598, 1599, 1600, 1601, 1602, 1603, 1604, 1605, 1606, 1607, 1609, 1611, 1612, 1613, 1614, 1615, 1616, 1617, 1618, 1619, 1620, 1621, 1623, 1625, 1630, 1631, 1632, 1635, 1637, 1639, 1641, 1642, 1643, 1644, 1646, 1648, 1650, 1651, 1652, 1653, 1654, 1655, 1657, 1659, 1661, 1663, 1665, 1667, 1669, 1671, 1673, 1675, 1677, 1679, 1681, 1682, 1684, 1686, 1688, 1690, 1692, 1694, 1696, 1698, 1699, 1700, 1701, 1702, 1703, 1704, 1705, 1707, 1709, 1711, 1713, 1715, 1717, 1719, 1720, 1721, 1722, 1723, 1725, 1727, 1729, 1730, 1732, 1734, 1736, 1738, 1739, 1740, 1741, 1742, 1743, 1744, 1745, 1746, 1748, 1750, 1751, 1752, 1754, 1756, 1758, 1760, 1762, 1764, 1766, 1767, 1768, 1769, 1770, 1771, 1772, 1773, 1774, 1775, 1776, 1777, 1778, 1780, 1782, 1784, 1786, 1788, 1790, 1792, 1794, 1796, 1798, 1800, 1802, 1804, 1805, 1806, 1807, 1808, 1809, 1810, 1811, 1812, 1813, 1814, 1815, 1816, 1817, 1818, 1819, 1820, 1821, 1822, 1823, 1824, 1825, 1826, 1827, 1828, 1829, 1830, 1831, 1832, 1833, 1834, 1835, 1836, 1837, 1838, 1839, 1840, 1842, 1843, 1844, 1845, 1846, 1847, 1848, 1850, 1852, 1854, 1856, 1858, 1859, 1860, 1861, 1862, 1863, 1864, 1865, 1866, 1867, 1869, 1870, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2009, 2011, 2013, 2015, 2017, 2019, 2021, 2023, 2025, 2027, 2029, 2030, 2031, 2032, 2033, 2034, 2035, 2036, 2037, 2038, 2039, 2040, 2041, 2042, 2043, 2044, 2045, 2046, 2047, 2048, 2049, 2050, 2051, 2052, 2053, 2054, 2055, 2056, 2057, 2058, 2059, 2060, 2061, 2062, 2063, 2064, 2065, 2066, 2067, 2069, 2070, 2072, 2074, 2076, 2078, 2080, 2081, 2083, 2084, 2085, 2087, 2089, 2091, 2093, 2095, 2097, 2099, 2101, 2103, 2105, 2107, 2109, 2111, 2113, 2114, 2115, 2116, 2117, 2118, 2119, 2120, 2121, 2123, 2125, 2127, 2129, 2131, 2133, 2135, 2136, 2137, 2138, 2139, 2140, 2141, 2142, 2143, 2144, 2146, 2148, 2150, 2152, 2154, 2156, 2158, 2160, 2162, 2164, 2166, 2168, 2170, 2172, 2174, 2176, 2178, 2180, 2182, 2183, 2184, 2185, 2186, 2187, 2188, 2189, 2190, 2191, 2192, 2193, 2194, 2195, 2196, 2197, 2198, 2199, 2200, 2201, 2202, 2203, 2204, 2205, 2206, 2207, 2208, 2209, 2210, 2211, 2212, 2213, 2214, 2215, 2216, 2217, 2218, 2219, 2220, 2221, 2222, 2223, 2224, 2225, 2226, 2227, 2228, 2229, 2230, 2231, 2232, 2233, 2234, 2235, 2236, 2237, 2238, 2239, 2240, 2241, 2242, 2243, 2244, 2245, 2246, 2247, 2248, 2249, 2250, 2251, 2252, 2253, 2254, 2255, 2256, 2257, 2258, 2259, 2260, 2261, 2262, 2263, 2264, 2266, 2268, 2269, 2270, 2271, 2272, 2273, 2274, 2275, 2276, 2277, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2323, 2324, 2325, 2326, 2327, 2328, 2329, 2330, 2331, 2332, 2333, 2334, 2335, 2336, 2337, 2338, 2339, 2340, 2341, 2342, 2343, 2344, 2345, 2346, 2347, 2348, 2350, 2352, 2354, 2356, 2358, 2360, 2362, 2364, 2366, 2368, 2370, 2372, 2374, 2375, 2376, 2377, 2378, 2379, 2380, or 2381. A plant produced from the plant cell has a difference in low light or SD+EODFR tolerance as compared to a control plant that does not comprise the exogenous nucleic acid.

In one aspect, the polypeptide further comprises a CDI domain having 70 percent or greater sequence identity to the CDI domain of SEQ ID NO:70. In another aspect, the polypeptide further comprises an AUX/IAA domain having 70 percent or greater sequence identity to the AUX/IAA domain of SEQ ID NO:129 or SEQ ID NO:1347. In another aspect, the polypeptide further comprises a homeobox domain having 70 percent or greater sequence identity to the homeobox domain of SEQ ID NO:317. In another aspect, the polypeptide further comprises a zf_C3HC4 domain having 70 percent or greater sequence identity to the zf_C3HC4 domain of SEQ ID NO:337. In another aspect, the polypeptide further comprises a B-box zinc finger domain having 70 percent or greater sequence identity to the B-box zinc finger domain of SEQ ID NO:456 and a CCT motif having 70 percent or greater sequence identity to the CCT motif of SEQ ID NO:456. In another aspect, the polypeptide further comprises a FAD_binding_7 domain having 70 percent or greater sequence identity to the FAD_binding_7 domain of SEQ ID NO:538 or SEQ ID NO:1497 and a DNA photolyase domain having 70 percent or greater sequence identity to the DNA photolyase domain of SEQ ID NO:538 or SEQ ID NO:1497. In another aspect, the polypeptide further comprises a zf_Dof domain having 70 percent or greater sequence identity to the zf_Dof domain of SEQ ID NO:606. In another aspect, the polypeptide further comprises an AP2 domain having 70 percent or greater sequence identity to the AP2 domain of SEQ ID NO:645. In another aspect, the polypeptide further comprises a VQ motif having 70 percent or greater sequence identity to the VQ motif of SEQ ID NO:850. In another aspect, the polypeptide further comprises a zf_C2H2 domain having 70 percent or greater sequence identity to the zf_C2H2 domain of SEQ ID NO:907. In another aspect, the polypeptide further comprises a TCP domain having 70 percent or greater sequence identity to the TCP domain of SEQ ID NO:1151. In another aspect, the polypeptide further comprises an F-box domain having 70 percent or greater sequence identity to the F-box domain of SEQ ID NO:1277. In another aspect, the polypeptide further comprises a zf_CCCH domain having 70 percent or greater sequence identity to the zf_CCCH domain of SEQ ID NO:1457. In another aspect, the polypeptide further comprises a PDX domain having 70 percent or greater sequence identity to the PDX domain of SEQ ID NO:1540 and a homeobox domain having 70 percent or greater sequence identity to the homeobox domain of SEQ ID NO:1540. In another aspect, the polypeptide further comprises an HSF-type DNA-binding domain having 70 percent or greater sequence identity to the HSF-type DNA-binding domain of SEQ ID NO:1587. In another aspect, the polypeptide further comprises a SAM_1 domain having 70 percent or greater sequence identity to the SAM_1 domain of SEQ ID NO:1635 and a DRMBL domain having 70 percent or greater sequence identity to the DRMBL domain of SEQ ID NO:1635.

In another aspect, a method of producing a plant comprises growing a plant cell comprising an exogenous nucleic acid, where the exogenous nucleic acid comprises a regulatory region operably linked to a nucleotide sequence having 80 percent or greater sequence identity to a nucleotide sequence, or a fragment thereof, set forth in SEQ ID NOs:1, 2, 4, 6, 8, 11, 13, 15, 17, 19, 21, 23, 27, 29, 31, 33, 35, 37, 39, 41, 43, 45, 47, 50, 52, 54, 56, 58, 64, 66, 68, 69, 71, 73, 75, 77, 79, 81, 83, 85, 87, 92, 94, 104, 106, 108, 110, 112, 114, 123, 125, 127, 128, 134, 136, 138, 140, 142, 144, 146, 148, 150, 152, 154, 156, 158, 160, 162, 164, 166, 168, 170, 172, 174, 176, 178, 180, 182, 184, 186, 190, 192, 194, 196, 198, 200, 202, 204, 206, 208, 210, 212, 214, 216, 218, 220, 222, 224, 226, 228, 240, 242, 244, 246, 248, 250, 252, 254, 256, 258, 260, 263, 265, 267, 269, 272, 274, 276, 278, 280, 282, 284, 286, 288, 290, 305, 307, 309, 311, 313, 315, 316, 318, 320, 322, 324, 326, 328, 333, 335, 336, 338, 340, 342, 345, 356, 358, 360, 363, 369, 371, 373, 375, 377, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 455, 461, 463, 465, 467, 469, 471, 473, 476, 490, 492, 500, 502, 504, 506, 513, 517, 519, 537, 540, 551, 553, 566, 568, 569, 571, 573, 575, 577, 581, 583, 585, 587, 589, 591, 593, 595, 597, 599, 602, 604, 605, 610, 612, 614, 619, 623, 627, 630, 632, 633, 635, 640, 642, 643, 646, 648, 650, 652, 654, 656, 658, 660, 662, 664, 666, 668, 670, 672, 674, 677, 679, 681, 683, 685, 687, 689, 691, 693, 696, 698, 700, 703, 705, 707, 710, 715, 717, 719, 722, 724, 727, 729, 731, 733, 735, 737, 739, 746, 748, 752, 754, 756, 758, 760, 766, 768, 770, 772, 775, 777, 781, 785, 787, 789, 791, 793, 825, 828, 836, 842, 844, 846, 848, 849, 852, 854, 856, 858, 860, 867, 869, 871, 873, 875, 878, 880, 882, 884, 886, 888, 890, 892, 894, 896, 899, 901, 903, 905, 906, 908, 910, 912, 914, 916, 918, 921, 925, 927, 933, 935, 942, 944, 946, 951, 952, 954, 956, 958, 960, 962, 964, 968, 970, 972, 974, 976, 978, 980, 982, 984, 986, 988, 990, 992, 994, 996, 998, 1000, 1002, 1004, 1006, 1008, 1010, 1012, 1017, 1019, 1020, 1021, 1022, 1023, 1026, 1028, 1031, 1034, 1036, 1038, 1041, 1045, 1046, 1048, 1050, 1052, 1054, 1056, 1058, 1060, 1062, 1064, 1066, 1070, 1076, 1079, 1082, 1084, 1086, 1088, 1090, 1092, 1094, 1096, 1102, 1104, 1106, 1108, 1110, 1112, 1114, 1116, 1118, 1120, 1122, 1124, 1126, 1128, 1130, 1132, 1140, 1142, 1144, 1146, 1148, 1150, 1152, 1154, 1156, 1158, 1163, 1165, 1167, 1169, 1171, 1173, 1175, 1177, 1179, 1181, 1183, 1185, 1187, 1189, 1191, 1193, 1195, 1197, 1205, 1207, 1210, 1212, 1218, 1220, 1222, 1224, 1226, 1228, 1231, 1233, 1235, 1237, 1239, 1241, 1243, 1245, 1247, 1249, 1251, 1253, 1265, 1267, 1269, 1271, 1273, 1275, 1276, 1278, 1280, 1282, 1284, 1286, 1288, 1290, 1292, 1296, 1300, 1302, 1304, 1306, 1308, 1310, 1312, 1314, 1316, 1318, 1320, 1333, 1335, 1337, 1339, 1341, 1343, 1345, 1346, 1348, 1350, 1354, 1356, 1359, 1361, 1363, 1365, 1369, 1371, 1373, 1376, 1378, 1380, 1382, 1384, 1386, 1388, 1390, 1392, 1394, 1396, 1398, 1400, 1403, 1405, 1407, 1409, 1416, 1418, 1420, 1428, 1432, 1437, 1441, 1443, 1445, 1447, 1449, 1451, 1453, 1454, 1455, 1456, 1459, 1461, 1463, 1465, 1470, 1472, 1474, 1476, 1487, 1489, 1491, 1493, 1495, 1496, 1498, 1500, 1507, 1509, 1517, 1526, 1530, 1537, 1538, 1539, 1542, 1544, 1546, 1548, 1550, 1552, 1560, 1562, 1569, 1571, 1573, 1575, 1577, 1579, 1581, 1583, 1585, 1586, 1588, 1590, 1592, 1595, 1608, 1610, 1622, 1624, 1626, 1627, 1628, 1629, 1633, 1634, 1636, 1638, 1640, 1645, 1647, 1649, 1656, 1658, 1660, 1662, 1664, 1666, 1668, 1670, 1672, 1674, 1676, 1678, 1680, 1683, 1685, 1687, 1689, 1691, 1693, 1695, 1697, 1706, 1708, 1710, 1712, 1714, 1716, 1718, 1724, 1726, 1728, 1731, 1733, 1735, 1737, 1747, 1749, 1753, 1755, 1757, 1759, 1761, 1763, 1765, 1779, 1781, 1783, 1785, 1787, 1789, 1791, 1793, 1795, 1797, 1799, 1801, 1803, 1841, 1849, 1851, 1853, 1855, 1857, 1868, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2068, 2071, 2073, 2075, 2077, 2079, 2082, 2086, 2088, 2090, 2092, 2094, 2096, 2098, 2100, 2102, 2104, 2106, 2108, 2110, 2112, 2122, 2124, 2126, 2128, 2130, 2132, 2134, 2145, 2147, 2149, 2151, 2153, 2155, 2157, 2159, 2161, 2163, 2165, 2167, 2169, 2171, 2173, 2175, 2177, 2179, 2181, 2265, 2267, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2349, 2351, 2353, 2355, 2357, 2359, 2361, 2363, 2365, 2367, 2369, 2371, or 2373. A plant produced from the plant cell has a difference in low light or SD+EODFR tolerance as compared to a control plant that does not comprise the exogenous nucleic acid.

Methods of modulating low light tolerance in a plant are provided herein. In one aspect, a method comprises introducing into a plant cell an exogenous nucleic acid, that comprises a regulatory region operably linked to a nucleotide sequence encoding a polypeptide. The HMM bit score of the amino acid sequence of the polypeptide is greater than about 20, using an HMM generated from the amino acid sequences depicted in one of FIGS. 1-24. A plant produced from the plant cell has a difference in low light tolerance as compared to a control plant that does not comprise the exogenous nucleic acid.

In another aspect, a method comprises introducing into a plant cell an exogenous nucleic acid that comprises a regulatory region operably linked to a nucleotide sequence encoding a polypeptide having 80 percent or greater sequence identity to an amino acid sequence set forth in SEQ ID NOs:3, 5, 7, 9, 10, 12, 14, 16, 18, 20, 22, 24, 25, 26, 28, 30, 32, 34, 36, 38, 40, 42, 44, 46, 48, 49, 51, 53, 55, 57, 59, 60, 61, 62, 63, 65, 67, 70, 72, 74, 76, 78, 80, 82, 84, 86, 88, 89, 90, 91, 93, 95, 96, 97, 98, 99, 100, 101, 102, 103, 105, 107, 109, 111, 113, 115, 116, 117, 118, 119, 120, 121, 122, 124, 126, 129, 130, 131, 132, 133, 135, 137, 139, 141, 143, 145, 147, 149, 151, 153, 155, 157, 159, 161, 163, 165, 167, 169, 171, 173, 175, 177, 179, 181, 183, 185, 187, 188, 189, 191, 193, 195, 197, 199, 201, 203, 205, 207, 209, 211, 213, 215, 217, 219, 221, 223, 225, 227, 229, 230, 231, 232, 233, 234, 235, 236, 237, 238, 239, 241, 243, 245, 247, 249, 251, 253, 255, 257, 259, 261, 262, 264, 266, 268, 270, 271, 273, 275, 277, 279, 281, 283, 285, 287, 289, 291, 292, 293, 294, 295, 296, 297, 298, 299, 300, 301, 302, 303, 304, 306, 308, 310, 312, 314, 317, 319, 321, 323, 325, 327, 329, 330, 331, 332, 334, 337, 339, 341, 343, 344, 346, 347, 348, 349, 350, 351, 352, 353, 354, 355, 357, 359, 361, 362, 364, 365, 366, 367, 368, 370, 372, 374, 376, 378, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 456, 457, 458, 459, 460, 462, 464, 466, 468, 470, 472, 474, 475, 477, 478, 479, 480, 481, 482, 483, 484, 485, 486, 487, 488, 489, 491, 493, 494, 495, 496, 497, 498, 499, 501, 503, 505, 507, 508, 509, 510, 511, 512, 514, 515, 516, 518, 520, 521, 522, 523, 524, 525, 526, 527, 528, 529, 530, 531, 532, 533, 534, 535, 536, 538, 539, 541, 542, 543, 544, 545, 546, 547, 548, 549, 550, 552, 554, 555, 556, 557, 558, 559, 560, 561, 562, 563, 564, 565, 567, 570, 572, 574, 576, 578, 579, 580, 582, 584, 586, 588, 590, 592, 594, 596, 598, 600, 601, 603, 606, 607, 608, 609, 611, 613, 615, 616, 617, 618, 620, 621, 622, 624, 625, 626, 628, 629, 631, 634, 636, 637, 638, 639, 641, 644, 645, 647, 649, 651, 653, 655, 657, 659, 661, 663, 665, 667, 669, 671, 673, 675, 676, 678, 680, 682, 684, 686, 688, 690, 692, 694, 695, 697, 699, 701, 702, 704, 706, 708, 709, 711, 712, 713, 714, 716, 718, 720, 721, 723, 725, 726, 728, 730, 732, 734, 736, 738, 740, 741, 742, 743, 744, 745, 747, 749, 750, 751, 753, 755, 757, 759, 761, 762, 763, 764, 765, 767, 769, 771, 773, 774, 776, 778, 779, 780, 782, 783, 784, 786, 788, 790, 792, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 826, 827, 829, 830, 831, 832, 833, 834, 835, 837, 838, 839, 840, 841, 843, 845, 847, 850, 851, 853, 855, 857, 859, 861, 862, 863, 864, 865, 866, 868, 870, 872, 874, 876, 877, 879, 881, 883, 885, 887, 889, 891, 893, 895, 897, 898, 900, 902, 904, 907, 909, 911, 913, 915, 917, 919, 920, 922, 923, 924, 926, 928, 929, 930, 931, 932, 934, 936, 937, 938, 939, 940, 941, 943, 945, 947, 948, 949, 950, 953, 955, 957, 959, 961, 963, 965, 966, 967, 969, 971, 973, 975, 977, 979, 981, 983, 985, 987, 989, 991, 993, 995, 997, 999, 1001, 1003, 1005, 1007, 1009, 1011, 1013, 1014, 1015, 1016, 1018, 1024, 1025, 1027, 1029, 1030, 1032, 1033, 1035, 1037, 1039, 1040, 1042, 1043, 1044, 1047, 1049, 1051, 1053, 1055, 1057, 1059, 1061, 1063, 1065, 1067, 1068, 1069, 1071, 1072, 1073, 1074, 1075, 1077, 1078, 1080, 1081, 1083, 1085, 1087, 1089, 1091, 1093, 1095, 1097, 1098, 1099, 1100, 1101, 1103, 1105, 1107, 1109, 1111, 1113, 1115, 1117, 1119, 1121, 1123, 1125, 1127, 1129, 1131, 1133, 1134, 1135, 1136, 1137, 1138, 1139, 1141, 1143, 1145, 1147, 1149, 1151, 1153, 1155, 1157, 1159, 1160, 1161, 1162, 1164, 1166, 1168, 1170, 1172, 1174, 1176, 1178, 1180, 1182, 1184, 1186, 1188, 1190, 1192, 1194, 1196, 1198, 1199, 1200, 1201, 1202, 1203, 1204, 1206, 1208, 1209, 1211, 1213, 1214, 1215, 1216, 1217, 1219, 1221, 1223, 1225, 1227, 1229, 1230, 1232, 1234, 1236, 1238, 1240, 1242, 1244, 1246, 1248, 1250, 1252, 1254, 1255, 1256, 1257, 1258, 1259, 1260, 1261, 1262, 1263, 1264, 1266, 1268, 1270, 1272, 1274, 1277, 1279, 1281, 1283, 1285, 1287, 1289, 1291, 1293, 1294, 1295, 1297, 1298, 1299, 1301, 1303, 1305, 1307, 1309, 1311, 1313, 1315, 1317, 1319, 1321, 1322, 1323, 1324, 1325, 1326, 1327, 1328, 1329, 1330, 1331, 1332, 1334, 1336, 1338, 1340, 1342, 1344, 1347, 1349, 1351, 1352, 1353, 1355, 1357, 1358, 1360, 1362, 1364, 1366, 1367, 1368, 1370, 1372, 1374, 1375, 1377, 1379, 1381, 1383, 1385, 1387, 1389, 1391, 1393, 1395, 1397, 1399, 1401, 1402, 1404, 1406, 1408, 1410, 1411, 1412, 1413, 1414, 1415, 1417, 1419, 1421, 1422, 1423, 1424, 1425, 1426, 1427, 1429, 1430, 1431, 1433, 1434, 1435, 1436, 1438, 1439, 1440, 1442, 1444, 1446, 1448, 1450, 1452, 1457, 1458, 1460, 1462, 1464, 1466, 1467, 1468, 1469, 1471, 1473, 1475, 1477, 1478, 1479, 1480, 1481, 1482, 1483, 1484, 1485, 1486, 1488, 1490, 1492, 1494, 1497, 1499, 1501, 1502, 1503, 1504, 1505, 1506, 1508, 1510, 1511, 1512, 1513, 1514, 1515, 1516, 1518, 1519, 1520, 1521, 1522, 1523, 1524, 1525, 1527, 1528, 1529, 1531, 1532, 1533, 1534, 1535, 1536, 1540, 1541, 1543, 1545, 1547, 1549, 1551, 1553, 1554, 1555, 1556, 1557, 1558, 1559, 1561, 1563, 1564, 1565, 1566, 1567, 1568, 1570, 1572, 1574, 1576, 1578, 1580, 1582, 1584, 1587, 1589, 1591, 1593, 1594, 1596, 1597, 1598, 1599, 1600, 1601, 1602, 1603, 1604, 1605, 1606, 1607, 1609, 1611, 1612, 1613, 1614, 1615, 1616, 1617, 1618, 1619, 1620, 1621, 1623, 1625, 1630, 1631, 1632, 1635, 1637, 1639, 1641, 1642, 1643, 1644, 1646, 1648, 1650, 1651, 1652, 1653, 1654, 1655, 1657, 1659, 1661, 1663, 1665, 1667, 1669, 1671, 1673, 1675, 1677, 1679, 1681, 1682, 1684, 1686, 1688, 1690, 1692, 1694, 1696, 1698, 1699, 1700, 1701, 1702, 1703, 1704, 1705, 1707, 1709, 1711, 1713, 1715, 1717, 1719, 1720, 1721, 1722, 1723, 1725, 1727, 1729, 1730, 1732, 1734, 1736, 1738, 1739, 1740, 1741, 1742, 1743, 1744, 1745, 1746, 1748, 1750, 1751, 1752, 1754, 1756, 1758, 1760, 1762, 1764, 1766, 1767, 1768, 1769, 1770, 1771, 1772, 1773, 1774, 1775, 1776, 1777, 1778, 1780, 1782, 1784, 1786, 1788, 1790, 1792, 1794, 1796, 1798, 1800, 1802, 1804, 1805, 1806, 1807, 1808, 1809, 1810, 1811, 1812, 1813, 1814, 1815, 1816, 1817, 1818, 1819, 1820, 1821, 1822, 1823, 1824, 1825, 1826, 1827, 1828, 1829, 1830, 1831, 1832, 1833, 1834, 1835, 1836, 1837, 1838, 1839, 1840, 1842, 1843, 1844, 1845, 1846, 1847, 1848, 1850, 1852, 1854, 1856, 1858, 1859, 1860, 1861, 1862, 1863, 1864, 1865, 1866, 1867, 1869, 1870, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2009, 2011, 2013, 2015, 2017, 2019, 2021, 2023, 2025, 2027, 2029, 2030, 2031, 2032, 2033, 2034, 2035, 2036, 2037, 2038, 2039, 2040, 2041, 2042, 2043, 2044, 2045, 2046, 2047, 2048, 2049, 2050, 2051, 2052, 2053, 2054, 2055, 2056, 2057, 2058, 2059, 2060, 2061, 2062, 2063, 2064, 2065, 2066, 2067, 2069, 2070, 2072, 2074, 2076, 2078, 2080, 2081, 2083, 2084, 2085, 2087, 2089, 2091, 2093, 2095, 2097, 2099, 2101, 2103, 2105, 2107, 2109, 2111, 2113, 2114, 2115, 2116, 2117, 2118, 2119, 2120, 2121, 2123, 2125, 2127, 2129, 2131, 2133, 2135, 2136, 2137, 2138, 2139, 2140, 2141, 2142, 2143, 2144, 2146, 2148, 2150, 2152, 2154, 2156, 2158, 2160, 2162, 2164, 2166, 2168, 2170, 2172, 2174, 2176, 2178, 2180, 2182, 2183, 2184, 2185, 2186, 2187, 2188, 2189, 2190, 2191, 2192, 2193, 2194, 2195, 2196, 2197, 2198, 2199, 2200, 2201, 2202, 2203, 2204, 2205, 2206, 2207, 2208, 2209, 2210, 2211, 2212, 2213, 2214, 2215, 2216, 2217, 2218, 2219, 2220, 2221, 2222, 2223, 2224, 2225, 2226, 2227, 2228, 2229, 2230, 2231, 2232, 2233, 2234, 2235, 2236, 2237, 2238, 2239, 2240, 2241, 2242, 2243, 2244, 2245, 2246, 2247, 2248, 2249, 2250, 2251, 2252, 2253, 2254, 2255, 2256, 2257, 2258, 2259, 2260, 2261, 2262, 2263, 2264, 2266, 2268, 2269, 2270, 2271, 2272, 2273, 2274, 2275, 2276, 2277, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2323, 2324, 2325, 2326, 2327, 2328, 2329, 2330, 2331, 2332, 2333, 2334, 2335, 2336, 2337, 2338, 2339, 2340, 2341, 2342, 2343, 2344, 2345, 2346, 2347, 2348, 2350, 2352, 2354, 2356, 2358, 2360, 2362, 2364, 2366, 2368, 2370, 2372, 2374, 2375, 2376, 2377, 2378, 2379, 2380, or 2381. A plant produced from the plant cell has a difference in low light tolerance as compared to a control plant that does not comprise the exogenous nucleic acid.

In another aspect, a method comprises introducing into a plant cell an exogenous nucleic acid, that comprises a regulatory region operably linked to a nucleotide sequence having 80 percent or greater sequence identity to a nucleotide sequence set forth in SEQ ID NOs:1, 2, 4, 6, 8, 11, 13, 15, 17, 19, 21, 23, 27, 29, 31, 33, 35, 37, 39, 41, 43, 45, 47, 50, 52, 54, 56, 58, 64, 66, 68, 69, 71, 73, 75, 77, 79, 81, 83, 85, 87, 92, 94, 104, 106, 108, 110, 112, 114, 123, 125, 127, 128, 134, 136, 138, 140, 142, 144, 146, 148, 150, 152, 154, 156, 158, 160, 162, 164, 166, 168, 170, 172, 174, 176, 178, 180, 182, 184, 186, 190, 192, 194, 196, 198, 200, 202, 204, 206, 208, 210, 212, 214, 216, 218, 220, 222, 224, 226, 228, 240, 242, 244, 246, 248, 250, 252, 254, 256, 258, 260, 263, 265, 267, 269, 272, 274, 276, 278, 280, 282, 284, 286, 288, 290, 305, 307, 309, 311, 313, 315, 316, 318, 320, 322, 324, 326, 328, 333, 335, 336, 338, 340, 342, 345, 356, 358, 360, 363, 369, 371, 373, 375, 377, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 455, 461, 463, 465, 467, 469, 471, 473, 476, 490, 492, 500, 502, 504, 506, 513, 517, 519, 537, 540, 551, 553, 566, 568, 569, 571, 573, 575, 577, 581, 583, 585, 587, 589, 591, 593, 595, 597, 599, 602, 604, 605, 610, 612, 614, 619, 623, 627, 630, 632, 633, 635, 640, 642, 643, 646, 648, 650, 652, 654, 656, 658, 660, 662, 664, 666, 668, 670, 672, 674, 677, 679, 681, 683, 685, 687, 689, 691, 693, 696, 698, 700, 703, 705, 707, 710, 715, 717, 719, 722, 724, 727, 729, 731, 733, 735, 737, 739, 746, 748, 752, 754, 756, 758, 760, 766, 768, 770, 772, 775, 777, 781, 785, 787, 789, 791, 793, 825, 828, 836, 842, 844, 846, 848, 849, 852, 854, 856, 858, 860, 867, 869, 871, 873, 875, 878, 880, 882, 884, 886, 888, 890, 892, 894, 896, 899, 901, 903, 905, 906, 908, 910, 912, 914, 916, 918, 921, 925, 927, 933, 935, 942, 944, 946, 951, 952, 954, 956, 958, 960, 962, 964, 968, 970, 972, 974, 976, 978, 980, 982, 984, 986, 988, 990, 992, 994, 996, 998, 1000, 1002, 1004, 1006, 1008, 1010, 1012, 1017, 1019, 1020, 1021, 1022, 1023, 1026, 1028, 1031, 1034, 1036, 1038, 1041, 1045, 1046, 1048, 1050, 1052, 1054, 1056, 1058, 1060, 1062, 1064, 1066, 1070, 1076, 1079, 1082, 1084, 1086, 1088, 1090, 1092, 1094, 1096, 1102, 1104, 1106, 1108, 1110, 1112, 1114, 1116, 1118, 1120, 1122, 1124, 1126, 1128, 1130, 1132, 1140, 1142, 1144, 1146, 1148, 1150, 1152, 1154, 1156, 1158, 1163, 1165, 1167, 1169, 1171, 1173, 1175, 1177, 1179, 1181, 1183, 1185, 1187, 1189, 1191, 1193, 1195, 1197, 1205, 1207, 1210, 1212, 1218, 1220, 1222, 1224, 1226, 1228, 1231, 1233, 1235, 1237, 1239, 1241, 1243, 1245, 1247, 1249, 1251, 1253, 1265, 1267, 1269, 1271, 1273, 1275, 1276, 1278, 1280, 1282, 1284, 1286, 1288, 1290, 1292, 1296, 1300, 1302, 1304, 1306, 1308, 1310, 1312, 1314, 1316, 1318, 1320, 1333, 1335, 1337, 1339, 1341, 1343, 1345, 1346, 1348, 1350, 1354, 1356, 1359, 1361, 1363, 1365, 1369, 1371, 1373, 1376, 1378, 1380, 1382, 1384, 1386, 1388, 1390, 1392, 1394, 1396, 1398, 1400, 1403, 1405, 1407, 1409, 1416, 1418, 1420, 1428, 1432, 1437, 1441, 1443, 1445, 1447, 1449, 1451, 1453, 1454, 1455, 1456, 1459, 1461, 1463, 1465, 1470, 1472, 1474, 1476, 1487, 1489, 1491, 1493, 1495, 1496, 1498, 1500, 1507, 1509, 1517, 1526, 1530, 1537, 1538, 1539, 1542, 1544, 1546, 1548, 1550, 1552, 1560, 1562, 1569, 1571, 1573, 1575, 1577, 1579, 1581, 1583, 1585, 1586, 1588, 1590, 1592, 1595, 1608, 1610, 1622, 1624, 1626, 1627, 1628, 1629, 1633, 1634, 1636, 1638, 1640, 1645, 1647, 1649, 1656, 1658, 1660, 1662, 1664, 1666, 1668, 1670, 1672, 1674, 1676, 1678, 1680, 1683, 1685, 1687, 1689, 1691, 1693, 1695, 1697, 1706, 1708, 1710, 1712, 1714, 1716, 1718, 1724, 1726, 1728, 1731, 1733, 1735, 1737, 1747, 1749, 1753, 1755, 1757, 1759, 1761, 1763, 1765, 1779, 1781, 1783, 1785, 1787, 1789, 1791, 1793, 1795, 1797, 1799, 1801, 1803, 1841, 1849, 1851, 1853, 1855, 1857, 1868, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2068, 2071, 2073, 2075, 2077, 2079, 2082, 2086, 2088, 2090, 2092, 2094, 2096, 2098, 2100, 2102, 2104, 2106, 2108, 2110, 2112, 2122, 2124, 2126, 2128, 2130, 2132, 2134, 2145, 2147, 2149, 2151, 2153, 2155, 2157, 2159, 2161, 2163, 2165, 2167, 2169, 2171, 2173, 2175, 2177, 2179, 2181, 2265, 2267, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2349, 2351, 2353, 2355, 2357, 2359, 2361, 2363, 2365, 2367, 2369, 2371, or 2373, or a fragment thereof. A plant produced from the plant cell has a difference in low light tolerance as compared to a control plant that does not comprise the exogenous nucleic acid.

Methods of modulating SD+EODFR tolerance in a plant are provided herein. In one aspect, a method comprises introducing into a plant cell an exogenous nucleic acid, that comprises a regulatory region operably linked to a nucleotide sequence encoding a polypeptide. The HMM bit score of the amino acid sequence of the polypeptide is greater than about 20, using an HMM generated from the amino acid sequences depicted in one of FIG. 16 or 24-27. A plant produced from the plant cell has a difference in SD+EODFR tolerance as compared to a control plant that does not comprise the exogenous nucleic acid.

In another aspect, a method comprises introducing into a plant cell an exogenous nucleic acid that comprises a regulatory region operably linked to a nucleotide sequence encoding a polypeptide having 80 percent or greater sequence identity to an amino acid sequence set forth in SEQ ID NOs:538, 539, 541, 542, 543, 544, 545, 546, 547, 548, 549, 550, 552, 554, 555, 556, 557, 558, 559, 560, 561, 562, 563, 564, 565, 567, 570, 572, 574, 576, 578, 579, 580, 582, 584, 586, 588, 590, 592, 594, 596, 598, 600, 601, 603, 606, 607, 608, 609, 611, 613, 615, 616, 617, 618, 620, 621, 622, 624, 625, 626, 628, 629, 631, 1347, 1349, 1351, 1352, 1353, 1355, 1357, 1358, 1360, 1362, 1364, 1366, 1367, 1368, 1370, 1372, 1374, 1375, 1377, 1379, 1381, 1383, 1385, 1387, 1389, 1391, 1393, 1395, 1397, 1399, 1401, 1402, 1404, 1406, 1408, 1410, 1411, 1412, 1413, 1414, 1415, 1417, 1419, 1421, 1422, 1423, 1424, 1425, 1426, 1427, 1429, 1430, 1431, 1433, 1434, 1435, 1436, 1438, 1439, 1440, 1442, 1444, 1446, 1448, 1450, 1452, 1540, 1541, 1543, 1545, 1547, 1549, 1551, 1553, 1554, 1555, 1556, 1557, 1558, 1559, 1561, 1563, 1564, 1565, 1566, 1567, 1568, 1570, 1572, 1574, 1576, 1578, 1580, 1582, 1584, 1679, 1681, 1682, 1748, 1750, 1751, 1752, 1850, 1852, 1854, 1856, 1858, 1859, 1860, 1861, 1862, 1863, 1864, 1865, 1866, 1867, 1869, 1870, 1871, 1873, 1875, 1877, 1879, 1881, 1883, 1885, 1887, 1889, 1891, 1893, 1895, 1897, 1899, 1901, 1903, 1905, 1907, 2268, 2269, 2270, 2271, 2272, 2273, 2274, 2275, 2276, 2277, or 2278. A plant produced from the plant cell has a difference in SD+EODFR tolerance as compared to a control plant that does not comprise the exogenous nucleic acid.

In another aspect, a method comprises introducing into a plant cell an exogenous nucleic acid, that comprises a regulatory region operably linked to a nucleotide sequence having 80 percent or greater sequence identity to a nucleotide sequence set forth in SEQ ID NOs:537, 540, 551, 553, 566, 568, 569, 571, 573, 575, 577, 581, 583, 585, 587, 589, 591, 593, 595, 597, 599, 602, 604, 605, 610, 612, 614, 619, 623, 627, 630, 1345, 1346, 1348, 1350, 1354, 1356, 1359, 1361, 1363, 1365, 1369, 1371, 1373, 1376, 1378, 1380, 1382, 1384, 1386, 1388, 1390, 1392, 1394, 1396, 1398, 1400, 1403, 1405, 1407, 1409, 1416, 1418, 1420, 1428, 1432, 1437, 1441, 1443, 1445, 1447, 1449, 1451, 1537, 1538, 1539, 1542, 1544, 1546, 1548, 1550, 1552, 1560, 1562, 1569, 1571, 1573, 1575, 1577, 1579, 1581, 1583, 1678, 1680, 1747, 1749, 1849, 1851, 1853, 1855, 1857, 1868, 1872, 1874, 1876, 1878, 1880, 1882, 1884, 1886, 1888, 1890, 1892, 1894, 1896, 1898, 1900, 1902, 1904, 1906, and 2267, or a fragment thereof. A plant produced from the plant cell has a difference in SD+EODFR tolerance as compared to a control plant that does not comprise the exogenous nucleic acid.

Plant cells comprising an exogenous nucleic acid are provided herein. In one aspect, the exogenous nucleic acid comprises a regulatory region operably linked to a nucleotide sequence encoding a polypeptide. The HMM bit score of the amino acid sequence of the polypeptide is greater than about 20, using an HMM based on the amino acid sequences depicted in one of FIGS. 1-24. A plant produced from the cells has a difference in low light or SD+EODFR tolerance as compared to a control plant that does not comprise the exogenous nucleic acid. In another aspect, the exogenous nucleic acid comprises a regulatory region operably linked to a nucleotide sequence encoding a polypeptide having 80 percent or greater sequence identity to an amino acid sequence selected from the group consisting of SEQ ID NOs:3, 5, 7, 9, 10, 12, 14, 16, 18, 20, 22, 24, 25, 26, 28, 30, 32, 34, 36, 38, 40, 42, 44, 46, 48, 49, 51, 53, 55, 57, 59, 60, 61, 62, 63, 65, 67, 70, 72, 74, 76, 78, 80, 82, 84, 86, 88, 89, 90, 91, 93, 95, 96, 97, 98, 99, 100, 101, 102, 103, 105, 107, 109, 111, 113, 115, 116, 117, 118, 119, 120, 121, 122, 124, 126, 129, 130, 131, 132, 133, 135, 137, 139, 141, 143, 145, 147, 149, 151, 153, 155, 157, 159, 161, 163, 165, 167, 169, 171, 173, 175, 177, 179, 181, 183, 185, 187, 188, 189, 191, 193, 195, 197, 199, 201, 203, 205, 207, 209, 211, 213, 215, 217, 219, 221, 223, 225, 227, 229, 230, 231, 232, 233, 234, 235, 236, 237, 238, 239, 241, 243, 245, 247, 249, 251, 253, 255, 257, 259, 261, 262, 264, 266, 268, 270, 271, 273, 275, 277, 279, 281, 283, 285, 287, 289, 291, 292, 293, 294, 295, 296, 297, 298, 299, 300, 301, 302, 303, 304, 306, 308, 310, 312, 314, 317, 319, 321, 323, 325, 327, 329, 330, 331, 332, 334, 337, 339, 341, 343, 344, 346, 347, 348, 349, 350, 351, 352, 353, 354, 355, 357, 359, 361, 362, 364, 365, 366, 367, 368, 370, 372, 374, 376, 378, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 456, 457, 458, 459, 460, 462, 464, 466, 468, 470, 472, 474, 475, 477, 478, 479, 480, 481, 482, 483, 484, 485, 486, 487, 488, 489, 491, 493, 494, 495, 496, 497, 498, 499, 501, 503, 505, 507, 508, 509, 510, 511, 512, 514, 515, 516, 518, 520, 521, 522, 523, 524, 525, 526, 527, 528, 529, 530, 531, 532, 533, 534, 535, 536, 538, 539, 541, 542, 543, 544, 545, 546, 547, 548, 549, 550, 552, 554, 555, 556, 557, 558, 559, 560, 561, 562, 563, 564, 565, 567, 570, 572, 574, 576, 578, 579, 580, 582, 584, 586, 588, 590, 592, 594, 596, 598, 600, 601, 603, 606, 607, 608, 609, 611, 613, 615, 616, 617, 618, 620, 621, 622, 624, 625, 626, 628, 629, 631, 634, 636, 637, 638, 639, 641, 644, 645, 647, 649, 651, 653, 655, 657, 659, 661, 663, 665, 667, 669, 671, 673, 675, 676, 678, 680, 682, 684, 686, 688, 690, 692, 694, 695, 697, 699, 701, 702, 704, 706, 708, 709, 711, 712, 713, 714, 716, 718, 720, 721, 723, 725, 726, 728, 730, 732, 734, 736, 738, 740, 741, 742, 743, 744, 745, 747, 749, 750, 751, 753, 755, 757, 759, 761, 762, 763, 764, 765, 767, 769, 771, 773, 774, 776, 778, 779, 780, 782, 783, 784, 786, 788, 790, 792, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 826, 827, 829, 830, 831, 832, 833, 834, 835, 837, 838, 839, 840, 841, 843, 845, 847, 850, 851, 853, 855, 857, 859, 861, 862, 863, 864, 865, 866, 868, 870, 872, 874, 876, 877, 879, 881, 883, 885, 887, 889, 891, 893, 895, 897, 898, 900, 902, 904, 907, 909, 911, 913, 915, 917, 919, 920, 922, 923, 924, 926, 928, 929, 930, 931, 932, 934, 936, 937, 938, 939, 940, 941, 943, 945, 947, 948, 949, 950, 953, 955, 957, 959, 961, 963, 965, 966, 967, 969, 971, 973, 975, 977, 979, 981, 983, 985, 987, 989, 991, 993, 995, 997, 999, 1001, 1003, 1005, 1007, 1009, 1011, 1013, 1014, 1015, 1016, 1018, 1024, 1025, 1027, 1029, 1030, 1032, 1033, 1035, 1037, 1039, 1040, 1042, 1043, 1044, 1047, 1049, 1051, 1053, 1055, 1057, 1059, 1061, 1063, 1065, 1067, 1068, 1069, 1071, 1072, 1073, 1074, 1075, 1077, 1078, 1080, 1081, 1083, 1085, 1087, 1089, 1091, 1093, 1095, 1097, 1098, 1099, 1100, 1101, 1103, 1105, 1107, 1109, 1111, 1113, 1115, 1117, 1119, 1121, 1123, 1125, 1127, 1129, 1131, 1133, 1134, 1135, 1136, 1137, 1138, 1139, 1141, 1143, 1145, 1147, 1149, 1151, 1153, 1155, 1157, 1159, 1160, 1161, 1162, 1164, 1166, 1168, 1170, 1172, 1174, 1176, 1178, 1180, 1182, 1184, 1186, 1188, 1190, 1192, 1194, 1196, 1198, 1199, 1200, 1201, 1202, 1203, 1204, 1206, 1208, 1209, 1211, 1213, 1214, 1215, 1216, 1217, 1219, 1221, 1223, 1225, 1227, 1229, 1230, 1232, 1234, 1236, 1238, 1240, 1242, 1244, 1246, 1248, 1250, 1252, 1254, 1255, 1256, 1257, 1258, 1259, 1260, 1261, 1262, 1263, 1264, 1266, 1268, 1270, 1272, 1274, 1277, 1279, 1281, 1283, 1285, 1287, 1289, 1291, 1293, 1294, 1295, 1297, 1298, 1299, 1301, 1303, 1305, 1307, 1309, 1311, 1313, 1315, 1317, 1319, 1321, 1322, 1323, 1324, 1325, 1326, 1327, 1328, 1329, 1330, 1331, 1332, 1334, 1336, 1338, 1340, 1342, 1344, 1347, 1349, 1351, 1352, 1353, 1355, 1357, 1358, 1360, 1362, 1364, 1366, 1367, 1368, 1370, 1372, 1374, 1375, 1377, 1379, 1381, 1383, 1385, 1387, 1389, 1391, 1393, 1395, 1397, 1399, 1401, 1402, 1404, 1406, 1408, 1410, 1411, 1412, 1413, 1414, 1415, 1417, 1419, 1421, 1422, 1423, 1424, 1425, 1426, 1427, 1429, 1430, 1431, 1433, 1434, 1435, 1436, 1438, 1439, 1440, 1442, 1444, 1446, 1448, 1450, 1452, 1457, 1458, 1460, 1462, 1464, 1466, 1467, 1468, 1469, 1471, 1473, 1475, 1477, 1478, 1479, 1480, 1481, 1482, 1483, 1484, 1485, 1486, 1488, 1490, 1492, 1494, 1497, 1499, 1501, 1502, 1503, 1504, 1505, 1506, 1508, 1510, 1511, 1512, 1513, 1514, 1515, 1516, 1518, 1519, 1520, 1521, 1522, 1523, 1524, 1525, 1527, 1528, 1529, 1531, 1532, 1533, 1534, 1535, 1536, 1540, 1541, 1543, 1545, 1547, 1549, 1551, 1553, 1554, 1555, 1556, 1557, 1558, 1559, 1561, 1563, 1564, 1565, 1566, 1567, 1568, 1570, 1572, 1574, 1576, 1578, 1580, 1582, 1584, 1587, 1589, 1591, 1593, 1594, 1596, 1597, 1598, 1599, 1600, 1601, 1602, 1603, 1604, 1605, 1606, 1607, 1609, 1611, 1612, 1613, 1614, 1615, 1616, 1617, 1618, 1619, 1620, 1621, 1623, 1625, 1630, 1631, 1632, 1635, 1637, 1639, 1641, 1642, 1643, 1644, 1646, 1648, 1650, 1651, 1652, 1653, 1654, 1655, 1657, 1659, 1661, 1663, 1665, 1667, 1669, 1671, 1673, 1675, 1677, 1679, 1681, 1682, 1684, 1686, 1688, 1690, 1692, 1694, 1696, 1698, 1699, 1700, 1701, 1702, 1703, 1704, 1705, 1707, 1709, 1711, 1713, 1715, 1717, 1719, 1720, 1721, 1722, 1723, 1725, 1727, 1729, 1730, 1732, 1734, 1736, 1738, 1739, 1740, 1741, 1742, 1743, 1744, 1745, 1746, 1748, 1750, 1751, 1752, 1754, 1756, 1758, 1760, 1762, 1764, 1766, 1767, 1768, 1769, 1770, 1771, 1772, 1773, 1774, 1775, 1776, 1777, 1778, 1780, 1782, 1784, 1786, 1788, 1790, 1792, 1794, 1796, 1798, 1800, 1802, 1804, 1805, 1806, 1807, 1808, 1809, 1810, 1811, 1812, 1813, 1814, 1815, 1816, 1817, 1818, 1819, 1820, 1821, 1822, 1823, 1824, 1825, 1826, 1827, 1828, 1829, 1830, 1831, 1832, 1833, 1834, 1835, 1836, 1837, 1838, 1839, 1840, 1842, 1843, 1844, 1845, 1846, 1847, 1848, 1850, 1852, 1854, 1856, 1858, 1859, 1860, 1861, 1862, 1863, 1864, 1865, 1866, 1867, 1869, 1870, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2009, 2011, 2013, 2015, 2017, 2019, 2021, 2023, 2025, 2027, 2029, 2030, 2031, 2032, 2033, 2034, 2035, 2036, 2037, 2038, 2039, 2040, 2041, 2042, 2043, 2044, 2045, 2046, 2047, 2048, 2049, 2050, 2051, 2052, 2053, 2054, 2055, 2056, 2057, 2058, 2059, 2060, 2061, 2062, 2063, 2064, 2065, 2066, 2067, 2069, 2070, 2072, 2074, 2076, 2078, 2080, 2081, 2083, 2084, 2085, 2087, 2089, 2091, 2093, 2095, 2097, 2099, 2101, 2103, 2105, 2107, 2109, 2111, 2113, 2114, 2115, 2116, 2117, 2118, 2119, 2120, 2121, 2123, 2125, 2127, 2129, 2131, 2133, 2135, 2136, 2137, 2138, 2139, 2140, 2141, 2142, 2143, 2144, 2146, 2148, 2150, 2152, 2154, 2156, 2158, 2160, 2162, 2164, 2166, 2168, 2170, 2172, 2174, 2176, 2178, 2180, 2182, 2183, 2184, 2185, 2186, 2187, 2188, 2189, 2190, 2191, 2192, 2193, 2194, 2195, 2196, 2197, 2198, 2199, 2200, 2201, 2202, 2203, 2204, 2205, 2206, 2207, 2208, 2209, 2210, 2211, 2212, 2213, 2214, 2215, 2216, 2217, 2218, 2219, 2220, 2221, 2222, 2223, 2224, 2225, 2226, 2227, 2228, 2229, 2230, 2231, 2232, 2233, 2234, 2235, 2236, 2237, 2238, 2239, 2240, 2241, 2242, 2243, 2244, 2245, 2246, 2247, 2248, 2249, 2250, 2251, 2252, 2253, 2254, 2255, 2256, 2257, 2258, 2259, 2260, 2261, 2262, 2263, 2264, 2266, 2268, 2269, 2270, 2271, 2272, 2273, 2274, 2275, 2276, 2277, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2323, 2324, 2325, 2326, 2327, 2328, 2329, 2330, 2331, 2332, 2333, 2334, 2335, 2336, 2337, 2338, 2339, 2340, 2341, 2342, 2343, 2344, 2345, 2346, 2347, 2348, 2350, 2352, 2354, 2356, 2358, 2360, 2362, 2364, 2366, 2368, 2370, 2372, 2374, 2375, 2376, 2377, 2378, 2379, 2380, and 2381.

Also provided herein is a method of identifying whether a polymorphism is associated with variation in low light or SD+EODFR tolerance. The method includes the steps of: determining whether one or more genetic polymorphisms in a population of plants is associated with the locus for a polypeptide selected from the group consisting of the polypeptides depicted in FIGS. 1-24 and functional homologs thereof; and measuring the correlation between variation in the low light or SD+EODFR tolerance in plants of the population and the presence of the genetic polymorphisms in plants of the population, thereby identifying whether or not one or more genetic polymorphisms are associated with variation in low light or SD+EODFR tolerance. The population of plants can be a population of switchgrass, sorghum, sugar cane, or miscanthus plants.

A method of making a plant line is also provided herein. The method includes the steps of: determining whether one or more genetic polymorphisms in a population of plants is associated with the locus for a polypeptide selected from the group consisting of the polypeptides depicted in FIGS. 1-24 and functional homologs thereof; identifying one or more plants in the population in which the presence of at least one allele at the one or more genetic polymorphisms is associated with variation in low light or SD+EODFR tolerance; crossing each of the identified plants with itself or a different plant to produce seed; crossing at least one progeny plant grown from the seed with itself or a different plant; and repeating the crossing steps for an additional 0-5 generations to make the plant line, wherein the allele is present in the plant line. The population of plants can be a population of switchgrass plants.

In another aspect, this document provides a method of producing a plant. The method comprises growing a plant cell comprising an exogenous nucleic acid, wherein the exogenous nucleic acid is effective for down-regulating an endogenous nucleic acid in the plant cell. The endogenous nucleic acid can encode a polypeptide. The HMM bit score of the amino acid sequence of the polypeptide can be greater than about 210. The HMM can be based on the amino acid sequences depicted in one of FIGS. 6, 11, and 21. The plant produced from the cell can have an increase in hypocotyl length as compared to a control plant that does not comprise the exogenous nucleic acid.

In another aspect, a transgenic plant cell is provided. The plant cell comprises an exogenous nucleic acid. The exogenous nucleic acid is effective for down-regulating an endogenous nucleic acid in the plant cell. The endogenous nucleic acid can encode a polypeptide. The HMM bit score of the amino acid sequence of the polypeptide is greater than about 210. The HMM is based on the amino acid sequences depicted in one of FIGS. 6, 11, and 21.

A transgenic plant is also provided. The transgenic plant comprises a plant cell comprising an exogenous nucleic acid. The exogenous nucleic acid is effective for down-regulating an endogenous nucleic acid in the plant cell. The endogenous nucleic acid can encode a polypeptide. The HMM bit score of the amino acid sequence of the polypeptide is greater than about 210. The HMM is based on the amino acid sequences depicted in one of FIGS. 6, 11, and 21. The plant has an increase in hypocotyl length as compared to a control plant that does not comprise the plant cell.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DESCRIPTION OF THE DRAWINGS

Figure 1:
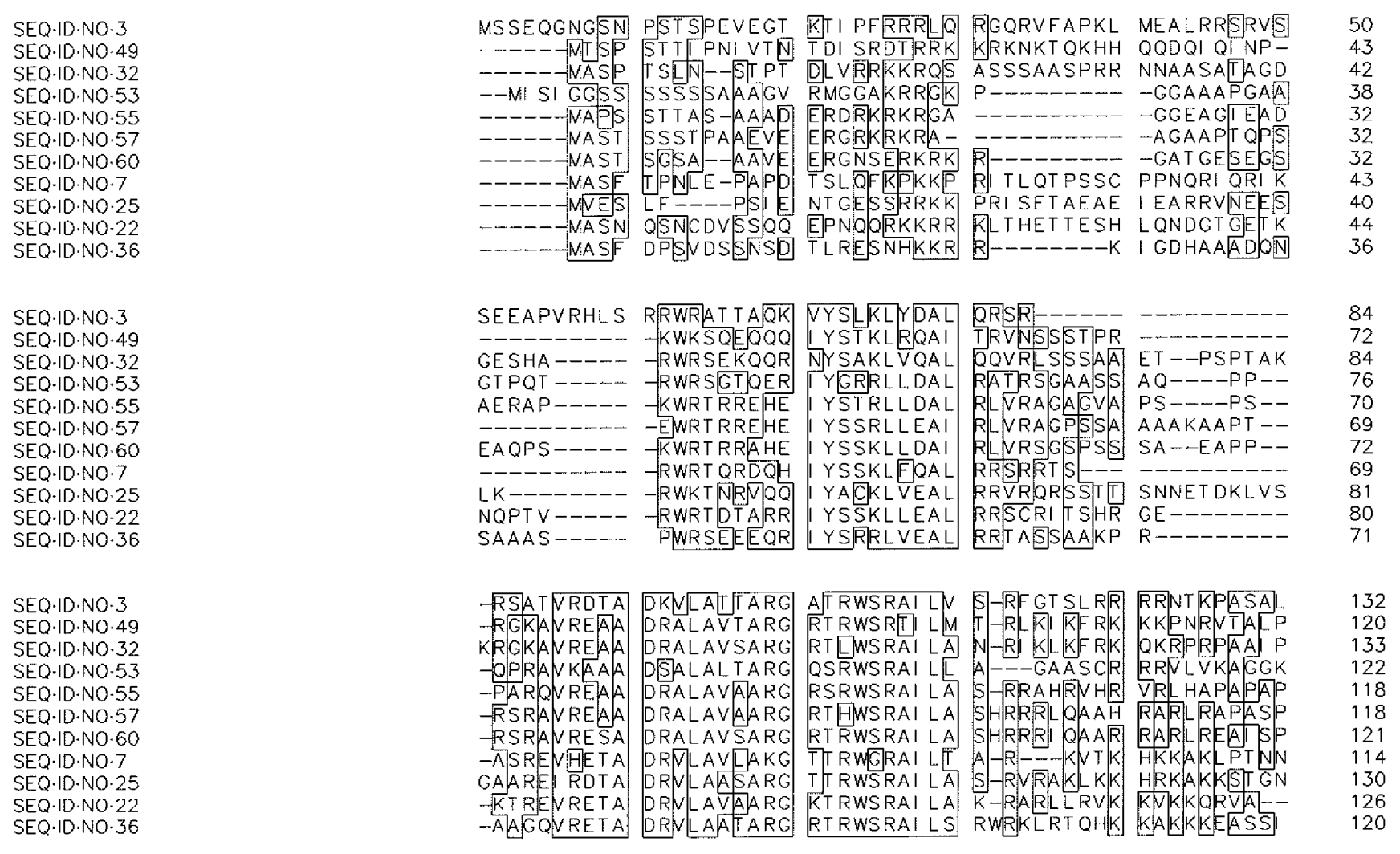
Figure 1:
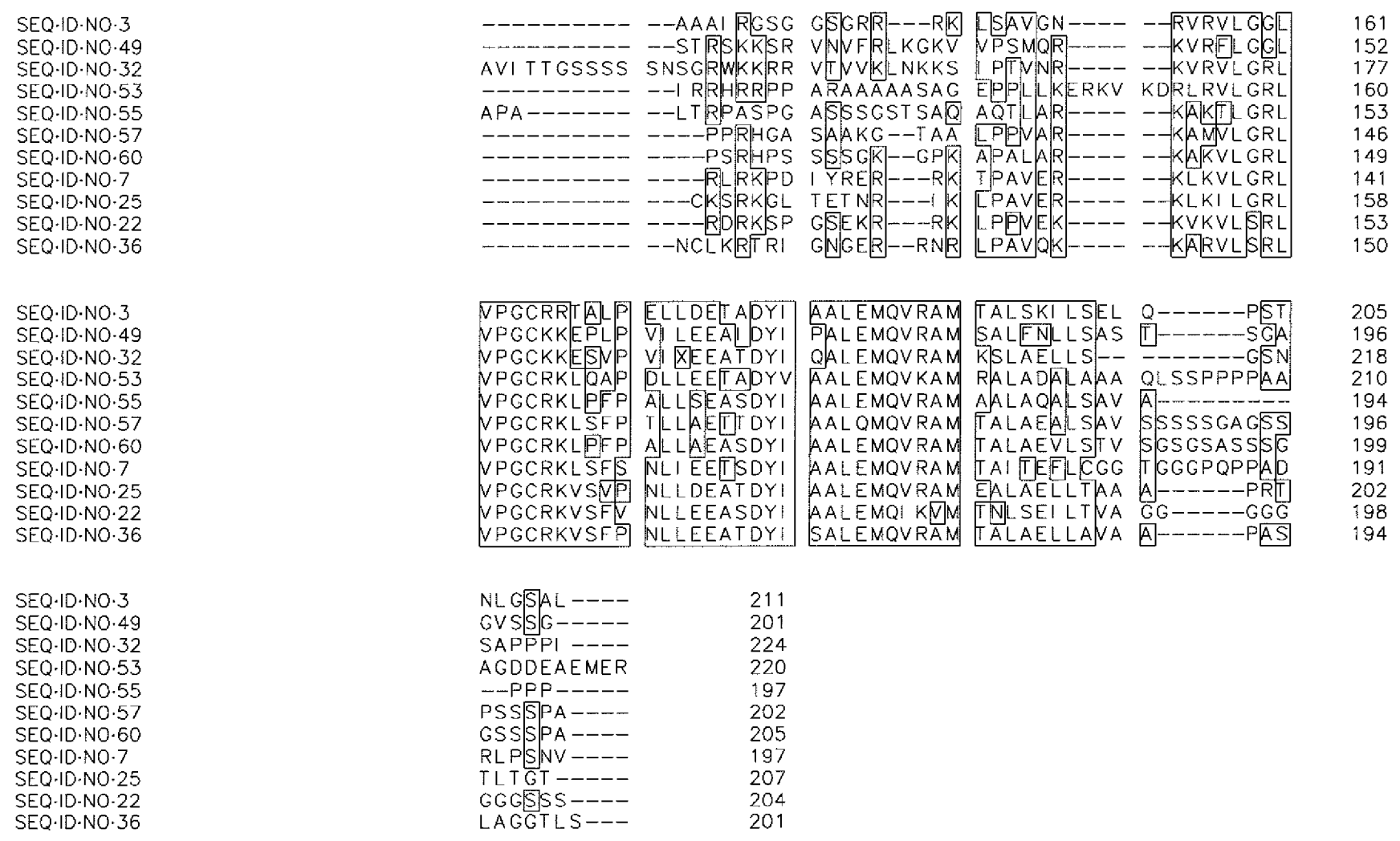

FIG. 1 is an alignment of At4g37295 (Ceres Seedline ME05268; SEQ ID NO:3) with homologous and/or orthologous amino acid sequences including Ceres CLONE ID no. 1844057 (SEQ ID NO:7), Ceres ANNOT ID no. 1469148 (SEQ ID NO:22), Public GI ID no. 18390998 (SEQ ID NO:25), Ceres CLONE ID no. 1065656 (SEQ ID NO:32), Ceres CLONE ID no. 1652677 (SEQ ID NO:36), Public GI ID no. 92874556 (SEQ ID NO:49), Ceres CLONE ID no. 1329161 (SEQ ID NO:53), Ceres CLONE ID no. 1030378 (SEQ ID NO:55), Ceres CLONE ID no. 1413787 (SEQ ID NO:57), and Public GI ID no. 125543598 (SEQ ID NO:60). In all the alignment figures shown herein, a dash in an aligned sequence represents a gap, i.e., a lack of an amino acid at that position. Identical amino acids or conserved amino acid substitutions among aligned sequences are identified by boxes. FIG. 1 and the other alignment figures provided herein were generated using the program MUSCLE version 3.52.

FIG. 2 is an alignment of At2g32710 (Ceres Seedline ME06120; SEQ ID NO:70) with homologous and/or orthologous amino acid sequences including Ceres CLONE ID no. 1975934 (SEQ ID NO:72), Ceres ANNOT ID no. 1529913 (SEQ ID NO:80), Ceres CLONE ID no. 977794 (SEQ ID NO:93), Public GI ID no. 42362378 (SEQ ID NO:96), Public GI ID no. 23899378 (SEQ ID NO:99), Public GI ID no. 15963346 (SEQ ID NO:101), Public GI ID no. 15963344+B816 (SEQ ID NO:102), Public GI ID no. 92429657 (SEQ ID NO:103), Ceres CLONE ID no. 746644 (SEQ ID NO:105), Ceres CLONE ID no. 623089 (SEQ ID NO:109), Ceres CLONE ID no. 1913678 (SEQ ID NO:115), and Public GI ID no. 115450609 (SEQ ID NO:119).

FIG. 3 is an alignment of At2g46990 (Ceres Seedline ME09503; SEQ ID NO:129) with homologous and/or orthologous amino acid sequences including Public GI ID no. 34550779 (SEQ ID NO:133), Ceres CLONE ID no. 1932235 (SEQ ID NO:137), Ceres CLONE ID no. 981738 (SEQ ID NO:201), Ceres CLONE ID no. 565974 (SEQ ID NO:209), Public GI ID no. 1352058 (SEQ ID NO:231), Public GI ID no. 11131101 (SEQ ID NO:234), Public GI ID no. 4887018 (SEQ ID NO:236), Public GI ID no. 4887018 (SEQ ID NO:236), Ceres CLONE ID no. 644455 (SEQ ID NO:247), Ceres CLONE ID no. 1731500 (SEQ ID NO:270), Public GI ID no. 20269063 (SEQ ID NO:300), Public GI ID no. 50404477 (SEQ ID NO:302), and Public GI ID no. 62125392 (SEQ ID NO:303).

FIG. 4 is an alignment of At4g03250 (Ceres Seedline ME10007; SEQ ID NO:317) with homologous and/or orthologous amino acid sequences including Ceres CLONE ID no. 1842125 (SEQ ID NO:319), Ceres ANNOT ID no. 1461360 (SEQ ID NO:321), Ceres CLONE ID no. 480906 (SEQ ID NO:327), Public GI ID no. 92889352 (SEQ ID NO:330), and Public GI ID no. 56201850 (SEQ ID NO:331).

FIG. 5 is an alignment of At2g04240 (Ceres Seedline ME10852; SEQ ID NO:337), Ceres CLONE ID no. 952050 (SEQ ID NO:339) with homologous and/or orthologous amino acid sequences including Public GI ID no. 115477050 (SEQ ID NO:349), Public GI ID no. 87162911 (SEQ ID NO:355), Ceres CLONE ID no. 1790901 (SEQ ID NO:357), Ceres CLONE ID no. 1460088 (SEQ ID NO:370), Ceres CLONE ID no. 1734065 (SEQ ID NO:393), Ceres CLONE ID no. 473509 (SEQ ID NO:395), Ceres CLONE ID no. 849918 (SEQ ID NO:401), Ceres CLONE ID no. 633470 (SEQ ID NO:409), Ceres CLONE ID no. 1808334 (SEQ ID NO:417), and Ceres ANNOT ID no. 1525600 (SEQ ID NO:437).

FIG. 6 is an alignment of At5g14370 (Ceres Seedline ME11939; SEQ ID NO:456) with homologous and/or orthologous amino acid sequences including Public GI ID no. 58430585 (SEQ ID NO:457), Ceres CLONE ID no. 1842825 (SEQ ID NO:466), Ceres ANNOT ID no. 1449721 (SEQ ID NO:474), Public GI ID no. 41323978 (SEQ ID NO:475), Public GI ID no. 2895186 (SEQ ID NO:478), Public GI ID no. 22854950 (SEQ ID NO:481), Public GI ID no. 116010474 (SEQ ID NO:485), Public GI ID no. 4091804 (SEQ ID NO:488), Public GI ID no. 60459257 (SEQ ID NO:494), Public GI ID no. 45544881 (SEQ ID NO:496), Public GI ID no. 36789802 (SEQ ID NO:498), Public GI ID no. 92875402 (SEQ ID NO:508), Public GI ID no. 118406898 (SEQ ID NO:510), Public GI ID no. 107770485 (SEQ ID NO:511), Public GI ID no. 21655154 (SEQ ID NO:532), Public GI ID no. 90657642 (SEQ ID NO:536), and Ceres CLONE ID no. 1569555 (SEQ ID NO:1842).

FIG. 7 is an alignment of At1g70270 (Ceres Seedline ME13456; SEQ ID NO:634) with homologous and/or orthologous amino acid sequences including Public GI ID no. 98961985 (SEQ ID NO:637).

FIG. 8 is an alignment of At4g25480 (Ceres Seedline ME15935; SEQ ID NO:644) with homologous and/or orthologous amino acid sequences including SEQ ID NO:645, Ceres CLONE ID no. 1849479 (SEQ ID NO:767), Public GI ID no. 89275008 (SEQ ID NO:796), Public GI ID no. 120400525 (SEQ ID NO:797), Public GI ID no. 98980426 (SEQ ID NO:804), Public GI ID no. 71983373 (SEQ ID NO:808), Public GI ID no. 41351817 (SEQ ID NO:809), Public GI ID no. 76446191 (SEQ ID NO:811), Public GI ID no. 5616086 (SEQ ID NO:813), Ceres CLONE ID no. 1052602 (SEQ ID NO:826), Public GI ID no. 72068957 (SEQ ID NO:830), Public GI ID no. 71534113 (SEQ ID NO:831), Public GI ID no. 37147896 (SEQ ID NO:832), Public GI ID no. 92918850 (SEQ ID NO:834), Public GI ID no. 40647095 (SEQ ID NO:835), Ceres ANNOT ID no. 1527711 (SEQ ID NO:837), Public GI ID no. 71041116 (SEQ ID NO:838), Public GI ID no. 12003384 (SEQ ID NO:839), Public GI ID no. 18535580 (SEQ ID NO:840), and Public GI ID no. 115353971 (SEQ ID NO:1843).

FIG. 9 is an alignment of At2g33780 (Ceres SEEDLINE ID no.ME16594, SEQ ID NO:850) with homologous and/or orthologous amino acid sequences including Ceres CLONE ID no.1833093 (SEQ ID NO:853), Ceres ANNOT ID no.1502190 (SEQ ID NO:857), Ceres CLONE ID no.565641 (SEQ ID NO:876), Public GI ID no.87240507 (SEQ ID NO:877), Ceres CLONE ID no.1325382 (SEQ ID NO:881), Ceres CLONE ID no.1558265 (SEQ ID NO:885), Ceres CLONE ID no.1823669 (SEQ ID NO:895), and Public GI ID no.115464921 (SEQ ID NO:898).

FIG. 10 is an alignment of At4g17810 (Ceres SEEDLINE ID no.ME16597, SEQ ID NO:907) with homologous and/or orthologous amino acid sequences including Ceres CLONE ID no.1940797 (SEQ ID NO:909), Ceres ANNOT ID no.1538900 (SEQ ID NO:911), Ceres CLONE ID no.1126868 (SEQ ID NO:922), Public GI ID no.89257684 (SEQ ID NO:923), Public GI ID no.124360460 (SEQ ID NO:929), Public GI ID no.62865694 (SEQ ID NO:931), Public GI ID no.62865692 (SEQ ID NO:932), Ceres CLONE ID no.260368 (SEQ ID NO:936), Ceres CLONE ID no.1873510 (SEQ ID NO:947), Public GI ID no.125541662 (SEQ ID NO:948), Public GI ID no.48716268 (SEQ ID NO:950), and Public GI ID no. 62865696 (SEQ ID NO:1844).

FIG. 11 is an alignment of At1g13360 (Ceres SEEDLINE ID no.ME16630, SEQ ID NO:953) with homologous and/or orthologous amino acid sequences including Ceres CLONE ID no.1798705 (SEQ ID NO:955), Ceres ANNOT ID no.1458907 (SEQ ID NO:963), Ceres CLONE ID no.1090409 (SEQ ID NO:971), Ceres CLONE ID no.479817 (SEQ ID NO:977), Ceres CLONE ID no.1041793 (SEQ ID NO:979), Ceres CLONE ID no.684633 (SEQ ID NO:985), Ceres CLONE ID no.371815 (SEQ ID NO:991), Ceres CLONE ID no.1686460 (SEQ ID NO:993), Ceres CLONE ID no.1448595 (SEQ ID NO:995), Ceres CLONE ID no.1734477 (SEQ ID NO:999), Ceres CLONE ID no.1605693 (SEQ ID NO:1005), Ceres CLONE ID no.1757400 (SEQ ID NO:1009), and Public GI ID no.115434334 (SEQ ID NO:1015).

FIG. 12 is an alignment of At1g75860 (Ceres SEEDLINE ID no.ME17128, SEQ ID NO:1024) with homologous and/or orthologous amino acid sequences including Ceres ANNOT ID no.1452905 (SEQ ID NO:1029), Ceres CLONE ID no.956176 (SEQ ID NO:1039), Public GI ID no.92870366 (SEQ ID NO:1040), Ceres CLONE ID no.294166 (SEQ ID NO:1042), and Public GI ID no.125543067 (SEQ ID NO:1043).

FIG. 13 is an alignment of At4g19700 (Ceres SEEDLINE ID no.ME17578, SEQ ID NO:1047) with homologous and/or orthologous amino acid sequences including Ceres CLONE ID no.1837694 (SEQ ID NO:1053), Ceres ANNOT ID no.1483367 (SEQ ID NO:1057), Ceres CLONE ID no.1077781 (SEQ ID NO:1083), Ceres CLONE ID no.471026 (SEQ ID NO:1085), Public GI ID no.92888885 (SEQ ID NO:1099), Public GI ID no.45544873 (SEQ ID NO:1100), Public GI ID no.45758663 (SEQ ID NO:1101), Ceres CLONE ID no.772927 (SEQ ID NO:1105), Ceres CLONE ID no.895080 (SEQ ID NO:1111), Ceres CLONE ID no.1806128 (SEQ ID NO:1131), Public GI ID no.115458192 (SEQ ID NO:1134), and Public GI ID no.82470795 (SEQ ID NO:1139).

FIG. 14 is an alignment of At1g58100 (Ceres SEEDLINE ID no.ME18158, SEQ ID NO:1151) with homologous and/or orthologous amino acid sequences including Ceres CLONE ID no.1851526 (SEQ ID NO:1155), Ceres ANNOT ID no.1486769 (SEQ ID NO:1172), Public GI ID no.83032232 (SEQ ID NO:1209), Ceres CLONE ID no.1620420 (SEQ ID NO:1211), Public GI ID no.92892428 (SEQ ID NO:1215), Ceres CLONE ID no.884742 (SEQ ID NO:1223), Ceres CLONE ID no.1821559 (SEQ ID NO:1246), Public GI ID no.51535021 (SEQ ID NO:1258), Public GI ID no.113205304 (SEQ ID NO:1263), and Public GI ID no.37719051 (SEQ ID NO:1264).

FIG. 15 is an alignment of At5g46170 (Ceres SEEDLINE ID no.ME18314, SEQ ID NO:1277) with homologous and/or orthologous amino acid sequences including Ceres CLONE ID no.1926352 (SEQ ID NO:1279), Ceres ANNOT ID no.1448905 (SEQ ID NO:1285), Public GI ID no.15236865 (SEQ ID NO:1294), Ceres CLONE ID no.934771 (SEQ ID NO:1301), Ceres CLONE ID no.338386 (SEQ ID NO:1303), Ceres CLONE ID no.1780691 (SEQ ID NO:1317), and Public GI ID no.115464819 (SEQ ID NO:1326).

FIG. 16 is an alignment of At4g32280 (Ceres SEEDLINE ID no.ME18408, SEQ ID NO:1347) with homologous and/or orthologous amino acid sequences including Ceres CLONE ID no.285028 (SEQ ID NO:1419), Ceres CLONE ID no.100969565 (SEQ ID NO:1422), Public GI ID no.1352057 (SEQ ID NO:1427), Ceres ANNOT ID no.1453784 (SEQ ID NO:1429), Public GI ID no.452777 (SEQ ID NO:1430), and Public GI ID no.92873297 (SEQ ID NO:1431).

FIG. 17 is an alignment of At3g02830 (Ceres SEEDLINE ID no.ME19304, SEQ ID NO:1457) with homologous and/or orthologous amino acid sequences including Ceres CLONE ID no.1924904 (SEQ ID NO:1460), Ceres ANNOT ID no.1543346 (SEQ ID NO:1462), Public GI ID no.18396338 (SEQ ID NO:1467), Ceres CLONE ID no.833872 (SEQ ID NO:1471), Ceres CLONE ID no.1579587 (SEQ ID NO:1475), Ceres CLONE ID no.1786411 (SEQ ID NO:1477), and Public GI ID no.108864370 (SEQ ID NO:1480).

FIG. 18 is an alignment of At4g08920 (Ceres SEEDLINE ID no.ME19738, SEQ ID NO:1497) with homologous and/or orthologous amino acid sequences including Ceres ANNOT ID no.1443463 (SEQ ID NO:1499), Public GI ID no.13605525 (SEQ ID NO:1502), Public GI ID no.94965681 (SEQ ID NO:1506), and Public GI ID no.28201254 (SEQ ID NO:1512).

FIG. 19 is an alignment of At4g11660 (Ceres SEEDLINE ID no.ME20871, SEQ ID NO:1587) with homologous and/or orthologous amino acid sequences including Ceres CLONE ID no.1839577 (SEQ ID NO:1589), Ceres ANNOT ID no.1491567 (SEQ ID NO:1591), Ceres CLONE ID no.574505 (SEQ ID NO:1596), Public GI ID no.56117815 (SEQ ID NO:1597), Public GI ID no.92874021 (SEQ ID NO:1603), Public GI ID no.123684 (SEQ ID NO:1605), Public GI ID no.5821136 (SEQ ID NO:1606), Ceres CLONE ID no.283366 (SEQ ID NO:1609), Public GI ID no.16118447 (SEQ ID NO:1612), and Public GI ID no.125562434 (SEQ ID NO:1614).

FIG. 20 is an alignment of At2g45700 (Ceres SEEDLINE ID no.ME21508, SEQ ID NO:1635) with homologous and/or orthologous amino acid sequences including Ceres ANNOT ID no.1508307 (SEQ ID NO:1637), Public GI ID no.1495267 (SEQ ID NO:1642), Public GI ID no.87241310 (SEQ ID NO:1644), Ceres CLONE ID no.938390 (SEQ ID NO:1646), Ceres CLONE ID no.272338 (SEQ ID NO:1648), Ceres CLONE ID no.1993510 (SEQ ID NO:1650), Public GI ID no.125563862 (SEQ ID NO:1651), and Public GI ID no.125605833 (SEQ ID NO:1653).

FIG. 22 is an alignment of At1g04400 (Ceres SEEDLINE ID no.ME12006, SEQ ID NO:538) with homologous and/or orthologous amino acid sequences including Public GI ID no.5731739 (SEQ ID NO:539), Ceres ANNOT ID no.1538045 (SEQ ID NO:541), Public GI ID no.29467479 (SEQ ID NO:542), Public GI ID no.133921974 (SEQ ID NO:543), Public GI ID no.113197027 (SEQ ID NO:544), Public GI ID no.92879277 (SEQ ID NO:545), Public GI ID no.45935260 (SEQ ID NO:546), Public GI ID no.8101444 (SEQ ID NO:547), Public GI ID no.78217443 (SEQ ID NO:548), and Public GI ID no.28372347 (SEQ ID NO:549).

FIG. 23 is an alignment of At3g45610 (Ceres SEEDLINE ID no.ME12899, SEQ ID NO:606) with homologous and/or orthologous amino acid sequences including Public GI ID no.92873064 (SEQ ID NO:607), Public GI ID no.37051125 (SEQ ID NO:608), and Public GI ID no.112363376 (SEQ ID NO:609).

FIG. 24 is an alignment of At4g08330 (Ceres SEEDLINE ID no.ME12596, SEQ ID NO:570) with homologous and/or orthologous amino acid sequences including Ceres CLONE ID no.1919714 (SEQ ID NO:572), Ceres ANNOT ID no.1443290 (SEQ ID NO:574), Ceres CLONE ID no.1042157 (SEQ ID NO:576), Ceres CLONE ID no.1384304 (SEQ ID NO:578), and Public GI ID no.115464375 (SEQ ID NO:579).

DETAILED DESCRIPTION

Figure 21:
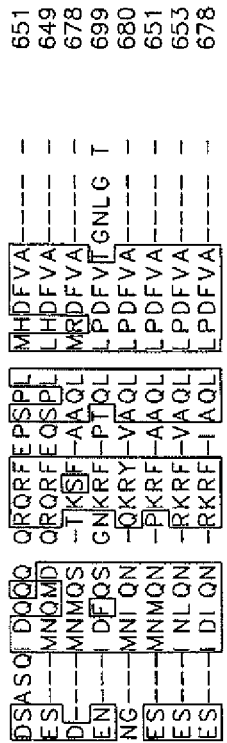
FIG. 21 is an alignment of At2g35940 (Ceres SEEDLINE ID no.ME19971, SEQ ID NO:1540) with homologous and/or orthologous amino acid sequences including Ceres CLONE ID no.1943265 (SEQ ID NO:1543), Ceres ANNOT ID no.1454522 (SEQ ID NO:1547), Public GI ID no.31323447 (SEQ ID NO:1556), Ceres CLONE ID no.1583941 (SEQ ID NO:1561), Ceres CLONE ID no.1792942 (SEQ ID NO:1563), Public GI ID no.77548772 (SEQ ID NO:1565), and Public GI ID no.84453182 (SEQ ID NO:1567).

This document provides methods and materials related to modulating tolerance of plants to Short Day plus End-of-Day Far-Red (SD+EODFR) conditions or low light irradiation. In some embodiments, the plants may have increased SD+EODFR tolerance and increased low light tolerance. The methods can include transforming a plant cell with a nucleic acid encoding an SD+EODFR and/or low light-tolerance polypeptide, wherein expression of the polypeptide results in increased SD+EODFR and/or low light tolerance. Plant cells produced using such methods can be grown to produce plants having an increased SD+EODFR and/or low light tolerance. Such plants can also be used to produce crops, plant products, biomass, and/or nitrogen fixating plants in shady or low light areas, such as under the canopy of another crop. For example, the methods and materials provided herein can be used to produce a legume (a member of Fabaceae, e.g., peas, beans, lupins, lentils, chick peas, vethes, soybeans, clovers, alfalfas, and peanuts) having an increased SD+EODFR and/or low light tolerance and which can be grown under the canopy of a taller crop (e.g., corn, switchgrass, sorghum, sugar cane, or miscanthus). In other embodiments, the taller plant is a nitrogen fixating plant (e.g., a member of Fabaceae, such as tamarind, mimosa, acacia, and carob) and the SD+EODFR and/or low light tolerant plant is a shorter plant, such as corn, switchgrass, sorghum, sugar cane, or miscanthus.

I. Definitions

"Amino acid" refers to one of the twenty biologically occurring amino acids and to synthetic amino acids, including D/L optical isomers.

"Cell type-preferential promoter" or "tissue-preferential promoter" refers to a promoter that drives expression preferentially in a target cell type or tissue, respectively, but may also lead to some transcription in other cell types or tissues as well.

"Control plant" refers to a plant that does not contain the exogenous nucleic acid present in a transgenic plant of interest, but otherwise has the same or similar genetic background as such a transgenic plant. A suitable control plant can be a non-transgenic wild type plant, a non-transgenic segregant from a transformation experiment, or a transgenic plant that contains an exogenous nucleic acid other than the exogenous nucleic acid of interest.

"Domains" are groups of substantially contiguous amino acids in a polypeptide that can be used to characterize protein families and/or parts of proteins. Such domains have a "fingerprint" or "signature" that can comprise conserved primary sequence, secondary structure, and/or three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

"Down-regulation" refers to regulation that decreases the level of an expression product (mRNA, polypeptide, or both) relative to basal or native states.

"Exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

"Expression" refers to the process of converting genetic information of a polynucleotide into RNA through transcription, which is catalyzed by an enzyme, RNA polymerase, and into protein, through translation of mRNA on ribosomes.

"Heterologous polypeptide" as used herein refers to a polypeptide that is not a naturally occurring polypeptide in a plant cell, e.g., a transgenic *Panicum virgatum* plant transformed with and expressing the coding sequence for a nitrogen transporter polypeptide from a *Zea mays* plant.

"Isolated nucleic acid" as used herein includes a naturally-occurring nucleic acid, provided one or both of the sequences immediately flanking that nucleic acid in its naturally-occurring genome is removed or absent. Thus, an isolated nucleic acid includes, without limitation, a nucleic acid that exists as a purified molecule or a nucleic acid molecule that is incorporated into a vector or a virus. A nucleic acid existing among hundreds to millions of other nucleic acids within, for example, cDNA libraries, genomic libraries, or gel slices containing a genomic DNA restriction digest, is not to be considered an isolated nucleic acid.

"Modulation" of the level of tolerance to a stimulus (e.g., low light conditions or SD+EODFR conditions) refers to the change in the level of tolerance of the indicated stimulus that is observed as a result of expression of, or transcription from, an exogenous nucleic acid in a plant cell. The change in level is measured relative to the corresponding level in control plants.

"Nucleic acid" and "polynucleotide" are used interchangeably herein, and refer to both RNA and DNA, including cDNA, genomic DNA, synthetic DNA, and DNA or RNA containing nucleic acid analogs. Polynucleotides can have any three-dimensional structure. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, nucleic acid probes and nucleic acid primers. A polynucleotide may contain unconventional or modified nucleotides.

"Operably linked" refers to the positioning of a regulatory region and a sequence to be transcribed in a nucleic acid so that the regulatory region is effective for regulating transcription or translation of the sequence. For example, to operably link a coding sequence and a regulatory region, the translation initiation site of the translational reading frame of the coding sequence is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site.

"Polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. Full-length polypeptides, truncated polypeptides, point mutants, insertion mutants, splice variants, chimeric proteins, and fragments thereof are encompassed by this definition.

"Progeny" includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. The designation $F_1$ refers to the progeny of a cross between two parents that are genetically distinct. The designations $F_2$, $F_3$, $F_4$, $F_5$ and $F_6$ refer to subsequent generations of self- or sib-pollinated progeny of an $F_1$ plant.

"Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell,* 1:977-984 (1989).

"Up-regulation" refers to regulation that increases the level of an expression product (mRNA, polypeptide, or both) relative to basal or native states.

"Vector" refers to a replicon, such as a plasmid, phage, or cosmid, into which another DNA segment may be inserted so as to bring about the replication of the inserted segment. Generally, a vector is capable of replication when associated with the proper control elements. The term "vector" includes cloning and expression vectors, as well as viral vectors and integrating vectors. An "expression vector" is a vector that includes a regulatory region.

II. Polypeptides

Polypeptides described herein include SD+EODFR and/or low light tolerancepolypeptides. SD+EODFR and/or low light tolerance polypeptides can be effective to increase SD+EODFR and/or low light tolerance when expressed in a plant or plant cell. Such polypeptides typically contain at least one domain indicative of SD+EODFR and/or low light tolerance polypeptides, as described in more detail herein. SD+EODFR and/or low light tolerance polypeptides typically have an HMM bit score that is greater than 20 for an HMM model based on one of the alignments set forth in FIGS. 1-24, as described in more detail herein. In some embodiments, SD+EODFR and/or low light tolerance polypeptides have greater than 40% identity to SEQ ID NO:3, SEQ ID NO:70, SEQ ID NO:129, SEQ ID NO:317, SEQ ID NO:337, SEQ ID NO:456, SEQ ID NO:538, SEQ ID NO:570, SEQ ID NO:606, SEQ ID NO:634, SEQ ID NO:644, SEQ ID NO:850, SEQ ID NO:907, SEQ ID NO:953, SEQ ID NO:1024, SEQ ID NO:1047, SEQ ID NO:1151, SEQ ID NO:1277, SEQ ID NO:1347, SEQ ID NO:1457, SEQ ID NO:1497, SEQ ID NO:1540, SEQ ID NO:1587, SEQ ID NO:1630, or SEQ ID NO:1635 as described in more detail herein.

Polypeptides described herein include red light specific response pathway polypeptides. Red light specific response pathway polypeptides can be effective to decrease hypocotyl length when over-expressed in a plant or plant cell. Such polypeptides typically contain at least one domain indicative of red light specific response pathway polypeptides, as described in more detail herein. Red light specific response pathway polypeptides typically have an HMM bit score that is greater than 20 for an HMM model based on one of the alignments set forth in FIGS. 6, 11, and 24, as described in more detail herein. In some embodiments, red light specific response pathway polypeptides have greater than 40% identity to SEQ ID NO:456, SEQ ID NO:953, or SEQ ID NO:1540 as described in more detail herein.

A. Domains Indicative of SD+EODFR and/or Low Light Tolerance Polypeptides

A low light tolerance polypeptide can contain a cyclin dependent kinase inhibitor (CDI) domain. Cell cycle progression is negatively controlled by cyclin-dependent kinases inhibitors (CDIs). CDIs are involved in cell cycle arrest at the G1 phase. The motif is also present in SEQ ID NO:70, which sets forth the amino acid sequence of an *Arabidopsis* clone, identified herein as At2g32710 (SEQ ID NO:69), that is predicted to encode a cyclin-dependent kinase inhibitor 4 (KIP4) polypeptide.

A low light tolerance polypeptide can contain an AUX/IAA domain, which is predicted to be characteristic of an Aux/IAA transcriptional repressor. AUX/IAA proteins act as repressors of auxin-induced gene expression, possibly through modulating the activity of DNA-binding auxin response factors (ARFs). SEQ ID NO:129 sets forth the amino acid sequence of an *Arabidopsis* clone, identified herein as At2g46990 (SEQ ID NO:127), that is predicted to encode an auxin-induced IAA21 polypeptide. An SD+EODFR tolerance and low light tolerance polypeptide can also contain an AUX/IAA domain. SEQ ID NO:1347 sets forth the amino acid sequence of an *Arabidopsis* clone, identified herein as At1g32280 (SEQ ID NO:1345), that is predicted to encode an auxin-responsive IAA29 polypeptide containing an AUX/IAA domain.

A low light tolerance polypeptide can contain a homeobox domain. Homeobox domains bind DNA through a helix-turn-helix (HTH) structure. The HTH motif is characterised by two alpha-helices, which make intimate contacts with the DNA and are joined by a short turn. The second helix binds to DNA via a number of hydrogen bonds and hydrophobic interactions, which occur between specific side chains and the exposed bases and thymine methyl groups within the major groove of the DNA. The first helix helps to stabilise the structure. SEQ ID NO:317 sets forth the amino acid sequence of an *Arabidopsis* clone, identified herein as At4g03250 (SEQ ID NO:315), that is predicted to encode a polypeptide containing a homeobox domain.

A low light tolerance polypeptide can contain a C3HC4 type zinc-finger (zf_C3HC4) domain. The C3HC4 type zinc-finger (RING finger) is a cysteine-rich domain of 40 to 60 residues that coordinates two zinc ions, and has the consensus sequence: C-X2-C-X(9-39)-C-X(1-3)-H-X(2-3)-C-X2-C-X(4-48)-C-X2-C where X is any amino acid. Many proteins containing a RING finger play a role in the ubiquitination pathway. SEQ ID NO:337 sets forth the amino acid sequence of an *Arabidopsis* clone, identified herein as At2g04240 (SEQ ID NO:335), that is predicted to encode a polypeptide containing zf_C3HC4 domain.

A low light tolerance polypeptide can contain a B-box zinc finger (zf-B_box) domain and a CCT motif A B-box zinc finger domain is about 40 amino acids in length. One or two copies of this domain are generally associated with a ring finger and a coiled coil motif B-box zinc finger domains are found in transcription factors, ribonucleoproteins and protooncoproteins, but no function is clearly assigned. The CCT (CONSTANS, CO-like, and TOC1) motif is a highly conserved basic domain of about 43 amino acids, and is found near the C-terminus of plant proteins often involved in light signal transduction. The CCT motif is found in association with other domains, such as B-box zinc finger domains, GATA-type zinc finger domains, ZIM motifs, or response regulatory domains. The CCT motif contains a putative nuclear localization signal within the second half of the CCT motif, has been shown to be involved in nuclear localization, and likely has a role in protein-protein interaction. SEQ ID NO:456 sets forth the amino acid sequence of an *Arabidopsis* clone, identified herein as At5g14370 (SEQ ID NO:454), that is predicted to encode a polypeptide containing a B-box zinc finger domain and a CCT motif.

An SD+EODFR tolerance polypeptide can contain a DNA photolyase domain and a FAD_binding_7 domain (FAD binding domain of DNA photolyase). DNA photolyases are enzymes that repair mismatched pyrimidine dimers in DNA that are induced by exposure to ultra-violet light. Proteins containing a FAD_binding_7 domain include *Arabidopsis* cryptochromes 1 (CRY1) and 2 (CRY2), which are blue light photoreceptors that mediate blue light-induced gene expression. SEQ ID NO:538 sets forth the amino acid sequence of an *Arabidopsis* clone, identified herein as At1g04400 (SEQ ID NO:537), that is predicted to encode a cryptochrome 2 apoprotein polypeptide containing a FAD_binding_7 domain and a DNA photolyase domain. A low light-tolerance polypeptide can also FAD_binding_7 domain and a DNA photolyase domain. SEQ ID NO:1497 sets forth the amino acid sequence of an *Arabidopsis* clone, identified herein as At4g08920 (SEQ ID NO:1496), that is predicted to encode a cryptochrome 1 (CRY1), flavin-type blue-light photoreceptor apoprotein polypeptide containing a FAD_binding_7 domain and a DNA photolyase domain.

An SD+EODFR tolerance polypeptide can contain a zf_Dof domain, which is predicted to be characteristic of a Dof domain zinc finger polypeptide. SEQ ID NO:606 sets forth the amino acid sequence of an *Arabidopsis* clone, identified herein as At3g45610 (SEQ ID NO:605), that is predicted to encode a polypeptide containing a zf_Dof domain.

A low light tolerance polypeptide can contain an AP2 domain, which is predicted to be characteristic of an ERF/AP2 transcription factor. AP2 domains are typically about 60 amino acid residues in length. SEQ ID NO:645 sets forth the amino acid sequence of an *Arabidopsis* clone, identified herein as At4g25480 (SEQ ID NO:642), that is predicted to encode a DREB subfamily A-1 polypeptide of the ERF/AP2 transcription factor family containing an AP2 domain.

A low light tolerance polypeptide can contain a VQ motif. VQ motifs are short conserved motifs of FXhVQChTG, where X is any amino acid and h is a hydrophobic amino acid, that is found in a variety of plant proteins. SEQ ID NO:850 sets forth the amino acid sequence of an *Arabidopsis* clone, identified herein as At2g33780 (SEQ ID NO:848), that is predicted to encode a polypeptide containing a VQ motif.

A low light tolerance polypeptide can contain a zf_C2H2 domain, which is predicted to be characteristic of a C2H2-type zinc finger. C2H2 zinc fingers are composed of two short beta strands followed by an alpha helix. The amino terminal part of the helix binds the major groove of DNA. The two conserved cysteines and histidines of a C2H2 zinc finger domain coordinate a zinc ion. SEQ ID NO:907 sets forth the amino acid sequence of an *Arabidopsis* clone, identified herein as At4g17810 (SEQ ID NO:905), that is predicted to encode a polypeptide containing a zf_C2H2 domain.

A low light tolerance polypeptide can contain a TCP domain, which is predicted to be characteristic of a TCP family transcription factor. The TCP family of transcription factors is named after its first characterized members, TB1, CYC and PCF1 and PCF2. TCP domains are predicted to form non-canonical basic-Helix-Loop-Helix (bHLP) structures. The TCP domains found in two rice DNA-binding proteins, PCF1 and PCF2, have been shown to be involved in DNA-binding and dimerization. SEQ ID NO:1151 sets forth the amino acid sequence of an *Arabidopsis* clone, identified herein as At1g58100 (SEQ ID NO:1150), that is predicted to encode a polypeptide containing a TCP domain.

A low light tolerance polypeptide can contain an F-box domain. F-box domains have a role in mediating protein-protein interactions in a variety of contexts, such as polyubiquitination, transcription elongation, centromere binding and translational repression. Two motifs that are commonly found associated with F-box domains are leucine rich repeats and WD repeats. SEQ ID NO:1277 sets forth the amino acid sequence of an *Arabidopsis* clone, identified herein as At5g46170 (SEQ ID NO:1276), that is predicted to encode a polypeptide containing an F-box domain.

A low light tolerance polypeptide can contain a zf_CCCH domain, which is predicted to be characteristic of a C-x8-C-x5-C-x3-H type zinc finger polypeptide. The zf-CCCH domain is often found associated with proteins that interact with the 3' untranslated region of various mRNAs. SEQ ID NO:1457 sets forth the amino acid sequence of an *Arabidopsis* clone, identified herein as At3g02830 (SEQ ID NO:1456), that is predicted to encode a polypeptide containing a zf_CCCH domain.

An SD+EODFR tolerance and low light tolerance polypeptide can contain a PDX domain and a homeobox domain. PDX domains are often found in plant proteins with a homeobox domain, indicating that such proteins are likely transcription factors. SEQ ID NO:1540 sets forth the amino acid sequence of an *Arabidopsis* clone, identified herein as At2g35940 (SEQ ID NO:1537), that is predicted to encode a BEL1-like homeodomain 1 polypeptide containing a PDX domain and a homeobox domain.

A low light tolerance polypeptide can contain an HSF-type DNA-binding domain, which is predicted to be characteristic of heat shock factor transcription activator. Heat shock factor transcription activators are often found associated with heat shock protein promoters during heat shock. SEQ ID NO:1587 sets forth the amino acid sequence of an *Arabidopsis* clone, identified herein as At4g11660 (SEQ ID NO:1586), that is predicted to encode a polypeptide containing an HSF-type DNA-binding domain.

A low light tolerance polypeptide can contain a sterile alpha motif (SAM_1) domain and a DNA repair metallo-beta-lactamase (DRMBL) domain, which is predicted to be characteristic of a DNA repair metallo-beta-lactamase. SEQ ID NO:1635 sets forth the amino acid sequence of an *Arabidopsis* clone, identified herein as Ceres At2g45700 (SEQ ID NO:1634), that is predicted to encode a polypeptide containing a SAM domain and a DRMBL domain.

B. Domains Indicative of Red Light Specific Response Pathway Polypeptides

A red light specific response pathway polypeptide can contain a B-box zinc finger (zf-B_box) domain and a CCT motif A B-box zinc finger domain is about 40 amino acids in length. One or two copies of this domain are generally associated with a ring finger and a coiled coil motif B-box zinc finger domains are found in transcription factors, ribonucleoproteins and protooncoproteins, but no function is clearly assigned. The CCT (CONSTANS, CO-like, and TOC1) motif is a highly conserved basic domain of about 43 amino acids, and is found near the C-terminus of plant proteins often involved in light signal transduction. The CCT motif is found in association with other domains, such as B-box zinc finger domains, GATA-type zinc finger domains, ZIM motifs, or response regulatory domains. The CCT motif contains a putative nuclear localization signal within the second half of the CCT motif, has been shown to be involved in nuclear localization, and likely has a role in protein-protein interaction. SEQ ID NO:456 sets forth the amino acid sequence of an *Arabidopsis* clone, identified herein as At5g14370 (SEQ ID NO:454), that is predicted to encode a polypeptide containing a B-box zinc finger domain and a CCT motif.

A red light specific response pathway polypeptide can contain a PDX domain and a homeobox domain. PDX domains are often found in plant proteins with a homeobox domain, indicating that such proteins are likely transcription factors. SEQ ID NO:1540 sets forth the amino acid sequence of an *Arabidopsis* clone, identified herein as At2g35940

(SEQ ID NO:1537), that is predicted to encode a BELL-like homeodomain 1 polypeptide containing a PDX domain and a homeobox domain.

C. Functional Homologs Identified by Reciprocal BLAST

In some embodiments, one or more functional homologs of a reference SD+EODFR and/or low light tolerance polypeptide defined by one or more of the pfam descriptions indicated above are suitable for use as SD+EODFR and/or low light tolerance polypeptides. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for an SD+EODFR and/or low light tolerance polypeptide, or by combining domains from the coding sequences for different naturally-occurring SD+EODFR and/or low light tolerance polypeptides ("domain swapping"). The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of SD+EODFR and/or low light tolerance polypeptides. Sequence analysis can involve BLAST, Reciprocal BLAST, or PSI-BLAST analysis of nonredundant databases using an SD+EODFR and/or low light tolerance polypeptide amino acid sequence as the reference sequence. Amino acid sequence is, in some instances, deduced from the nucleotide sequence. Those polypeptides in the database that have greater than 40% sequence identity are candidates for further evaluation for suitability as an SD+EODFR and/or low light tolerance polypeptide Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in SD+EODFR and/or low light tolerance polypeptides, e.g., conserved functional domains.

Conserved regions can be identified by locating a region within the primary amino acid sequence of an SD+EODFR and/or low light tolerance polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/and pfam.janelia.org/. A description of the information included at the Pfam database is described in Sonnhammer et al., *Nucl. Acids Res.*, 26:320-322 (1998); Sonnhammer et al., *Proteins*, 28:405-420 (1997); and Bateman et al., *Nucl. Acids Res.*, 27:260-262 (1999). Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

Amino acid sequences of functional homologs of the polypeptide set forth in SEQ ID NO:3 are provided in FIG. 1. Such functional homologs include Ceres CLONE ID no. 1844057 (SEQ ID NO:7), Ceres ANNOT ID no. 1469148 (SEQ ID NO:22), Public GI ID no. 18390998 (SEQ ID NO:25), Ceres CLONE ID no. 1065656 (SEQ ID NO:32), Ceres CLONE ID no. 1652677 (SEQ ID NO:36), Public GI ID no. 92874556 (SEQ ID NO:49), Ceres CLONE ID no. 1329161 (SEQ ID NO:53), Ceres CLONE ID no. 1030378 (SEQ ID NO:55), Ceres CLONE ID no. 1413787 (SEQ ID NO:57), and Public GI ID no. 125543598 (SEQ ID NO:60). Other functional homologs of SEQ ID NO:3 include Ceres CLONE ID no. 1793691 (SEQ ID NO:5), Ceres CLONE ID no. 1933784 (SEQ ID NO:9), Ceres CLONE ID no. 100030408 (SEQ ID NO:10), Ceres CLONE ID no. 1837059 (SEQ ID NO:12), Ceres CLONE ID no. 1793801 (SEQ ID NO:14), Ceres CLONE ID no. 1855480 (SEQ ID NO:16), Ceres CLONE ID no. 1915644 (SEQ ID NO:18), Ceres CLONE ID no. 1898104 (SEQ ID NO:20), Ceres ANNOT ID no. 1464241 (SEQ ID NO:24), Public GI ID no. 18697627 (SEQ ID NO:26), Ceres CLONE ID no. 9391 (SEQ ID NO:28), Ceres CLONE ID no. 111154 (SEQ ID NO:30), Ceres CLONE ID no. 973975 (SEQ ID NO:34), Ceres CLONE ID no. 676695 (SEQ ID NO:38), Ceres CLONE ID no. 680331 (SEQ ID NO:40), Ceres CLONE ID no. 654515 (SEQ ID NO:42), Ceres CLONE ID no. 626154 (SEQ ID NO:44), Ceres CLONE ID no. 710603 (SEQ ID NO:46), Ceres CLONE ID no. 648076 (SEQ ID NO:48), Ceres CLONE ID no. 749439 (SEQ ID NO:51), Ceres CLONE ID no. 295936 (SEQ ID NO:59), Public GI ID no. 125525139 (SEQ ID NO:61), Public GI ID no. 115452643 (SEQ ID NO:62), Public GI ID no. 24059889 (SEQ ID NO:63), Ceres ANNOT ID no. 6012747 (SEQ ID NO:65), Ceres ANNOT ID no. 6027628 (SEQ ID NO:67), and sequences identified as functional homologs of the sequences of FIG. 1, as set forth in the sequence listing. In some cases, a functional homolog of SEQ ID NO:3 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:3.

Figure 2:
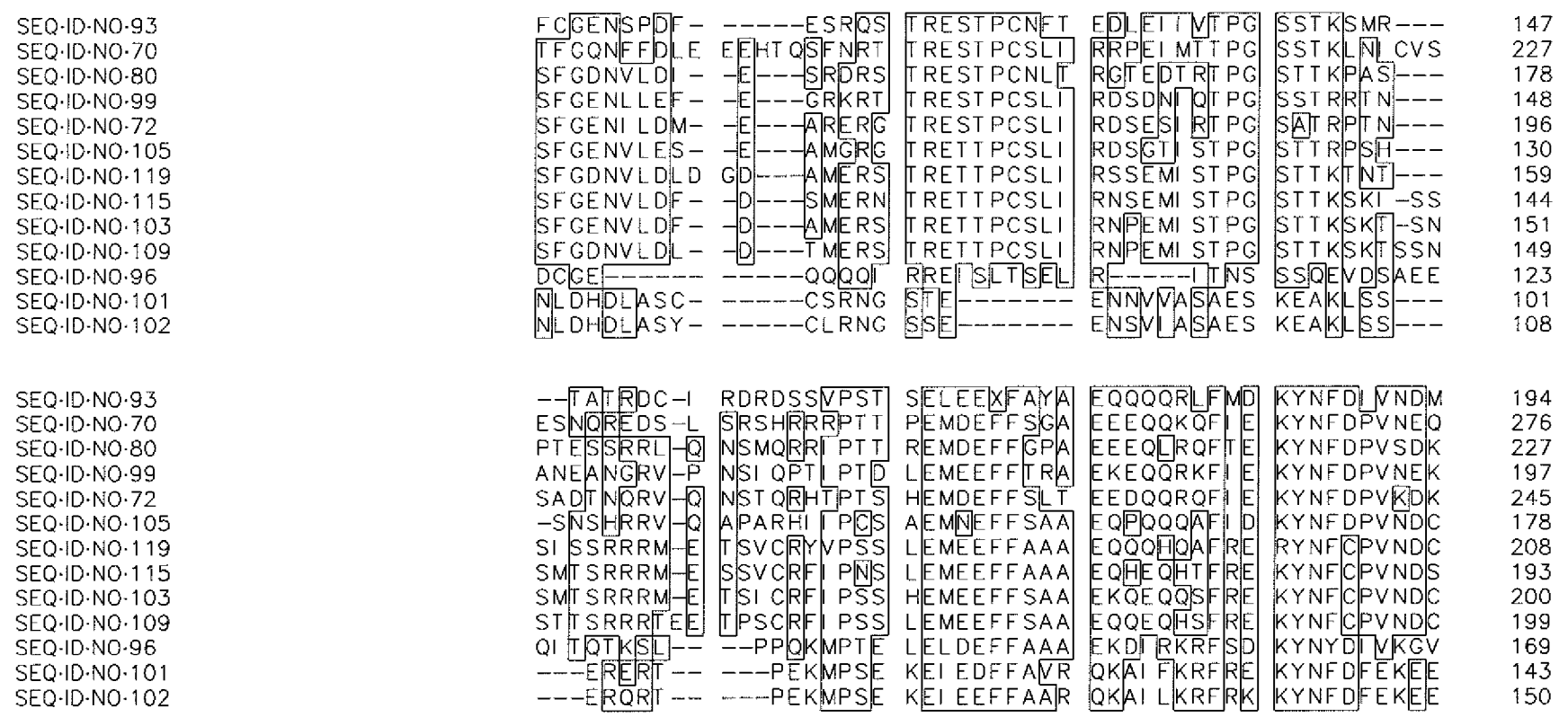

Amino acid sequences of functional homologs of the polypeptide set forth in SEQ ID NO:70 are provided in FIG. 2. Such functional homologs include Ceres CLONE ID no. 1975934 (SEQ ID NO:72), Ceres ANNOT ID no. 1529913 (SEQ ID NO:80), Ceres CLONE ID no. 977794 (SEQ ID NO:93), Public GI ID no. 42362378 (SEQ ID NO:96), Public GI ID no. 23899378 (SEQ ID NO:99), Public GI ID no. 15963346 (SEQ ID NO:101), Public GI ID no. 15963344+B816 (SEQ ID NO:102), Public GI ID no. 92429657 (SEQ ID NO:103), Ceres CLONE ID no. 746644 (SEQ ID NO:105), Ceres CLONE ID no. 623089 (SEQ ID NO:109), Ceres CLONE ID no. 1913678 (SEQ ID NO:115), and Public GI ID no. 115450609 (SEQ ID NO:119). Other functional homologs of SEQ ID NO:70 include Ceres CLONE ID no. 1835084 (SEQ ID NO:74), Ceres CLONE ID no. 1846153 (SEQ ID NO:76), Ceres CLONE ID no.

1930884 (SEQ ID NO:78), Ceres ANNOT ID no. 1493858 (SEQ ID NO:82), Ceres ANNOT ID no. 1498646 (SEQ ID NO:84), Ceres ANNOT ID no. 1440974 (SEQ ID NO:86), Ceres CLONE ID no. 1189183 (SEQ ID NO:88), Public GI ID no. 26450253 (SEQ ID NO:89), Public GI ID no. 15239719 (SEQ ID NO:90), Public GI ID no. 15230194 (SEQ ID NO:91), Ceres CLONE ID no. 630905 (SEQ ID NO:95), Public GI ID no. 42362389 (SEQ ID NO:97), Public GI ID no. 70906129 (SEQ ID NO:98), Public GI ID no. 23899381 (SEQ ID NO:100), Ceres CLONE ID no. 298166 (SEQ ID NO:107), Ceres CLONE ID no. 1448390 (SEQ ID NO:111), Ceres CLONE ID no. 1734216 (SEQ ID NO:113), Public GI ID no. 125542322 (SEQ ID NO:116), Public GI ID no. 125532331 (SEQ ID NO:117), Public GI ID no. 125541233 (SEQ ID NO:118), Public GI ID no. 125584844 (SEQ ID NO:120), Public GI ID no. 115482472 (SEQ ID NO:121), Public GI ID no. 125575112 (SEQ ID NO:122), Ceres ANNOT ID no.6003994 (SEQ ID NO:124), Ceres ANNOT ID no. 6068427 (SEQ ID NO:126), and sequences identified as functional homologs of the sequences of FIG. 2, as set forth in the sequence listing. In some cases, a functional homolog of SEQ ID NO:70 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:70.

Figure 3:
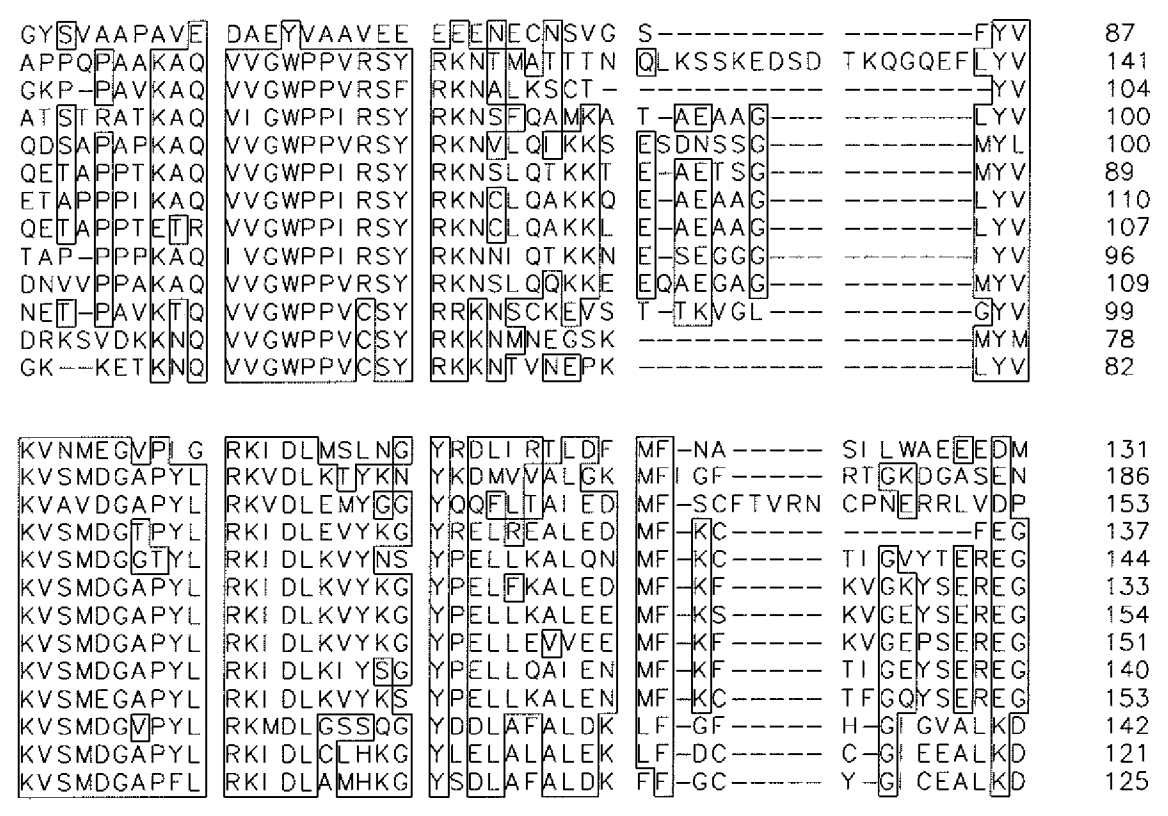

Amino acid sequences of functional homologs of the polypeptide set forth in SEQ ID NO:129 are provided in FIG. 3. Such functional homologs include Public GI ID no. 34550779 (SEQ ID NO:133), Ceres CLONE ID no. 1932235 (SEQ ID NO:137), Ceres CLONE ID no. 981738 (SEQ ID NO:201), Ceres CLONE ID no. 565974 (SEQ ID NO:209), Public GI ID no. 1352058 (SEQ ID NO:231), Public GI ID no. 11131101 (SEQ ID NO:234), Public GI ID no. 4887018 (SEQ ID NO:236), Public GI ID no. 4887018 (SEQ ID NO:236), Ceres CLONE ID no. 644455 (SEQ ID NO:247), Ceres CLONE ID no. 1731500 (SEQ ID NO:270), Public GI ID no. 20269063 (SEQ ID NO:300), Public GI ID no. 50404477 (SEQ ID NO:302), and Public GI ID no. 62125392 (SEQ ID NO:303). Other functional homologs of SEQ ID NO:129 include Public GI ID no. 32396293 (SEQ ID NO:130), Public GI ID no. 32396299 (SEQ ID NO:131), Public GI ID no. 32396295 (SEQ ID NO:132), Ceres CLONE ID no. 1855369 (SEQ ID NO:135), Ceres CLONE ID no. 1948456 (SEQ ID NO:139), Ceres CLONE ID no. 1920182 (SEQ ID NO:141), Ceres CLONE ID no. 1835797 (SEQ ID NO:143), Ceres CLONE ID no. 1794204 (SEQ ID NO:145), Ceres CLONE ID no. 1853542 (SEQ ID NO:147), Ceres CLONE ID no. 1838776 (SEQ ID NO:149), Ceres CLONE ID no. 1854675 (SEQ ID NO:151), Ceres CLONE ID no. 1833078 (SEQ ID NO:153), Ceres CLONE ID no. 1850667 (SEQ ID NO:155), Ceres CLONE ID no. 1918745 (SEQ ID NO:157), Ceres CLONE ID no. 1929487 (SEQ ID NO:159), Ceres ANNOT ID no. 1497918 (SEQ ID NO:161), Ceres ANNOT ID no. 1459563 (SEQ ID NO:163), Ceres ANNOT ID no. 1452610 (SEQ ID NO:165), Ceres ANNOT ID no. 1496539 (SEQ ID NO:167), Ceres ANNOT ID no. 1498819 (SEQ ID NO:169), Ceres ANNOT ID no. 1446583 (SEQ ID NO:171), Ceres ANNOT ID no. 1535123 (SEQ ID NO:173), Ceres ANNOT ID no. 1463397 (SEQ ID NO:175), Ceres ANNOT ID no. 1499563 (SEQ ID NO:177), Ceres ANNOT ID no. 1495753 (SEQ ID NO:179), Ceres ANNOT ID no. 1488767 (SEQ ID NO:181), Ceres ANNOT ID no. 1522920 (SEQ ID NO:185), Ceres ANNOT ID no. 1469532 (SEQ ID NO:187), Public GI ID no. 15219692 (SEQ ID NO:188), Public GI ID no. 18420964 (SEQ ID NO:189), Ceres CLONE ID no. 1342080 (SEQ ID NO:191), Ceres CLONE ID no. 123105 (SEQ ID NO:193), Ceres CLONE ID no. 32727 (SEQ ID NO:195), Ceres CLONE ID no. 41161 (SEQ ID NO:197), Ceres CLONE ID no. 37274 (SEQ ID NO:199), Ceres CLONE ID no. 538020 (SEQ ID NO:203), Ceres CLONE ID no. 476244 (SEQ ID NO:205), Ceres CLONE ID no. 1623662 (SEQ ID NO:207), Ceres CLONE ID no. 626817 (SEQ ID NO:211), Ceres CLONE ID no. 537469 (SEQ ID NO:213), Ceres CLONE ID no. 582463 (SEQ ID NO:215), Ceres CLONE ID no.1069818 (SEQ ID NO:217), Ceres CLONE ID no. 511737 (SEQ ID NO:219), Ceres CLONE ID no. 565422 (SEQ ID NO:221), Ceres CLONE ID no. 514595 (SEQ ID NO:223), Ceres CLONE ID no. 566396 (SEQ ID NO:225), Ceres CLONE ID no. 612705 (SEQ ID NO:227), Ceres CLONE ID no. 564134 (SEQ ID NO:229), Public GI ID no. 92872146 (SEQ ID NO:230), Public GI ID no. 11131103 (SEQ ID NO:232), Public GI ID no. 416641 (SEQ ID NO:233), Public GI ID no. 11131105 (SEQ ID NO:235), Public GI ID no. 4887016 (SEQ ID NO:237), Public GI ID no. 4887022 (SEQ ID NO:238), Public GI ID no. 81074526 (SEQ ID NO:239), Ceres CLONE ID no. 742023 (SEQ ID NO:241), Ceres CLONE ID no. 576268 (SEQ ID NO:243), Ceres CLONE ID no. 615386 (SEQ ID NO:245), Ceres CLONE ID no. 756966 (SEQ ID NO:249), Ceres CLONE ID no. 1052710 (SEQ ID NO:251), Ceres CLONE ID no. 697018 (SEQ ID NO:253), Ceres CLONE ID no. 618577 (SEQ ID NO:255), Ceres CLONE ID no. 935194 (SEQ ID NO:257), Ceres CLONE ID no. 1557429 (SEQ ID NO:259), Ceres CLONE ID no. 305337 (SEQ ID NO:261), Ceres CLONE ID no. 100872943 (SEQ ID NO:262), Ceres CLONE ID no. 305454 (SEQ ID NO:264), Ceres CLONE ID no. 1534670 (SEQ ID NO:266), Ceres CLONE ID no. 207963 (SEQ ID NO:268), Public GI ID no. 20257219 (SEQ ID NO:271), Ceres CLONE ID no. 1876818 (SEQ ID NO:273), Ceres CLONE ID no. 1817533 (SEQ ID NO:275), Ceres CLONE ID no. 1958631 (SEQ ID NO:277), Ceres CLONE ID no. 1963215 (SEQ ID NO:279), Ceres CLONE ID no. 1770022 (SEQ ID NO:281), Ceres CLONE ID no. 1796223 (SEQ ID NO:283), Ceres CLONE ID no. 2016695 (SEQ ID NO:285), Ceres CLONE ID no. 1757085 (SEQ ID NO:287), Ceres CLONE ID no. 1769256 (SEQ ID NO:289), Ceres CLONE ID no. 1994871 (SEQ ID NO:291), Public GI ID no. 17154533 (SEQ ID NO:292), Public GI ID no. 125557426 (SEQ ID NO:293), Public GI ID no. 125524736 (SEQ ID NO:294), Public GI ID no. 125527656 (SEQ ID NO:295), Public GI ID no. 125599342 (SEQ ID NO:296), Public GI ID no. 125569626 (SEQ ID NO:297), Public GI ID no. 115465401 (SEQ ID NO:298), Public GI ID no. 40539038 (SEQ ID NO:299), Public GI ID no. 20269059 (SEQ ID NO:301), Public GI ID no. 110826446 (SEQ ID NO:304), Ceres ANNOT ID no. 6029073 (SEQ ID NO:306), Ceres ANNOT ID no. 6011329 (SEQ ID NO:308), Ceres ANNOT ID no. 6034498 (SEQ ID NO:310), Ceres ANNOT ID no. 6095057 (SEQ ID NO:312), Ceres ANNOT ID no. 6095058 (SEQ ID NO:314), and sequences identified as functional homologs of the sequences of FIG. 3, as set forth in the sequence listing. In some cases, a functional homolog of SEQ ID NO:129 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:129.

Amino acid sequences of functional homologs of the polypeptide set forth in SEQ ID NO:317 are provided in FIG. 4. Such functional homologs include Ceres CLONE ID no. 1842125 (SEQ ID NO:319), Ceres ANNOT ID no. 1461360 (SEQ ID NO:321), Ceres CLONE ID no. 480906

(SEQ ID NO:327), Public GI ID no. 92889352 (SEQ ID NO:330), and Public GI ID no. 56201850 (SEQ ID NO:330). Other functional homologs of SEQ ID NO:317 include Ceres ANNOT ID no. 1440334 (SEQ ID NO:323), Ceres ANNOT ID no. 1493205 (SEQ ID NO:325), Ceres CLONE ID no. 482270 (SEQ ID NO:329), Public GI ID no. 125571531 (SEQ ID NO:332), Ceres ANNOT ID no. 6042411 (SEQ ID NO:334), and sequences identified as functional homologs of the sequences of FIG. 4, as set forth in the sequence listing. In some cases, a functional homolog of SEQ ID NO:317 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:317.

Figure 5:
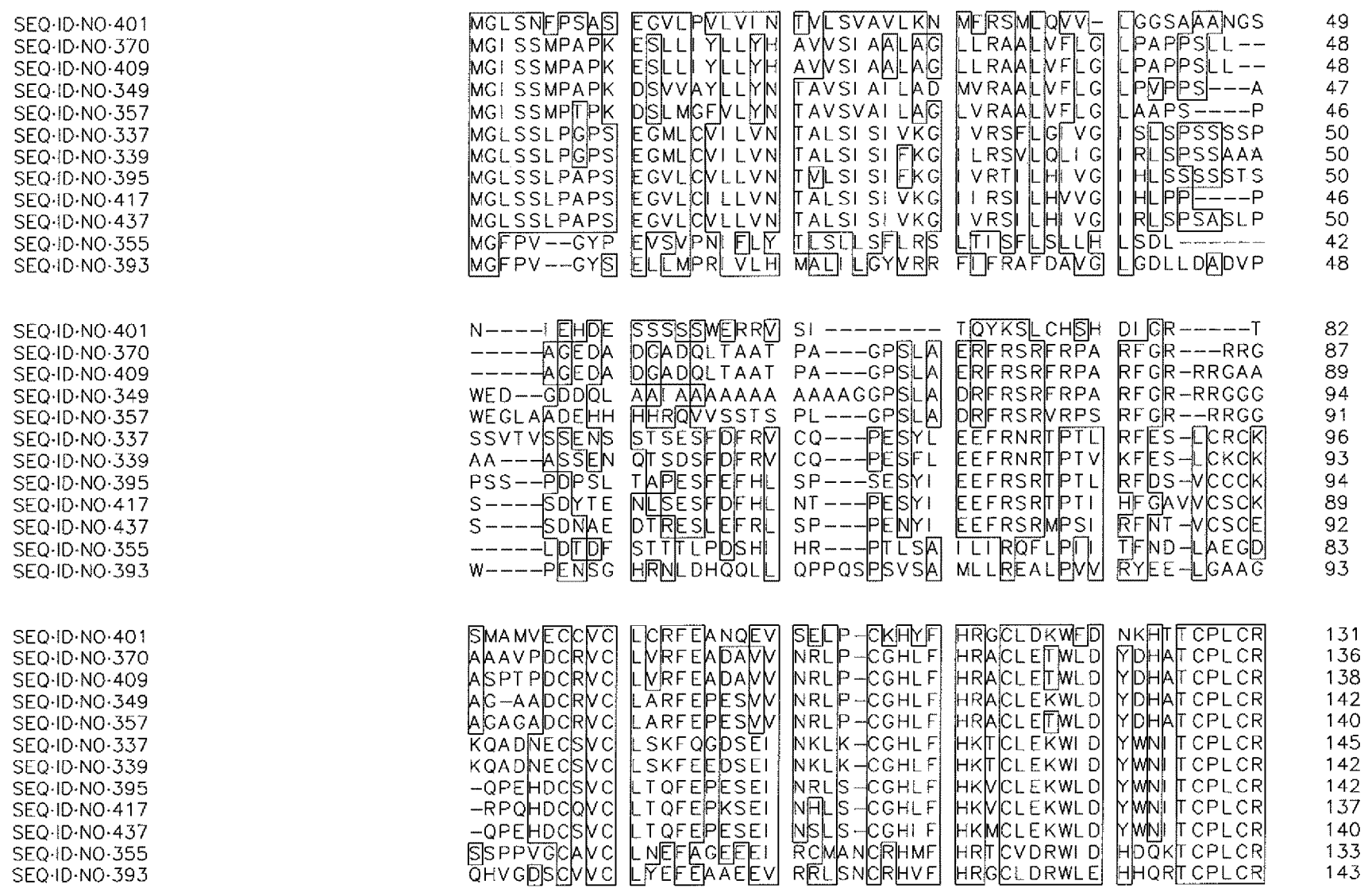

Amino acid sequences of functional homologs of the polypeptide set forth in SEQ ID NO:337 are provided in FIG. 5. Such functional homologs include Ceres CLONE ID no. 952050 (SEQ ID NO:339), Public GI ID no. 115477050 (SEQ ID NO:349), Public GI ID no. 87162911 (SEQ ID NO:355), Ceres CLONE ID no. 1790901 (SEQ ID NO:357), Ceres CLONE ID no. 1460088 (SEQ ID NO:370), Ceres CLONE ID no. 1734065 (SEQ ID NO:393), Ceres CLONE ID no. 473509 (SEQ ID NO:395), Ceres CLONE ID no. 849918 (SEQ ID NO:401), Ceres CLONE ID no. 633470 (SEQ ID NO:409), Ceres CLONE ID no. 1808334 (SEQ ID NO:417), and Ceres ANNOT ID no. 1525600 (SEQ ID NO:437). Other functional homologs of SEQ ID NO:337 include Ceres CLONE ID no. 1265097 (SEQ ID NO:341), Ceres CLONE ID no. 942980 (SEQ ID NO:343), Public GI ID no. 37901055 (SEQ ID NO:344), Ceres CLONE ID no. 1609912 (SEQ ID NO:346), Public GI ID no. 76446335 (SEQ ID NO:347), Public GI ID no. 125560204 (SEQ ID NO:348), Public GI ID no. 125303087 (SEQ ID NO:350), Public GI ID no. 115460088 (SEQ ID NO:351), Public GI ID no. 125591385 (SEQ ID NO:352), Public GI ID no. 115447931 (SEQ ID NO:353), Public GI ID no. 92893514 (SEQ ID NO:354), Ceres CLONE ID no. 2019320 (SEQ ID NO:359), Ceres CLONE ID no. 1890013 (SEQ ID NO:361), Public GI ID no. 20340241 (SEQ ID NO:362), Ceres CLONE ID no. 25801 (SEQ ID NO:364), Public GI ID no. 9743343 (SEQ ID NO:365), Public GI ID no. 15238072 (SEQ ID NO:366), Public GI ID no. 15222553 (SEQ ID NO:367), Public GI ID no. 21554155 (SEQ ID NO:368), Ceres CLONE ID no. 374439 (SEQ ID NO:372), Ceres CLONE ID no. 1465572 (SEQ ID NO:374), Ceres CLONE ID no. 1565524 (SEQ ID NO:376), Ceres CLONE ID no. 322302 (SEQ ID NO:378), Ceres CLONE ID no. 101136485 (SEQ ID NO:379), Ceres CLONE ID no. 1376133 (SEQ ID NO:381), Ceres CLONE ID no. 1374381 (SEQ ID NO:383), Ceres CLONE ID no. 1566473 (SEQ ID NO:385), Ceres CLONE ID no. 318088 (SEQ ID NO:387), Ceres CLONE ID no. 1452604 (SEQ ID NO:389), Ceres CLONE ID no. 337906 (SEQ ID NO:391), Ceres CLONE ID no. 1662513 (SEQ ID NO:397), Ceres CLONE ID no. 1662527 (SEQ ID NO:399), Ceres CLONE ID no. 571184 (SEQ ID NO:403), Ceres CLONE ID no. 665689 (SEQ ID NO:405), Ceres CLONE ID no. 1365853 (SEQ ID NO:407), Ceres CLONE ID no. 1052457 (SEQ ID NO:411), Ceres CLONE ID no. 579918 (SEQ ID NO:413), Ceres CLONE ID no. 863299 (SEQ ID NO:415), Ceres CLONE ID no. 1855611 (SEQ ID NO:419), Ceres CLONE ID no. 1845975 (SEQ ID NO:421), Ceres CLONE ID no. 1808298 (SEQ ID NO:423), Ceres CLONE ID no. 1841236 (SEQ ID NO:425), Ceres CLONE ID no. 1808269 (SEQ ID NO:427), Ceres CLONE ID no. 1850628 (SEQ ID NO:429), Ceres CLONE ID no. 1846911 (SEQ ID NO:431), Ceres CLONE ID no. 1916014 (SEQ ID NO:433), Ceres CLONE ID no. 1842594 (SEQ ID NO:435), Ceres ANNOT ID no. 1472192 (SEQ ID NO:439), Ceres ANNOT ID no. 1447489 (SEQ ID NO:441), Ceres ANNOT ID no. 1513000 (SEQ ID NO:443), Ceres ANNOT ID no. 1438658 (SEQ ID NO:445), Ceres ANNOT ID no. 1497255 (SEQ ID NO:447), Ceres ANNOT ID no. 6092104 (SEQ ID NO:449), Ceres ANNOT ID no. 6041700 (SEQ ID NO:451), Ceres ANNOT ID no. 6007297 (SEQ ID NO:453), and sequences identified as functional homologs of the sequences of FIG. 5, as set forth in the sequence listing. In some cases, a functional homolog of SEQ ID NO:337 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:337.

Figure 6:
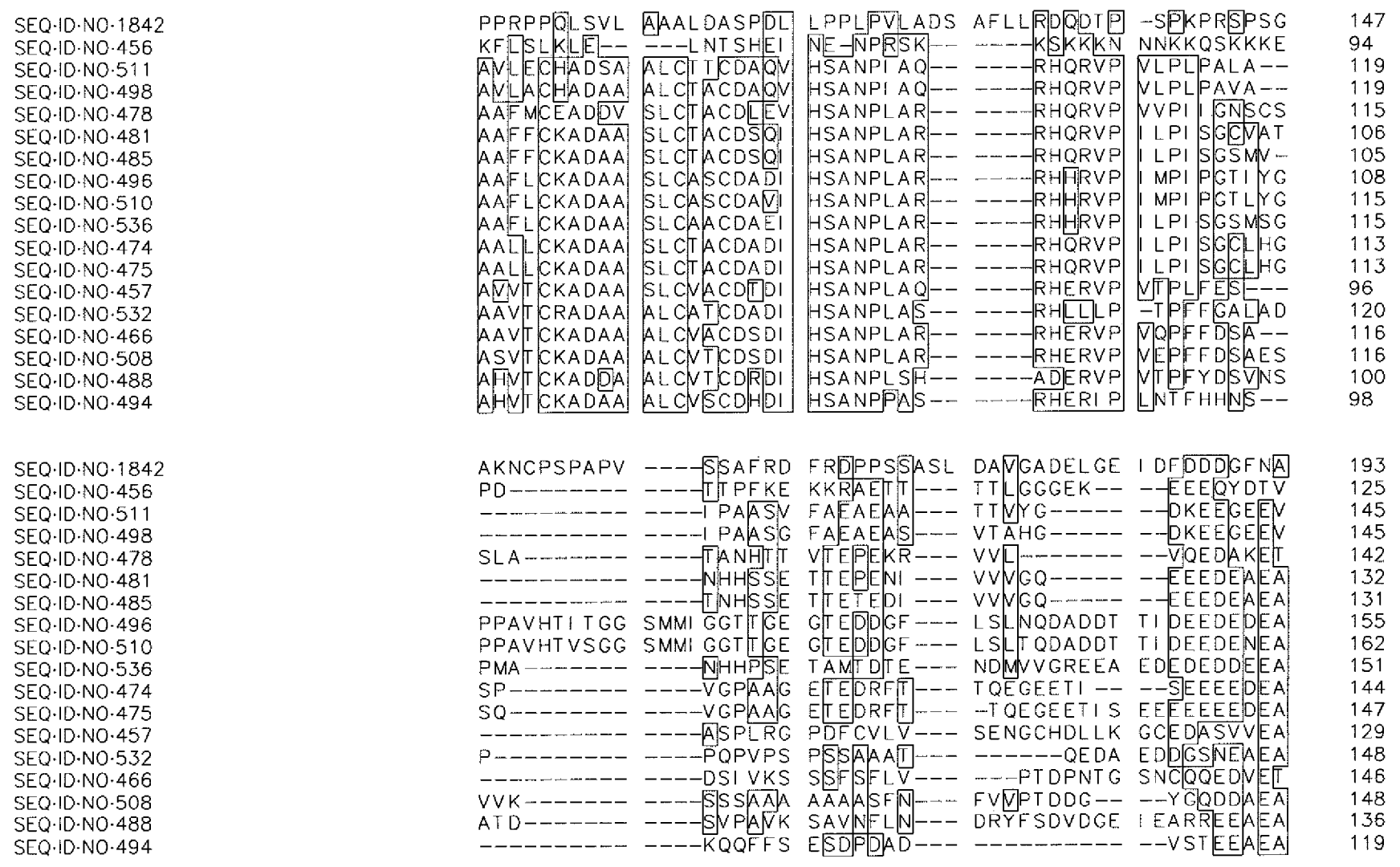
Figure 6:
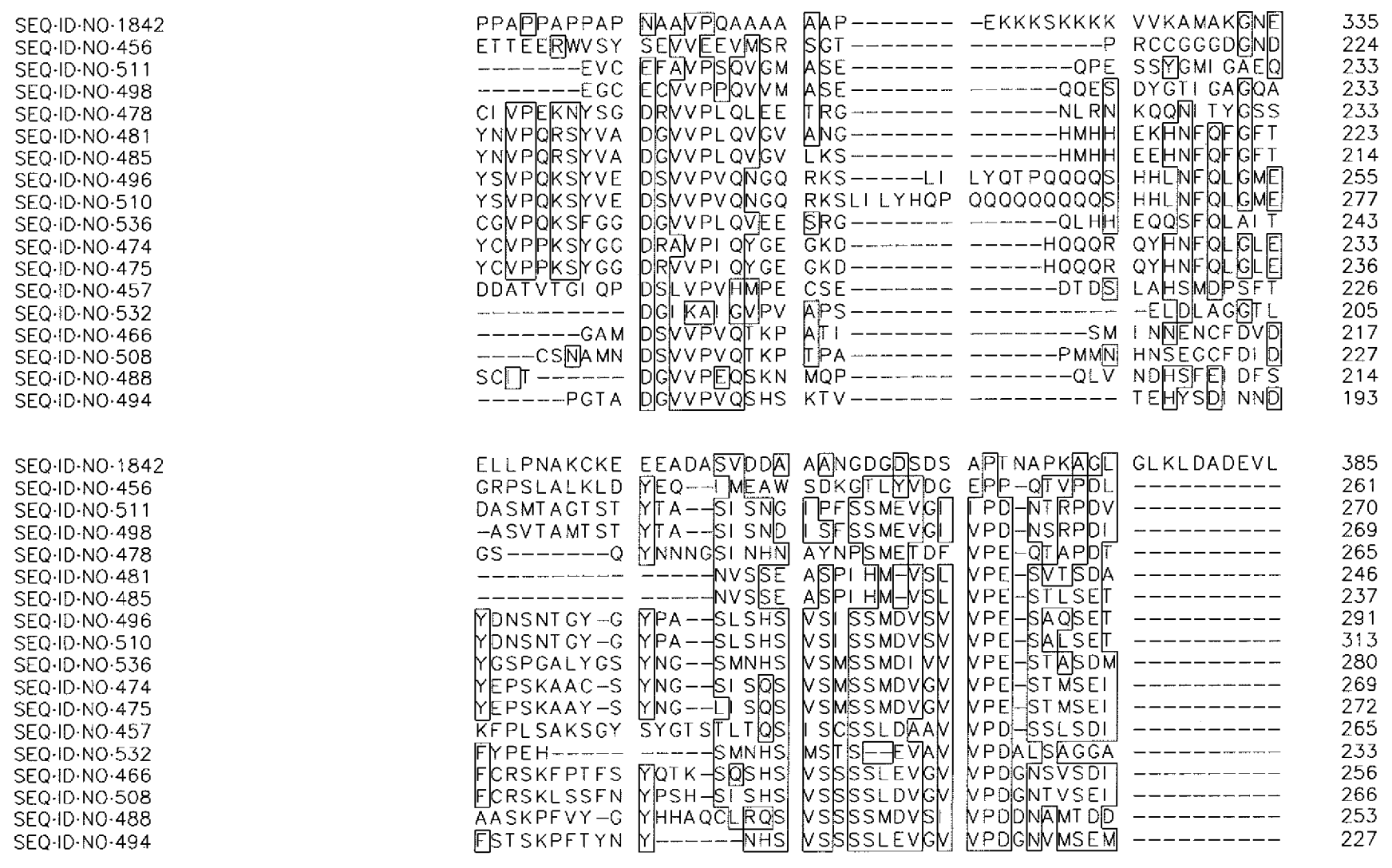

Amino acid sequences of functional homologs of the polypeptide set forth in SEQ ID NO:456 are provided in FIG. 6. Such functional homologs include Public GI ID no. 58430585 (SEQ ID NO:457), Ceres CLONE ID no. 1842825 (SEQ ID NO:466), Ceres ANNOT ID no. 1449721 (SEQ ID NO:474), Public GI ID no. 41323978 (SEQ ID NO:475), Public GI ID no. 2895186 (SEQ ID NO:478), Public GI ID no. 22854950 (SEQ ID NO:481), Public GI ID no. 116010474 (SEQ ID NO:485), Public GI ID no. 4091804 (SEQ ID NO:488), Public GI ID no. 60459257 (SEQ ID NO:494), Public GI ID no. 45544881 (SEQ ID NO:496), Public GI ID no. 36789802 (SEQ ID NO:498), Public GI ID no. 92875402 (SEQ ID NO:508), Public GI ID no. 118406898 (SEQ ID NO:510), Public GI ID no. 107770485 (SEQ ID NO:511), Public GI ID no. 21655154 (SEQ ID NO:532), Public GI ID no. 90657642 (SEQ ID NO:536), and Ceres CLONE ID no. 1569555 (SEQ ID NO:1842). Other homologs of SEQ ID NO:456 include Public GI ID no. 66841018 (SEQ ID NO:458), Public GI ID no. 66841020 (SEQ ID NO:459), Public GI ID no. 108859343 (SEQ ID NO:460), Ceres CLONE ID no. 1937613 (SEQ ID NO:462), Ceres CLONE ID no. 1834027 (SEQ ID NO:464), Ceres ANNOT ID no. 1477832 (SEQ ID NO:468), Ceres ANNOT ID no. 1482536 (SEQ ID NO:470), Ceres ANNOT ID no. 1478227 (SEQ ID NO:472), Ceres CLONE ID no. 19906 (SEQ ID NO:478), Public GI ID no. 2895184 (SEQ ID NO:479), Public GI ID no. 2895188 (SEQ ID NO:480), Public GI ID no. 11037313 (SEQ ID NO:482), Public GI ID no. 22854908 (SEQ ID NO:483), Public GI ID no. 40787165 (SEQ ID NO:484), Public GI ID no. 116010475 (SEQ ID NO:486), Public GI ID no. 3341723 (SEQ ID NO:487), Public GI ID no. 4091806 (SEQ ID NO:489), Ceres CLONE ID no. 523203 (SEQ ID NO:491), Ceres CLONE ID no. 463157 (SEQ ID NO:493), Public GI ID no. 61611678 (SEQ ID NO:495), Public GI ID no. 45544887 (SEQ ID NO:497), Public GI ID no. 36789793 (SEQ ID NO:481), Ceres CLONE ID no. 907473 (SEQ ID NO:501), Ceres CLONE ID no. 1674443 (SEQ ID NO:503), Ceres CLONE ID no. 1559496 (SEQ ID NO:505), Ceres CLONE ID no. 530984 (SEQ ID NO:507), Public GI ID no. 61611682 (SEQ ID NO:509), Public GI ID no. 36789785 (SEQ ID NO:512), Ceres CLONE ID no. 702632 (SEQ ID NO:514), Public GI ID no. 61657299 (SEQ ID NO:515), Public GI ID no. 10946337 (SEQ ID NO:516), Ceres CLONE ID no. 1996408 (SEQ ID NO:518), Ceres CLONE ID no. 1725313 (SEQ ID NO:520), Public GI ID no. 78058606 (SEQ ID NO:521), Public GI ID no. 125538317 (SEQ ID NO:522), Public GI ID no. 125556324 (SEQ ID NO:523), Public GI ID no. 125548890 (SEQ ID NO:524), Public GI ID no. 93211100 (SEQ ID NO:525), Public GI ID no. 115444217 (SEQ ID NO:526), Public GI ID no. 115467558 (SEQ ID NO:527), Public GI ID no. 11094209 (SEQ ID NO:528), Public GI ID no. 125596830 (SEQ ID NO:529), Public GI ID no. 115469296 (SEQ ID NO:530), Public GI ID no. 115447239 (SEQ ID NO:531), Public GI ID no. 21667485 (SEQ ID NO:533), Public GI ID no. 21667475 (SEQ ID NO:534), Public GI ID no. 21655158 (SEQ ID NO:535), and sequences identified as functional homologs of the sequences of FIG. 6, as set forth in the sequence listing. In some cases, a functional homolog of SEQ ID NO:456 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:456.

Amino acid sequences of functional homologs of the polypeptide set forth in SEQ ID NO:634 are provided in FIG. 7. Such functional homologs include Public GI ID no. 98961985 (SEQ ID NO:637). Other functional homologs of SEQ ID NO:634 include Ceres CLONE ID no. 1916112 (SEQ ID NO:636), Public GI ID no. 9369405 (SEQ ID NO:638), Public GI ID no. 9369406 (SEQ ID NO:639), Ceres CLONE ID no. 1238706 (SEQ ID NO:641), and sequences identified as functional homologs of the sequences of FIG. 7, as set forth in the sequence listing. In some cases, a functional homolog of SEQ ID NO:634 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:634.

Figure 8:
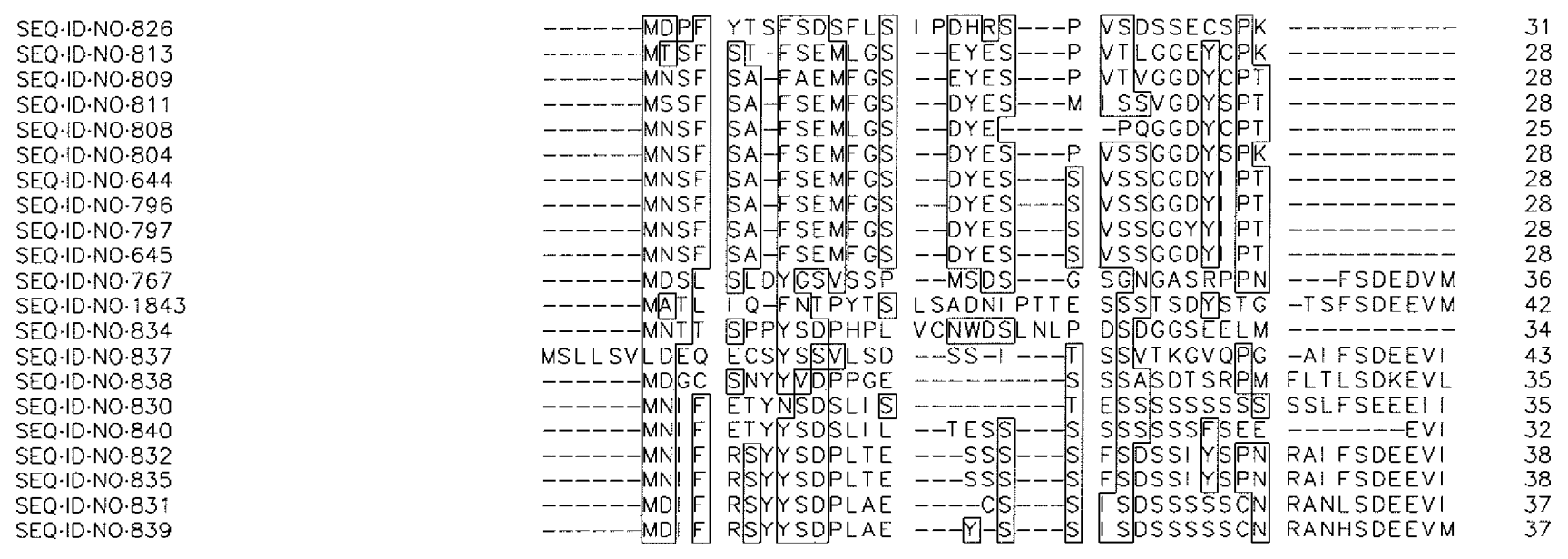
Figure 8:
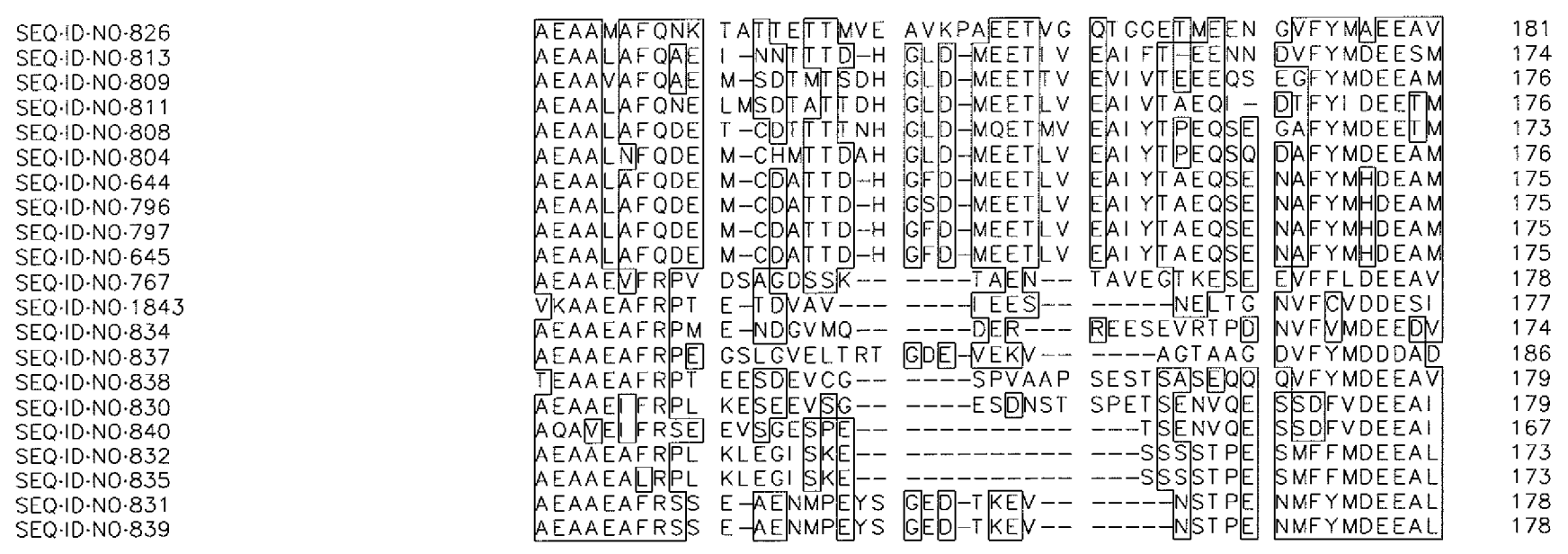

Amino acid sequences of functional homologs of the polypeptide set forth in SEQ ID NO:644 are provided in FIG. 8. Such functional homologs include SEQ ID NO:645, Ceres CLONE ID no. 1849479 (SEQ ID NO:767), Public GI ID no. 89275008 (SEQ ID NO:796), Public GI ID no. 120400525 (SEQ ID NO:797), Public GI ID no. 98980426 (SEQ ID NO:804), Public GI ID no. 71983373 (SEQ ID NO:808), Public GI ID no. 41351817 (SEQ ID NO:809), Public GI ID no. 76446191 (SEQ ID NO:811), Public GI ID no. 5616086 (SEQ ID NO:813), Ceres CLONE ID no. 1052602 (SEQ ID NO:826), Public GI ID no. 72068957 (SEQ ID NO:830), Public GI ID no. 71534113 (SEQ ID NO:831), Public GI ID no. 37147896 (SEQ ID NO:832), Public GI ID no. 92918850 (SEQ ID NO:834), Public GI ID no. 40647095 (SEQ ID NO:835), Ceres ANNOT ID no. 1527711 (SEQ ID NO:837), Public GI ID no. 71041116 (SEQ ID NO:838), Public GI ID no. 12003384 (SEQ ID NO:839), Public GI ID no. 18535580 (SEQ ID NO:840), and Public GI ID no. 115353971 (SEQ ID NO:1843). Other functional homologs of SEQ ID NO:644 include Ceres CLONE ID no. 991178 (SEQ ID NO:647), Ceres CLONE ID no. 1626038 (SEQ ID NO:649), Ceres CLONE ID no. 341615 (SEQ ID NO:651), Ceres CLONE ID no. 1832518 (SEQ ID NO:653), Ceres CLONE ID no. 1832588 (SEQ ID NO:655), Ceres CLONE ID no. 1936806 (SEQ ID NO:657), Ceres CLONE ID no. 973892 (SEQ ID NO:659), Ceres CLONE ID no. 565251 (SEQ ID NO:661), Ceres CLONE ID no. 681088 (SEQ ID NO:663), Ceres CLONE ID no. 707775 (SEQ ID NO:665), Ceres CLONE ID no. 453357 (SEQ ID NO:667), Ceres CLONE ID no. 1916958 (SEQ ID NO:669), Ceres CLONE ID no. 1940632 (SEQ ID NO:671), Ceres CLONE ID no. 476784 (SEQ ID NO:673), Ceres CLONE ID no. 1869284 (SEQ ID NO:675), Public GI ID no. 125540662 (SEQ ID NO:676), Ceres CLONE ID no. 1648272 (SEQ ID NO:678), Ceres CLONE ID no. 1987804 (SEQ ID NO:680), Ceres CLONE ID no. 1675695 (SEQ ID NO:682), Ceres CLONE ID no. 1169111 (SEQ ID NO:684), Ceres CLONE ID no. 572121 (SEQ ID NO:686), Ceres CLONE ID no. 1674836 (SEQ ID NO:688), Ceres ANNOT ID no. 1486207 (SEQ ID NO:690), Ceres CLONE ID no. 2023610 (SEQ ID NO:692), Ceres ANNOT ID no. 1496976 (SEQ ID NO:694), Public GI ID no. 116310031 (SEQ ID NO:695), Ceres CLONE ID no. 1626363 (SEQ ID NO:697), Ceres ANNOT ID no. 1483747 (SEQ ID NO:699), Ceres ANNOT ID no. 1471330 (SEQ ID NO:701), Ceres CLONE ID no. 101144964 (SEQ ID NO:702), Ceres ANNOT ID no. 1439439 (SEQ ID NO:704), Ceres CLONE ID no. 1446565 (SEQ ID NO:706), Ceres CLONE ID no. 1951962 (SEQ ID NO:708), Ceres CLONE ID no. 100960656 (SEQ ID NO:709), Ceres CLONE ID no. 285154 (SEQ ID NO:711), Public GI ID no. 61968916 (SEQ ID NO:712), Public GI ID no. 118026854 (SEQ ID NO:713), Public GI ID no. 63098612 (SEQ ID NO:714), Ceres ANNOT ID no. 1522310 (SEQ ID NO:716), Ceres CLONE ID no. 1854375 (SEQ ID NO:718), Ceres CLONE ID no. 709819 (SEQ ID NO:720), Public GI ID no. 115447695 (SEQ ID NO:721), Ceres CLONE ID no. 1726356 (SEQ ID NO:723), Ceres CLONE ID no. 1762419 (SEQ ID NO:725), Public GI ID no. 63098606 (SEQ ID NO:726), Ceres CLONE ID no. 1766572 (SEQ ID NO:728), Ceres CLONE ID no. 281871 (SEQ ID NO:730), Ceres CLONE ID no. 1560970 (SEQ ID NO:732), Ceres CLONE ID no. 1760747 (SEQ ID NO:734), Ceres ANNOT ID no. 1438772 (SEQ ID NO:736), Ceres ANNOT ID no. 1447378 (SEQ ID NO:738), Ceres ANNOT ID no. 1453360 (SEQ ID NO:740), Public GI ID no. 33637698 (SEQ ID NO:741), Public GI ID no. 118026860 (SEQ ID NO:742), Public GI ID no. 60116232 (SEQ ID NO:743), Public GI ID no.115477639 (SEQ ID NO:744), Public GI ID no.126567023 (SEQ ID NO:745), Ceres CLONE ID no.988971 (SEQ ID NO:747), Ceres CLONE ID no.1464521 (SEQ ID NO:749), Public GI ID no.63098610 (SEQ ID NO:750), Public GI ID no.126566972 (SEQ ID NO:751), Ceres CLONE ID no.1556129 (SEQ ID NO:753), Ceres CLONE ID no.1761385 (SEQ ID NO:755), Ceres ANNOT ID no.1488325 (SEQ ID NO:757), Ceres ANNOT ID no.1460483 (SEQ ID NO:759), Ceres CLONE ID no.1837825 (SEQ ID NO:761), Public GI ID no.27228310 (SEQ ID NO:762), Public GI ID no.117653881 (SEQ ID NO:763), Public GI ID no.115480233 (SEQ ID NO:764), Public GI ID no.37694048 (SEQ ID NO:765), Ceres CLONE ID no.1934653 (SEQ ID NO:769), Ceres CLONE ID no.1608106 (SEQ ID NO:771), Ceres CLONE ID no.1604576 (SEQ ID NO:773), Public GI ID no.55824656 (SEQ ID NO:774), Ceres CLONE ID no.1620272 (SEQ ID NO:776), Ceres CLONE ID no.1853170 (SEQ ID NO:778), Public GI ID no.79013962 (SEQ ID NO:779), Public GI ID no.98975385 (SEQ ID NO:780), Ceres ANNOT ID no.1438775 (SEQ ID NO:782), Public GI ID no.23495460 (SEQ ID NO:783), Public GI ID no.98975377 (SEQ ID NO:784), Ceres ANNOT ID no.1438776 (SEQ ID NO:786), Ceres CLONE ID no.1853601 (SEQ ID NO:788), Ceres CLONE ID no.1609048 (SEQ ID NO:790), Ceres CLONE ID no.322305 (SEQ ID NO:792), Ceres CLONE ID no.1823713 (SEQ ID NO:794), Public GI ID no.3660548 (SEQ ID NO:795), Public GI ID no.56154991 (SEQ ID NO:798), Public GI ID no.2980802 (SEQ ID NO:799), Public GI ID no.7269398 (SEQ ID NO:800), Public GI ID no.18416557 (SEQ ID NO:801), Public GI ID no.56154992 (SEQ ID NO:802), Public GI ID no.4091984 (SEQ ID NO:803), Public GI ID no.1899058 (SEQ ID NO:805), Public GI ID no.56154990 (SEQ ID NO:806), Public GI ID no.18416562 (SEQ ID NO:807), Public GI ID no.38683266 (SEQ ID NO:810), Public GI ID no.39983638 (SEQ ID NO:812), Public GI ID no.38426954 (SEQ ID NO:814), Public GI ID no.38426948 (SEQ ID NO:815), Public GI ID no.38146944 (SEQ ID NO:816), Public GI ID no.38426952 (SEQ ID NO:817), Public GI ID no.20303011 (SEQ ID NO:818), Public GI ID no.66269982 (SEQ ID NO:819), Public GI ID no.89212816 (SEQ ID NO:820), Public GI ID no.20303015 (SEQ ID NO:821), Public GI ID no.38426950 (SEQ ID NO:822), Public GI ID no.15242244 (SEQ ID NO:823), Public GI ID no.116831599 (SEQ ID NO:824), Public GI ID no.66269671 (SEQ ID NO:827), Ceres ANNOT ID no.1468919 (SEQ ID NO:829), Public GI ID no.57903606 (SEQ ID NO:833), Public GI ID no.45826358 (SEQ ID NO:841), Ceres ANNOT ID no.6085912 (SEQ ID NO:843), Ceres ANNOT ID no.6026171 (SEQ ID NO:845), Ceres ANNOT ID no.6031706 (SEQ ID NO:847), and sequences listing identified as functional homologs of the sequences of FIG. 8, as set forth in the sequence. In some cases, a functional homolog of SEQ ID NO:644 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:644.

Amino acid sequences of functional homologs of the polypeptide set forth in SEQ ID NO:850 are provided in FIG. 9. Such functional homologs include Ceres CLONE ID no.1833093 (SEQ ID NO:853), Ceres ANNOT ID no.1502190 (SEQ ID NO:857), Ceres CLONE ID no.565641 (SEQ ID NO:876), Public GI ID no.87240507 (SEQ ID NO:877), Ceres CLONE ID no.1325382 (SEQ ID NO:881), Ceres CLONE ID no.1558265 (SEQ ID NO:885), Ceres CLONE ID no.1823669 (SEQ ID NO:895), and Public GI ID no.115464921 (SEQ ID NO:898). Other functional homologs of SEQ ID NO:850 include Ceres CLONE ID no.100040598 (SEQ ID NO:851), Ceres CLONE ID no.1847967 (SEQ ID NO:855), Ceres ANNOT ID no.1449186 (SEQ ID NO:859), Ceres ANNOT ID no.1466723 (SEQ ID NO:861), Public GI ID no.21805688 (SEQ ID NO:862), Public GI ID no.9795609 (SEQ ID NO:863), Public GI ID no.13877535 (SEQ ID NO:864), Public GI ID no.15232547 (SEQ ID NO:865), Public GI ID no.15238851 (SEQ ID NO:866), Ceres CLONE ID no.123863 (SEQ ID NO:868), Ceres CLONE ID no.652496 (SEQ ID NO:870), Ceres CLONE ID no.1656707 (SEQ ID NO:872), Ceres CLONE ID no.1660346 (SEQ ID NO:874), Ceres CLONE ID no.678878 (SEQ ID NO:879), Ceres CLONE ID no.340102 (SEQ ID NO:883), Ceres CLONE ID no.330491 (SEQ ID NO:887), Ceres CLONE ID no.992304 (SEQ ID NO:889), Ceres CLONE ID no.1509925 (SEQ ID NO:891), Ceres CLONE ID no.1543852 (SEQ ID NO:893), Ceres CLONE ID no.1785736 (SEQ ID NO:897), Ceres ANNOT ID no.6079909 (SEQ ID NO:900), Ceres ANNOT ID no.6040353 (SEQ ID NO:902), Ceres ANNOT ID no.6100173 (SEQ ID NO:904), and sequences listing identified as functional homologs of the sequences of FIG. 9, as set forth in the sequence. In some cases, a functional homolog of SEQ ID NO:850 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:850.

Figure 10:
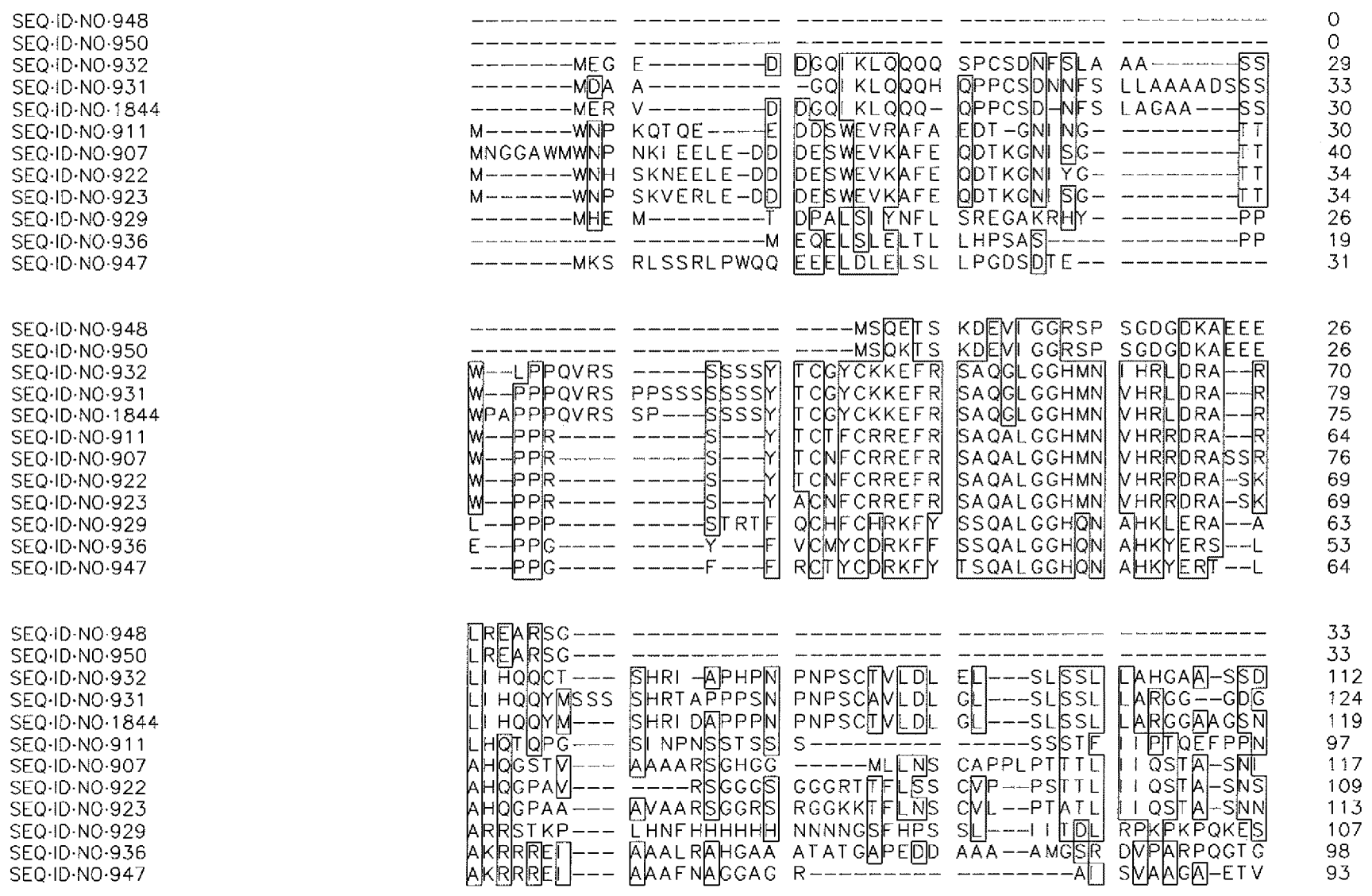

Amino acid sequences of functional homologs of the polypeptide set forth in SEQ ID NO:907 are provided in FIG. 10. Such functional homologs include Ceres CLONE ID no.1940797 (SEQ ID NO:909), Ceres ANNOT ID no.1538900 (SEQ ID NO:911), Ceres CLONE ID no.1126868 (SEQ ID NO:922), Public GI ID no.89257684 (SEQ ID NO:923), Public GI ID no.124360460 (SEQ ID NO:929), Public GI ID no.62865694 (SEQ ID NO:931), Public GI ID no.62865692 (SEQ ID NO:932), Ceres CLONE ID no.260368 (SEQ ID NO:936), Ceres CLONE ID no.1873510 (SEQ ID NO:947), Public GI ID no.125541662 (SEQ ID NO:948), Public GI ID no.48716268 (SEQ ID NO:950), and Public GI ID no. 62865696 (SEQ ID NO:1844). Other functional homologs of SEQ ID NO:907 include Ceres ANNOT ID no.1529131 (SEQ ID NO:913), Ceres ANNOT ID no.1454060 (SEQ ID NO:915), Ceres ANNOT ID no.1442787 (SEQ ID NO:917), Ceres ANNOT ID no.1452648 (SEQ ID NO:919), Public GI ID no.2245140 (SEQ ID NO:920), Public GI ID no.89274212 (SEQ ID NO:924), Ceres CLONE ID no.1104523 (SEQ ID NO:926), Ceres CLONE ID no.654265 (SEQ ID NO:928), Public GI ID no.42627704 (SEQ ID NO:930), Ceres CLONE ID no.887222 (SEQ ID NO:934), Public GI ID no.62865690 (SEQ ID NO:937), Public GI ID no.64175600 (SEQ ID NO:938), Public GI ID no.64175634 (SEQ ID NO:939), Public GI ID no.64175606 (SEQ ID NO:940), Public GI ID no.64175648 (SEQ ID NO:941), Ceres CLONE ID no.312184 (SEQ ID NO:943), Ceres CLONE ID no.380740 (SEQ ID NO:945), Public GI ID no.125531536 (SEQ ID NO:949), and sequences identified as functional homologs of the sequences of FIG. 10, as set forth in the sequence listing. In some cases, a functional homolog of SEQ ID NO:907 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:907.

Amino acid sequences of functional homologs of the polypeptide set forth in SEQ ID NO:953 are provided in FIG. 11. Such functional homologs include Ceres CLONE ID no.1798705 (SEQ ID NO:955), Ceres ANNOT ID no.1458907 (SEQ ID NO:963), Ceres CLONE ID no.1090409 (SEQ ID NO:971), Ceres CLONE ID no.479817 (SEQ ID NO:977), Ceres CLONE ID no.1041793 (SEQ ID NO:979), Ceres CLONE ID no.684633 (SEQ ID NO:985), Ceres CLONE ID no.371815 (SEQ ID NO:991), Ceres CLONE ID no.1686460 (SEQ ID NO:993), Ceres CLONE ID no.1448595 (SEQ ID NO:995), Ceres CLONE ID no.1734477 (SEQ ID NO:999), Ceres CLONE ID no.1605693 (SEQ ID NO:1005), Ceres CLONE ID no.1757400 (SEQ ID NO:1009), and Public GI ID no.115434334 (SEQ ID NO:1015). Other functional homologs of SEQ ID NO:953 include Ceres CLONE ID no.1793754 (SEQ ID NO:957), Ceres CLONE ID no.1938045 (SEQ ID NO:959), Ceres CLONE ID no.1850004 (SEQ ID NO:961), Ceres ANNOT ID no.1489548 (SEQ ID NO:965), Public GI ID no.22329538 (SEQ ID NO:966), Public GI ID no.18404714 (SEQ ID NO:967), Ceres CLONE ID no.1110032 (SEQ ID NO:969), Ceres CLONE ID no.1095353 (SEQ ID NO:973), Ceres CLONE ID no.872121 (SEQ ID NO:975), Ceres CLONE ID no.562208 (SEQ ID NO:981), Ceres CLONE ID no.1042364 (SEQ ID NO:983), Ceres CLONE ID no.1031873 (SEQ ID NO:987), Ceres CLONE ID no.1377698 (SEQ ID NO:989), Ceres CLONE ID no.1742945 (SEQ ID NO:997), Ceres CLONE ID no.1742053 (SEQ ID NO:1001), Ceres CLONE ID no.1728365 (SEQ ID NO:1003), Ceres CLONE ID no.1609807 (SEQ ID NO:1007), Ceres CLONE ID no.1778566 (SEQ ID NO:1011), Ceres CLONE ID no.2020580 (SEQ ID NO:1013), Public GI ID no.125524285 (SEQ ID NO:1014), Public GI ID no.125568898 (SEQ ID NO:1016), Ceres ANNOT ID no.6055303 (SEQ ID NO:1018), and sequences identified as functional homologs of the sequences of FIG. 11, as set forth in the sequence listing. In some cases, a functional homolog of SEQ ID NO:953 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:953.

Amino acid sequences of functional homologs of the polypeptide set forth in SEQ ID NO:1024 are provided in FIG. 12. Such functional homologs include Ceres ANNOT ID no.1452905 (SEQ ID NO:1029), Ceres CLONE ID no.956176 (SEQ ID NO:1039), Public GI ID no.92870366 (SEQ ID NO:1040), Ceres CLONE ID no.294166 (SEQ ID NO:1042), and Public GI ID no.125543067 (SEQ ID NO:1043). Other functional homologs of SEQ ID NO:1024 include SEQ ID NO:1025, Ceres ANNOT ID no.1442522 (SEQ ID NO:1027), Public GI ID no.8778818 (SEQ ID NO:1030), Ceres CLONE ID no.108095 (SEQ ID NO:1032), Public GI ID no.18394821 (SEQ ID NO:1033), Ceres CLONE ID no.6332 (SEQ ID NO:1035), Ceres CLONE ID no.1069047 (SEQ ID NO:1037), Public GI ID no.115480956 (SEQ ID NO:1044), and sequences identified as functional homologs of the sequences of FIG. 12, as set forth in the sequence listing. In some cases, a functional homolog of SEQ ID NO:1024 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1024.

Amino acid sequences of functional homologs of the polypeptide set forth in SEQ ID NO:1047 are provided in FIG. 13. Such functional homologs include Ceres CLONE ID no.1837694 (SEQ ID NO:1053), Ceres ANNOT ID no.1483367 (SEQ ID NO:1057), Ceres CLONE ID no.1077781 (SEQ ID NO:1083), Ceres CLONE ID no.471026 (SEQ ID NO:1085), Public GI ID no.92888885 (SEQ ID NO:1099), Public GI ID no.45544873 (SEQ ID NO:1100), Public GI ID no.45758663 (SEQ ID NO:1101), Ceres CLONE ID no.772927 (SEQ ID NO:1105), Ceres CLONE ID no.895080 (SEQ ID NO:1111), Ceres CLONE ID no.1806128 (SEQ ID NO:1131), Public GI ID no.115458192 (SEQ ID NO:1134), and Public GI ID no.82470795 (SEQ ID NO:1139). Other functional homologs of SEQ ID NO:1047 include Ceres CLONE ID no.1837746 (SEQ ID NO:1049), Ceres CLONE ID no.1834764 (SEQ ID NO:1051), Ceres CLONE ID no.1853547 (SEQ ID NO:1055), Ceres ANNOT ID no.1474088 (SEQ ID NO:1059), Ceres ANNOT ID no.1536919 (SEQ ID NO:1061), Ceres ANNOT ID no.1467033 (SEQ ID NO:1063), Ceres ANNOT ID no.1485401 (SEQ ID NO:1065), Ceres ANNOT ID no.1486505 (SEQ ID NO:1067), Public GI ID no.17065054 (SEQ ID NO:1068), Public GI ID no.30694690 (SEQ ID NO:1069), Ceres CLONE ID no.12997 (SEQ ID NO:1071), Public GI ID no.30694694 (SEQ ID NO:1072), Public GI ID no.42572167 (SEQ ID NO:1073), Public GI ID no.110739742 (SEQ ID NO:1074), Public GI ID no.18412263 (SEQ ID NO:1075), Ceres CLONE ID no.36412 (SEQ ID NO:1077), Public GI ID no.18399792 (SEQ ID NO:1078), Ceres CLONE ID no.924 (SEQ ID NO:1080), Public GI ID no.15238000 (SEQ ID NO:1081), Ceres CLONE ID no.1626330 (SEQ ID NO:1087), Ceres CLONE ID no.1650419 (SEQ ID NO:1089), Ceres CLONE ID no.1641329 (SEQ ID NO:1091), Ceres CLONE ID no.1620406 (SEQ ID NO:1093), Ceres CLONE ID no.546832 (SEQ ID NO:1095), Ceres CLONE ID no.1243138 (SEQ ID NO:1097), Public GI ID no.92887260 (SEQ ID NO:1098), Ceres CLONE ID no.885628 (SEQ ID NO:1103), Ceres CLONE ID no.1376391 (SEQ ID NO:1107), Ceres CLONE ID no.465893 (SEQ ID NO:1109), Ceres CLONE ID no.218243 (SEQ ID NO:1113), Ceres CLONE ID no.1558456 (SEQ ID NO:1115), Ceres CLONE ID no.343008 (SEQ ID NO:1117), Ceres CLONE ID no.218463 (SEQ ID NO:1119), Ceres CLONE ID no.1565409 (SEQ ID NO:1121), Ceres CLONE ID no.1060968 (SEQ ID NO:1123), Ceres CLONE ID no.236111 (SEQ ID NO:1125), Ceres CLONE ID no.285598 (SEQ ID NO:1127), Ceres CLONE ID no.225881 (SEQ ID NO:1129), Ceres CLONE ID no.1811383 (SEQ ID NO:1133), Public GI ID no.49388268 (SEQ ID NO:1135), Public GI ID no.125590268 (SEQ ID NO:1136), Public GI ID no.115444009 (SEQ ID NO:1137), Public GI ID no.115447993 (SEQ ID NO:1138), Ceres ANNOT ID no.6033842 (SEQ ID NO:1141), Ceres ANNOT ID no.6029952 (SEQ ID NO:1143), Ceres ANNOT ID no.6035837 (SEQ ID NO:1145), Ceres ANNOT ID no.6035830 (SEQ ID NO:1147), Ceres ANNOT ID no.6029981 (SEQ ID NO:1149), and sequences identified as functional homologs of the sequences of FIG. 13, as set forth in the sequence listing. In some cases, a functional homolog of SEQ ID NO:1047 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1047.

Figure 14:
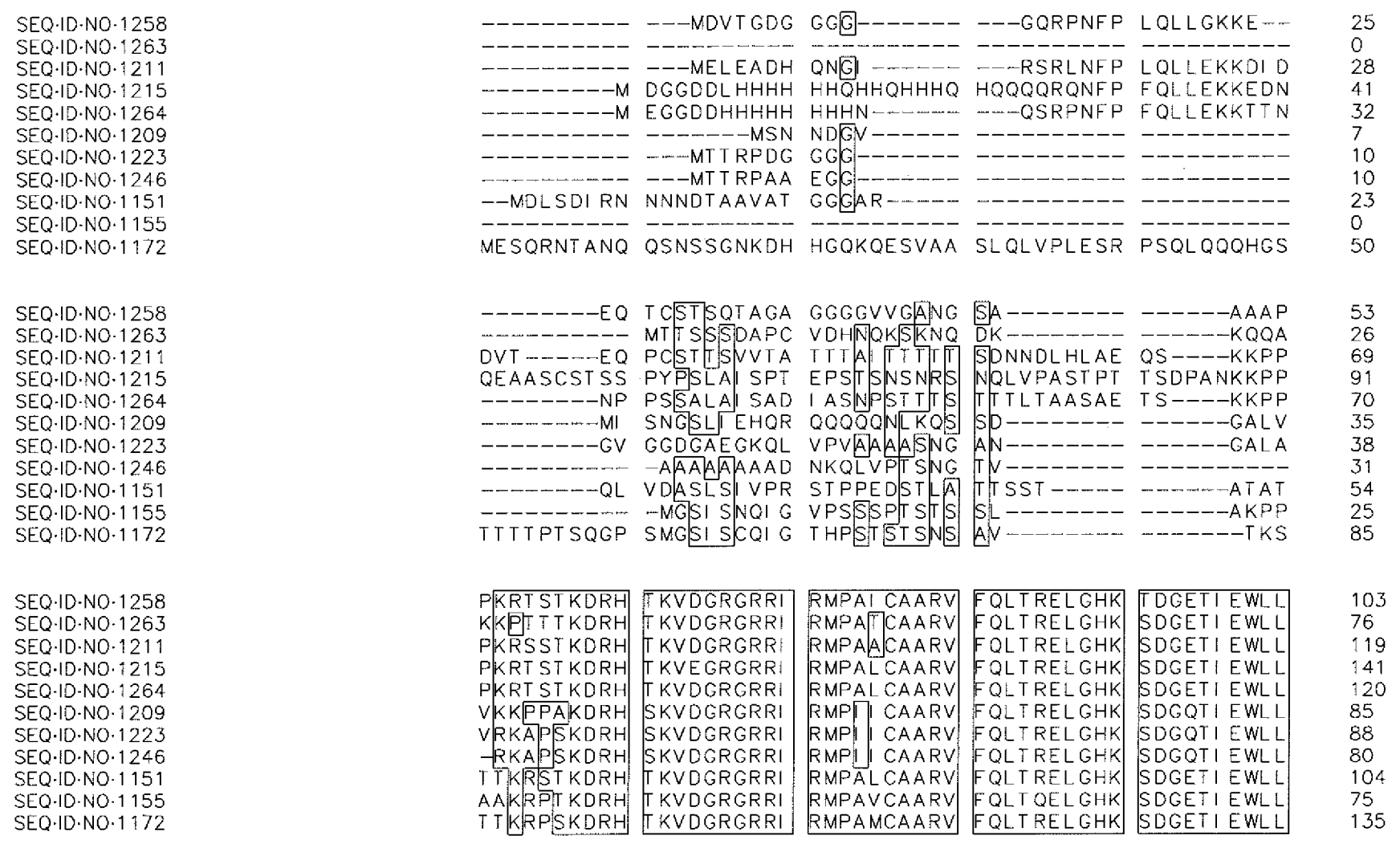

Amino acid sequences of functional homologs of the polypeptide set forth in SEQ ID NO:1151 are provided in FIG. 14. Such functional homologs include Ceres CLONE ID no.1851526 (SEQ ID NO:1155), Ceres ANNOT ID no.1486769 (SEQ ID NO:1172), Public GI ID no.83032232 (SEQ ID NO:1209), Ceres CLONE ID no.1620420 (SEQ ID NO:1211), Public GI ID no.92892428 (SEQ ID NO:1215), Ceres CLONE ID no.884742 (SEQ ID NO:1223), Ceres CLONE ID no.1821559 (SEQ ID NO:1246), Public GI ID no.51535021 (SEQ ID NO:1258), Public GI ID no.113205304 (SEQ ID NO:1263), and Public GI ID no.37719051 (SEQ ID NO:1264). Other functional homologs of SEQ ID NO:1151 include Ceres CLONE ID no.1918070 (SEQ ID NO:1153), Ceres CLONE ID no.1948426 (SEQ ID NO:1157), Ceres CLONE ID no.1937875 (SEQ ID NO:1159), Ceres CLONE ID no.100056542 (SEQ ID NO:1160), Public GI ID no.5731257 (SEQ ID NO:1161), Ceres CLONE ID no.100058043 (SEQ ID NO:1162), Ceres CLONE ID no.1838288 (SEQ ID NO:1164), Ceres CLONE ID no.1793597 (SEQ ID NO:1166), Ceres ANNOT ID no.1543031 (SEQ ID NO:1168), Ceres ANNOT ID no.1489643 (SEQ ID NO:1170), Ceres ANNOT ID no.1479721 (SEQ ID NO:1174), Ceres ANNOT ID no.1449170 (SEQ ID NO:1176), Ceres ANNOT ID no.1493696 (SEQ ID NO:1178), Ceres ANNOT ID no.1543534 (SEQ ID NO:1180), Ceres ANNOT ID no.1440815 (SEQ ID NO:1182), Ceres ANNOT ID no.1490137 (SEQ ID NO:1184), Ceres ANNOT ID no.1451054 (SEQ ID NO:1186), Ceres ANNOT ID no.1456669 (SEQ ID NO:1188), Ceres ANNOT ID no.1509865 (SEQ ID NO:1190), Ceres ANNOT ID no.1447910 (SEQ ID NO:1192), Ceres ANNOT ID no.1471068 (SEQ ID NO:1194), Ceres ANNOT ID no.1504118 (SEQ ID NO:1196), Ceres CLONE ID no.1343621 (SEQ ID NO:1198), Public GI ID no.15218305 (SEQ ID NO:1199), Public GI ID no.15219640 (SEQ ID NO:1200), Public GI ID no.18409345 (SEQ ID NO:1201), Public GI ID no.6522545 (SEQ ID NO:1202), Public GI ID no.15237274 (SEQ ID NO:1203), Public GI ID no.26452377 (SEQ ID NO:1204), Ceres CLONE ID no.33629 (SEQ ID NO:1206), Ceres CLONE ID no.1064407 (SEQ ID NO:1208), Ceres CLONE ID no.1656310 (SEQ ID NO:1213), Public GI ID no.92885257 (SEQ ID NO:1214), Public GI ID no.92868571 (SEQ ID NO:1216), Public GI ID no.53689778 (SEQ ID NO:1217), Ceres CLONE ID no.835598 (SEQ ID NO:1219), Ceres CLONE ID no.575649 (SEQ ID NO:1221), Ceres CLONE ID no.376567 (SEQ ID NO:1225), Ceres CLONE ID no.1284191 (SEQ ID NO:1227), Ceres CLONE ID no.367175 (SEQ ID NO:1229), Ceres CLONE ID no.100748296 (SEQ ID NO:1230), Ceres CLONE ID no.1597176 (SEQ ID NO:1232), Ceres CLONE ID no.375636 (SEQ ID NO:1234), Ceres CLONE ID no.288123 (SEQ ID NO:1236), Ceres CLONE ID no.303582 (SEQ ID NO:1238), Ceres CLONE ID no.1604759 (SEQ ID NO:1240), Ceres CLONE ID no.1955192 (SEQ ID NO:1242), Ceres CLONE ID no.2008687 (SEQ ID NO:1244), Ceres CLONE ID no.1995843 (SEQ ID NO:1248), Ceres CLONE ID no.2008591 (SEQ ID NO:1250), Ceres CLONE ID no.2046826 (SEQ ID NO:1252), Ceres CLONE ID no.1985573 (SEQ ID NO:1254), Public GI ID no.125541129 (SEQ ID NO:1255), Public GI ID no.125528922 (SEQ ID NO:1256), Public GI ID no.115487590 (SEQ ID NO:1257), Public GI ID no.115448671 (SEQ ID NO:1259), Public GI ID no.125596564 (SEQ ID NO:1260), Public GI ID no.125573161 (SEQ ID NO:1261), Public GI ID no.48716463 (SEQ ID NO:1262), Ceres ANNOT ID no.6054246 (SEQ ID NO:1266), Ceres ANNOT ID no.6086570 (SEQ ID NO:1268), Ceres ANNOT ID no.6024957 (SEQ ID NO:1270), Ceres ANNOT ID no.6016867 (SEQ ID NO:1272), Ceres ANNOT ID no.6091369 (SEQ ID NO:1274), and sequences identified as functional homologs of the sequences of FIG. 14, as set forth in the sequence listing. In some cases, a functional homolog of SEQ ID NO:1151 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1151.

Figure 15:
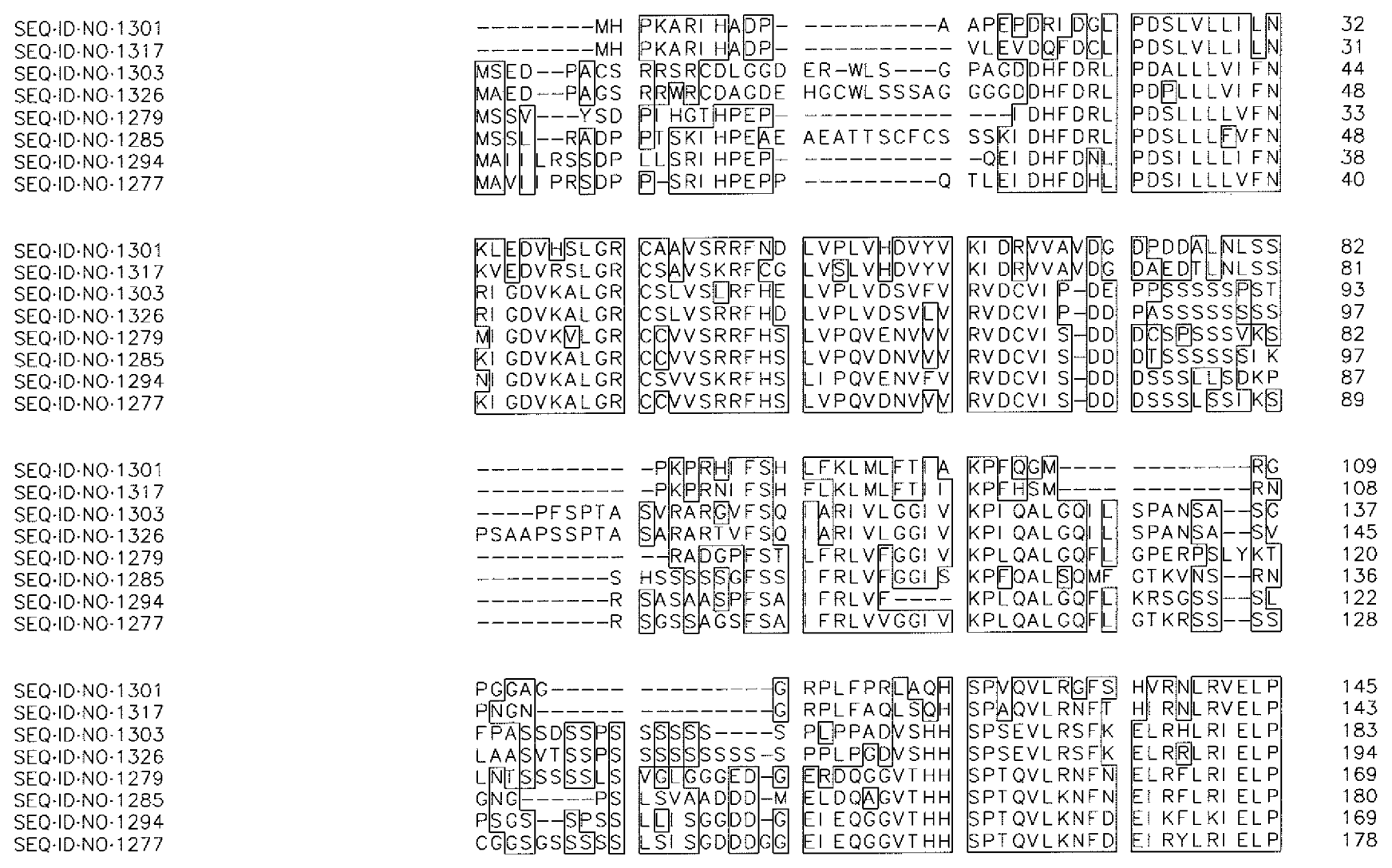

Amino acid sequences of functional homologs of the polypeptide set forth in SEQ ID NO:1277 are provided in FIG. 15. Such functional homologs include Ceres CLONE ID no.1926352 (SEQ ID NO:1279), Ceres ANNOT ID no.1448905 (SEQ ID NO:1285), Public GI ID no.15236865 (SEQ ID NO:1294), Ceres CLONE ID no.934771 (SEQ ID NO:1301), Ceres CLONE ID no.338386 (SEQ ID NO:1303), Ceres CLONE ID no.1780691 (SEQ ID NO:1317), and Public GI ID no.115464819 (SEQ ID NO:1326). Other functional homologs of SEQ ID NO:1277 include Ceres CLONE ID no.1848576 (SEQ ID NO:1281), Ceres CLONE ID no.1981528 (SEQ ID NO:1283), Ceres ANNOT ID no.1465978 (SEQ ID NO:1287), Ceres ANNOT ID no.1504997 (SEQ ID NO:1289), Ceres ANNOT ID no.1451909 (SEQ ID NO:1291), Ceres ANNOT ID no.1461635 (SEQ ID NO:1293), Public GI ID no.18397400 (SEQ ID NO:1295), Ceres CLONE ID no.16226 (SEQ ID NO:1297), Public GI ID no.18411823 (SEQ ID NO:1298), Public GI ID no.15219845 (SEQ ID NO:1299), Ceres CLONE ID no.1276710 (SEQ ID NO:1305), Ceres CLONE ID no.1479310 (SEQ ID NO:1307), Ceres CLONE ID no.376230 (SEQ ID NO:1309), Ceres CLONE ID no.1290713 (SEQ ID NO:1311), Ceres CLONE ID no.321681 (SEQ ID NO:1313), Ceres CLONE ID no.1869072 (SEQ ID NO:1315), Ceres CLONE ID no.1818502 (SEQ ID NO:1319), Ceres CLONE ID no.1750477 (SEQ ID NO:1321), Public GI ID no.125552947 (SEQ ID NO:1322), Public GI ID no.125527862 (SEQ ID NO:1323), Public GI ID no.125543660 (SEQ ID NO:1324), Public GI ID no.125528123 (SEQ ID NO:1325), Public GI ID no.115440195 (SEQ ID NO:1327), Public GI ID no.115452717 (SEQ ID NO:1328), Public GI ID no.115440629 (SEQ ID NO:1329), Public GI ID no.115464599 (SEQ ID NO:1330), Public GI ID no.20161462 (SEQ ID NO:1331), Public GI ID no.125586076 (SEQ ID NO:1332), Ceres CLONE ID no.1823216 (SEQ ID NO:1334), Ceres ANNOT ID no.6040230 (SEQ ID NO:1336), Ceres ANNOT ID no.6015489 (SEQ ID NO:1338), Ceres ANNOT ID no.6042890 (SEQ ID NO:1340), Ceres ANNOT ID no.6040033 (SEQ ID NO:1342), Ceres ANNOT ID no.6018414 (SEQ ID NO:1344), and sequences identified as functional homologs of the sequences of FIG. 15, as set forth in the sequence listing. In some cases, a functional homolog of SEQ ID NO:1277 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1277.

Figure 16:
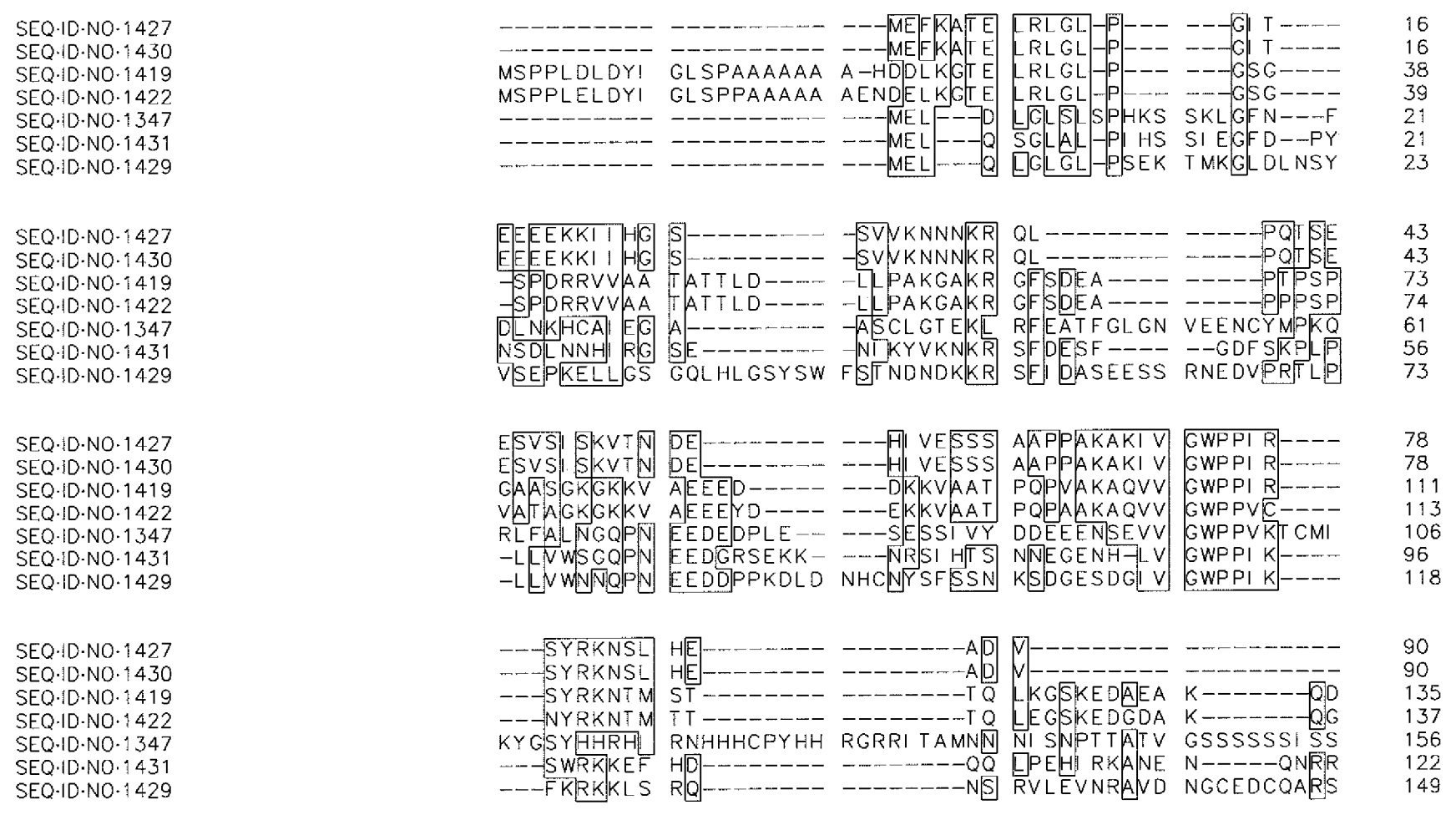

Amino acid sequences of functional homologs of the polypeptide set forth in SEQ ID NO:1347 are provided in FIG. 16. Such functional homologs include Ceres CLONE ID no.285028 (SEQ ID NO:1419), Ceres CLONE ID no.100969565 (SEQ ID NO:1422), Public GI ID no.1352057 (SEQ ID NO:1427), Ceres ANNOT ID no.1453784 (SEQ ID NO:1429), Public GI ID no.452777 (SEQ ID NO:1430), and Public GI ID no.92873297 (SEQ ID NO:1431). Other functional homologs of SEQ ID NO:1347 include Ceres ANNOT ID no.1452612 (SEQ ID NO:1349), Ceres CLONE ID no.520455 (SEQ ID NO:1351), Public GI ID no.75271810 (SEQ ID NO:1352), Public GI ID no.115489446 (SEQ ID NO:1353), Ceres CLONE ID no.499878 (SEQ ID NO:1355), Ceres ANNOT ID no.1491840 (SEQ ID NO:1357), Public GI ID no.125587204 (SEQ ID NO:1358), Ceres CLONE ID no.320997 (SEQ ID NO:1360), Ceres ANNOT ID no.1455585 (SEQ ID NO:1362), Ceres ANNOT ID no.1499460 (SEQ ID NO:1364), Ceres CLONE ID no.334484 (SEQ ID NO:1366), Ceres CLONE ID no.100819481 (SEQ ID NO:1367), Public GI ID no.115462401 (SEQ ID NO:1368), Ceres CLONE ID no.1448136 (SEQ ID NO:1370), Ceres CLONE ID no.277751 (SEQ ID NO:1372), Ceres ANNOT ID no.1491839 (SEQ ID NO:1374), Ceres CLONE ID no.100913241 (SEQ ID NO:1375), Ceres CLONE ID no.1053224 (SEQ ID NO:1377), Ceres CLONE ID no.425766 (SEQ ID NO:1379), Ceres CLONE ID no.485480 (SEQ ID NO:1381), Ceres CLONE ID no.474845 (SEQ ID NO:1383), Ceres CLONE ID no.354561 (SEQ ID NO:1385), Ceres CLONE ID no.540858 (SEQ ID NO:1387), Ceres CLONE ID no.2032994 (SEQ ID NO:1389), Ceres CLONE ID no.2015315 (SEQ ID NO:1391), Ceres CLONE ID no.2016149 (SEQ ID NO:1393), Ceres CLONE ID no.1922843 (SEQ ID NO:1395), Ceres CLONE ID no.2000263 (SEQ ID NO:1397), Ceres CLONE ID no.1943510 (SEQ ID NO:1399), Ceres CLONE ID no.1835498 (SEQ ID NO:1401), Ceres CLONE ID no.101116694 (SEQ ID NO:1402), Ceres CLONE ID no.1930596 (SEQ ID NO:1404), Ceres CLONE ID no.846036 (SEQ ID NO:1406), Ceres CLONE ID no.941614 (SEQ ID NO:1408), Ceres CLONE ID no.238788 (SEQ ID NO:1410), Public GI ID no.125554220 (SEQ ID NO:1411), Public GI ID no.125559895 (SEQ ID NO:1412), Public GI ID no.75252070 (SEQ ID NO:1413), Public GI ID no.115466632 (SEQ ID NO:1414), Public GI ID no.125541525 (SEQ ID NO:1415), Ceres CLONE ID no.1805110 (SEQ ID NO:1417), Ceres CLONE ID no.1725309 (SEQ ID NO:1421), Ceres CLONE ID no.100861679 (SEQ ID NO:1423), Public GI ID no.75226278 (SEQ ID NO:1424), Public GI ID no.125525030 (SEQ ID NO:1425), Public GI ID no.115435474 (SEQ ID NO:1426), Ceres CLONE ID no.1728516 (SEQ ID NO:1433), Public GI ID no.115467910 (SEQ ID NO:1434), Public GI ID no.15239950 (SEQ ID NO:1435), Public GI ID no.4887012 (SEQ ID NO:1436), Ceres ANNOT ID no.1478544 (SEQ ID NO:1438), Public GI ID no.90811713 (SEQ ID NO:1439), Public GI ID no.25989504 (SEQ ID NO:1440), Ceres CLONE ID no.1113354 (SEQ ID NO:1442), Ceres CLONE ID no.1113630 (SEQ ID NO:1444), Ceres ANNOT ID no.6072030 (SEQ ID NO:1446), Ceres ANNOT ID no.6025654 (SEQ ID NO:1448), Ceres ANNOT ID no.6091150 (SEQ ID NO:1450), Ceres ANNOT ID no.6100390 (SEQ ID NO:1452), and sequences identified as functional homologs of the sequences of FIG. 16, as set forth in the sequence listing. In some cases, a functional homolog of SEQ ID NO:1347 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1347.

Figure 17:
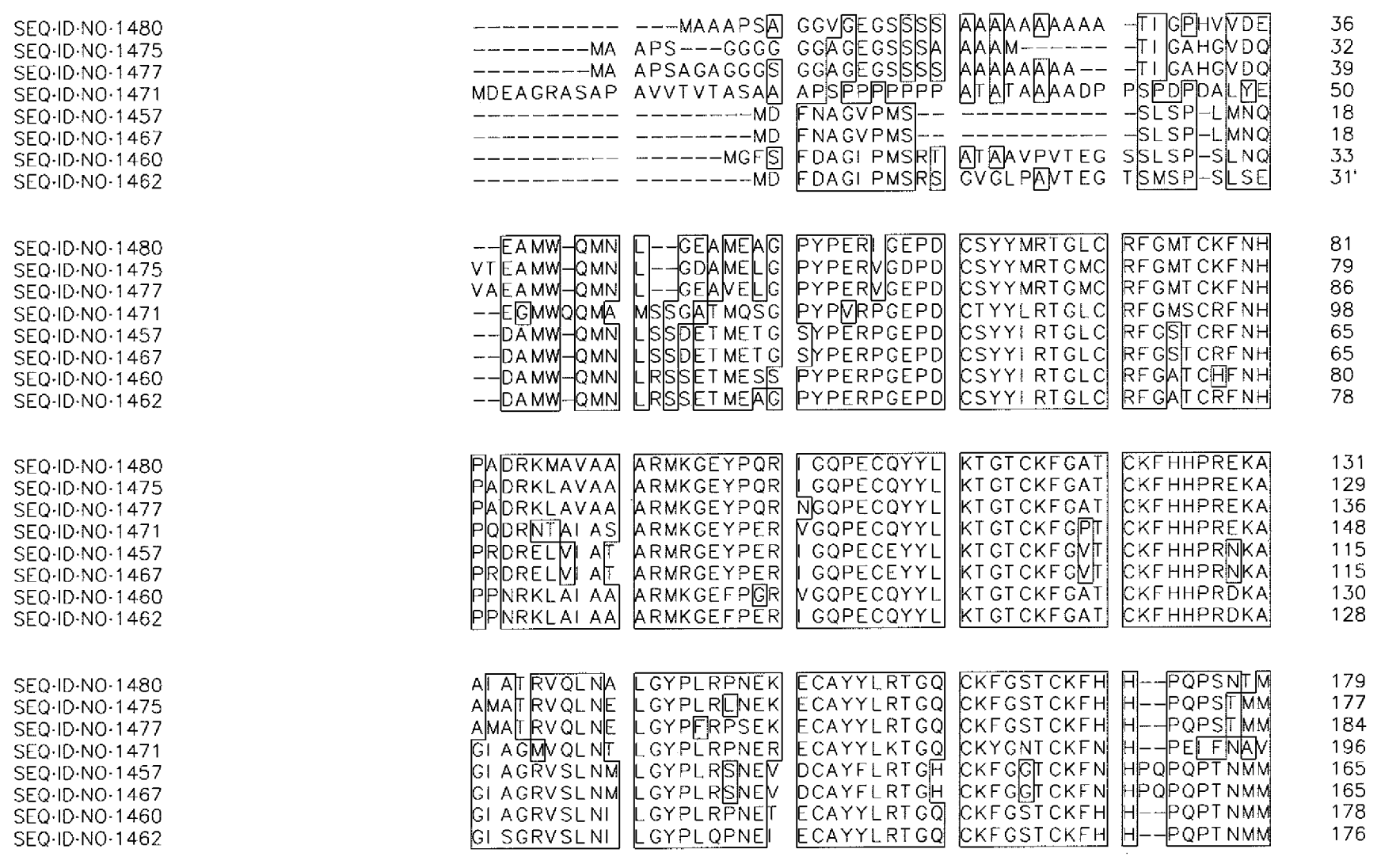

Amino acid sequences of functional homologs of the polypeptide set forth in SEQ ID NO:1457 are provided in FIG. 17. Such functional homologs include Ceres CLONE ID no.1924904 (SEQ ID NO:1460), Ceres ANNOT ID no.1543346 (SEQ ID NO:1462), Public GI ID no.18396338 (SEQ ID NO:1467), Ceres CLONE ID no.833872 (SEQ ID NO:1471), Ceres CLONE ID no.1579587 (SEQ ID NO:1475), Ceres CLONE ID no.1786411 (SEQ ID NO:1477), and Public GI ID no.108864370 (SEQ ID NO:1480). Other functional homologs of SEQ ID NO:1457 include SEQ ID NO:1458, Ceres ANNOT ID no.1532932 (SEQ ID NO:1464), Ceres ANNOT ID no.1489955 (SEQ ID NO:1466), Public GI ID no.4928917 (SEQ ID NO:1468), Public GI ID no.6728979 (SEQ ID NO:1469), Ceres CLONE ID no.285780 (SEQ ID NO:1473), Public GI ID no.125528863 (SEQ ID NO:1478), Public GI ID no.125536365 (SEQ ID NO:1479), Public GI ID no.108864369 (SEQ ID NO:1481), Public GI ID no.115488274 (SEQ ID NO:1482), Public GI ID no.125577099 (SEQ ID NO:1483), Public GI ID no.125573110 (SEQ ID NO:1484), Public GI ID no.124359159 (SEQ ID NO:1485), Public GI ID no.62901479 (SEQ ID NO:1486), Ceres ANNOT ID no.6016783 (SEQ ID NO:1488), Ceres ANNOT ID no.6020759 (SEQ ID NO:1490), Ceres ANNOT ID no.6028676 (SEQ ID NO:1492), Ceres ANNOT ID no.6028677 (SEQ ID NO:1494), and sequences identified as functional homologs of the sequences of FIG. 17, as set forth in the sequence listing. In some cases, a functional homolog of SEQ ID NO:1457 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1457.

Amino acid sequences of functional homologs of the polypeptide set forth in SEQ ID NO:1497 are provided in FIG. 18. Such functional homologs include Ceres ANNOT ID no.1443463 (SEQ ID NO:1499), Public GI ID no.13605525 (SEQ ID NO:1502), Public GI ID no.94965681 (SEQ ID NO:1506), and Public GI ID no.28201254 (SEQ ID NO:1512). Other functional homologs of SEQ ID NO:1497 include Ceres ANNOT ID no.1504954 (SEQ ID NO:1501), Public GI ID no.2499553 (SEQ ID NO:1503), Public GI ID no.738308 (SEQ ID NO:1504), Public GI ID no.4325368 (SEQ ID NO:1505), Ceres CLONE ID no.919923 (SEQ ID NO:1508), Ceres CLONE ID no.1659764 (SEQ ID NO:1510), Public GI ID no.125539984 (SEQ ID NO:1511), Public GI ID no.21740729 (SEQ ID NO:1513), Public GI ID no.115458700 (SEQ ID NO:1514), Public GI ID no.125590574 (SEQ ID NO:1515), Public GI ID no.16444957 (SEQ ID NO:1516), Ceres CLONE ID no.1784494 (SEQ ID NO:1518), Public GI ID no.77963980 (SEQ ID NO:1519), Public GI ID no.124361190 (SEQ ID NO:1520), Public GI ID no.37725007 (SEQ ID NO:1521), Public GI ID no.45935258 (SEQ ID NO:1522), Public GI ID no.15559008 (SEQ ID NO:1523), Public GI ID no.38037416 (SEQ ID NO:1524), Public GI ID no.77963974 (SEQ ID NO:1525), Ceres ANNOT ID no.6112581 (SEQ ID NO:1527), Public GI ID no.56553448 (SEQ ID NO:1528), Public GI ID no.23506659 (SEQ ID NO:1529), Ceres ANNOT ID no.6118060 (SEQ ID NO:1531), Public GI ID no.46446306 (SEQ ID NO:1532), Public GI ID no.114321405 (SEQ ID NO:1533), Public GI ID no.83858274 (SEQ ID NO:1534), Public GI ID no.154250969 (SEQ ID NO:1535), Public GI ID no.83594235 (SEQ ID NO:1536), and sequences identified as functional homologs of the sequences of FIG. 18, as set forth in the sequence listing. In some cases, a functional homolog of SEQ ID NO:1497 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1497.

Figure 19:
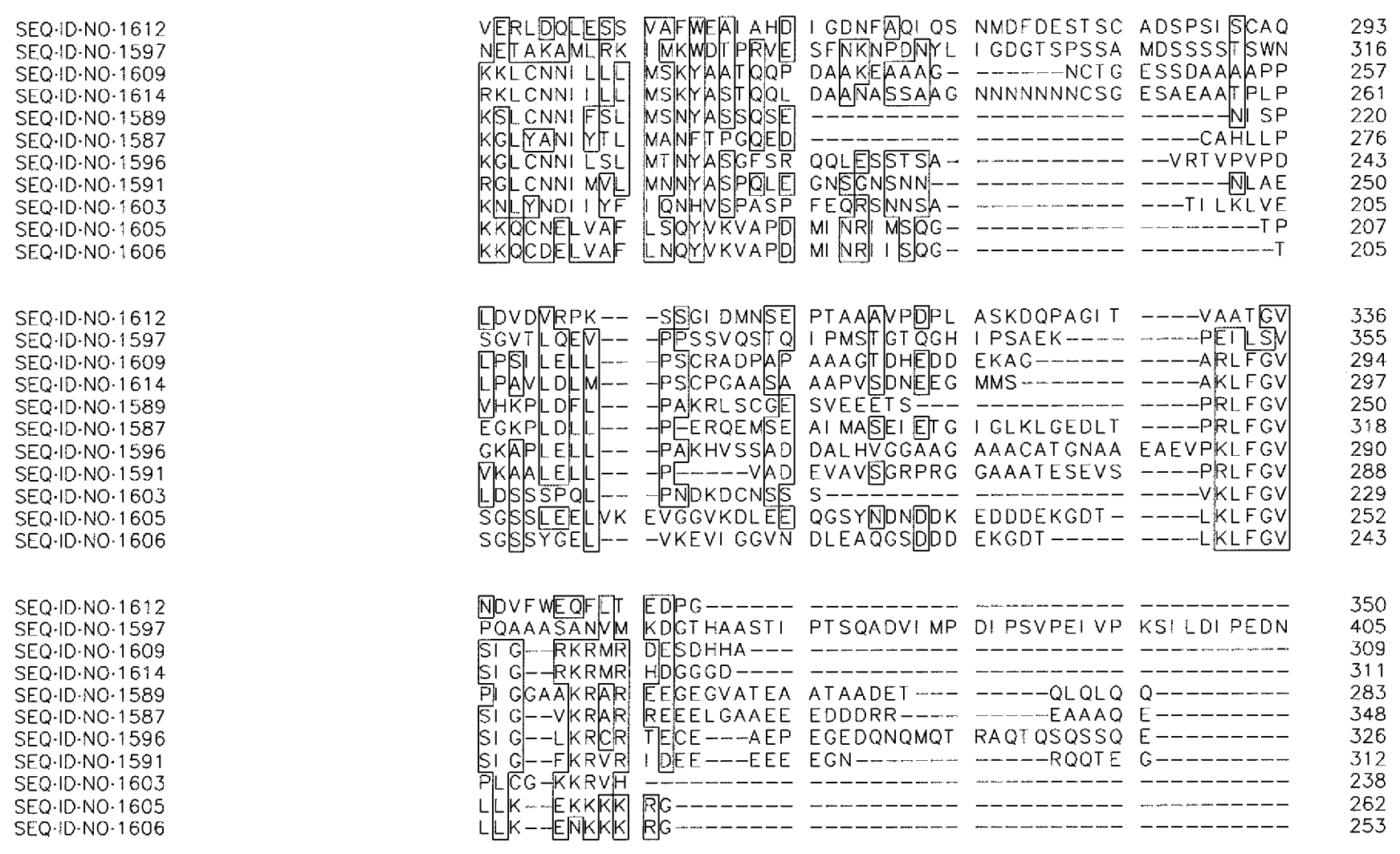

Amino acid sequences of functional homologs of the polypeptide set forth in SEQ ID NO:1587 are provided in FIG. 19. Such functional homologs include Ceres CLONE ID no.1839577 (SEQ ID NO:1589), Ceres ANNOT ID no.1491567 (SEQ ID NO:1591), Ceres CLONE ID no.574505 (SEQ ID NO:1596), Public GI ID no.56117815 (SEQ ID NO:1597), Public GI ID no.92874021 (SEQ ID NO:1603), Public GI ID no.123684 (SEQ ID NO:1605), Public GI ID no.5821136 (SEQ ID NO:1606), Ceres CLONE ID no.283366 (SEQ ID NO:1609), Public GI ID no.16118447 (SEQ ID NO:1612), and Public GI ID no.125562434 (SEQ ID NO:1614). Other functional homologs of SEQ ID NO:1587 include Ceres ANNOT ID no.1438739 (SEQ ID NO:1593), Public GI ID no.89274218 (SEQ ID NO:1594), Public GI ID no.115521211 (SEQ ID NO:1598), Public GI ID no.115521213 (SEQ ID NO:1599), Public GI ID no.115521217 (SEQ ID NO:1600), Public GI ID no.115521209 (SEQ ID NO:1601), Public GI ID no.115521215 (SEQ ID NO:1602), Public GI ID no.11386827 (SEQ ID NO:1604), Public GI ID no.25052685 (SEQ ID NO:1607), Ceres CLONE ID no.1440437 (SEQ ID NO:1611), Public GI ID no.125564440 (SEQ ID NO:1613), Public GI ID no.116309817 (SEQ ID NO:1615), Public GI ID no.125549382 (SEQ ID NO:1616), Public GI ID no.52077317 (SEQ ID NO:1617), Public GI ID no.115477655 (SEQ ID NO:1618), Public GI ID no.42408097 (SEQ ID NO:1619), Public GI ID no.115459982 (SEQ ID NO:1620), Public GI ID no.33591096 (SEQ ID NO:1621), Ceres CLONE ID no.484753 (SEQ ID NO:1623), Ceres ANNOT ID no.6035291 (SEQ ID NO:1625), and sequences identified as functional homologs of the sequences of FIG. 19, as set forth in the sequence listing. In some cases, a functional homolog of SEQ ID NO:1587 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1587.

Figure 20:
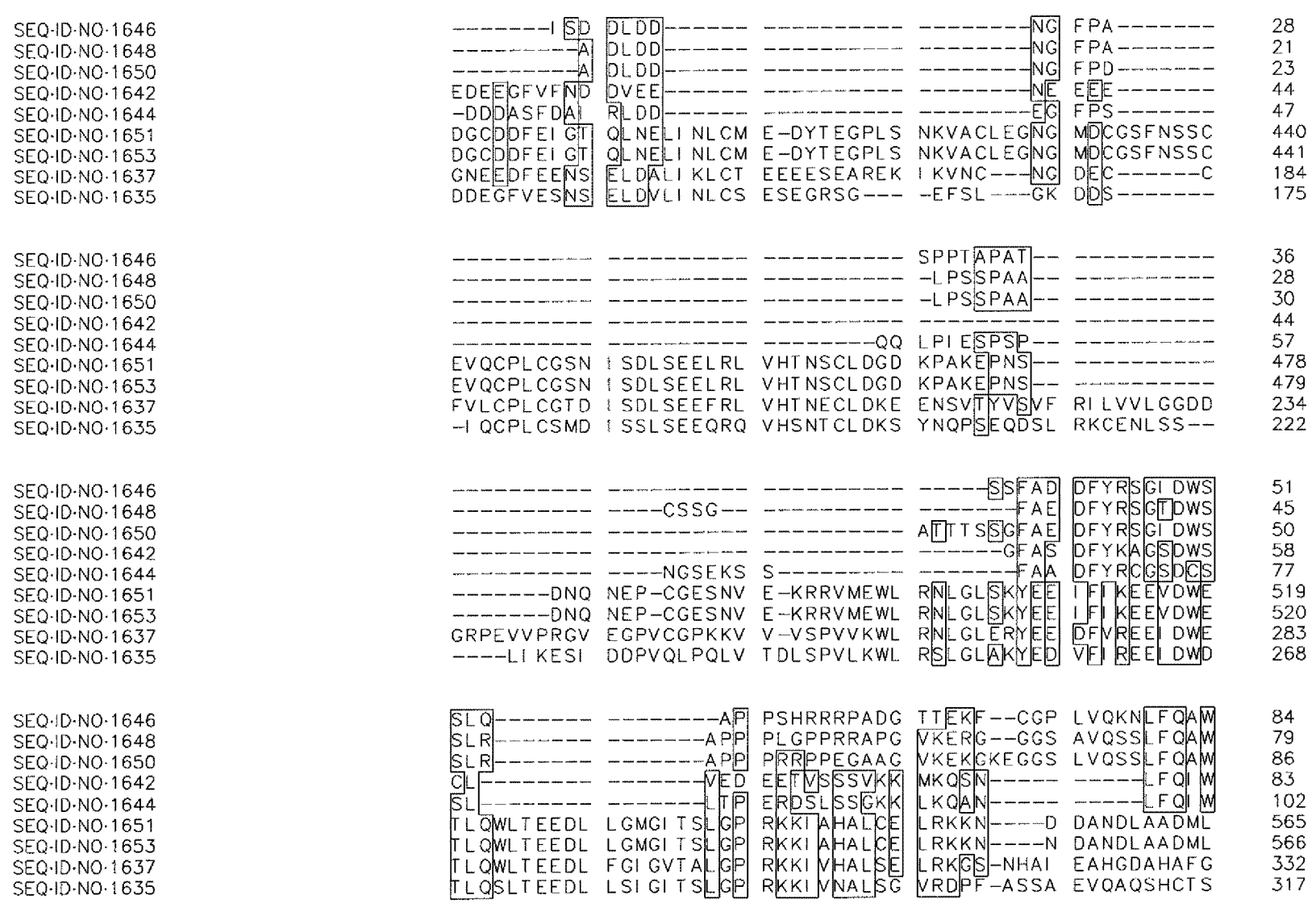
Figure 20:
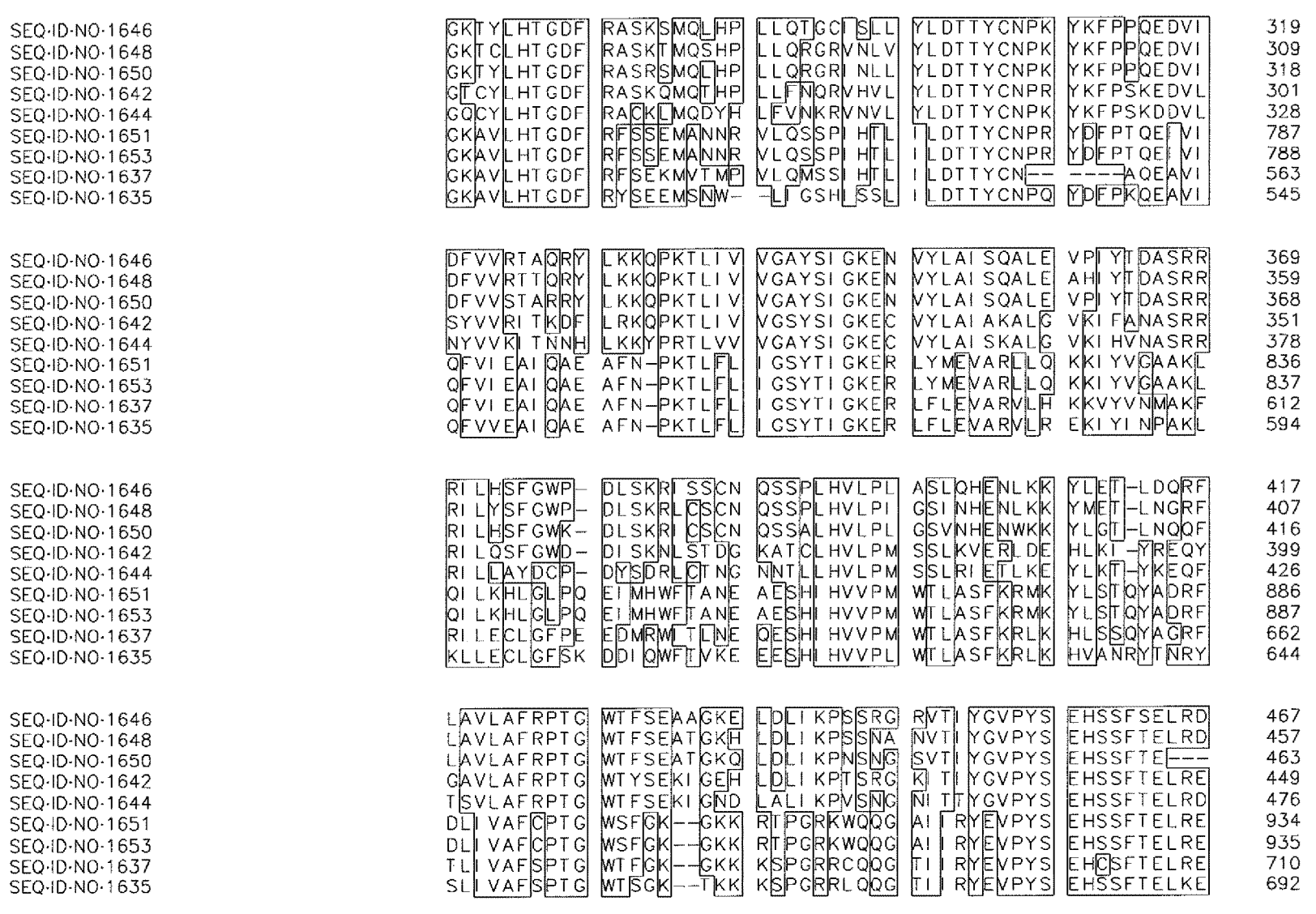
Figure 20:
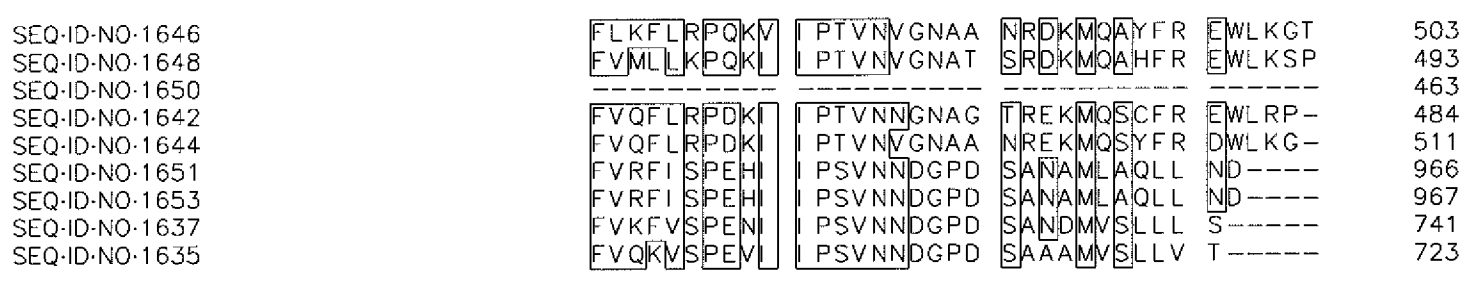

Amino acid sequences of functional homologs of the polypeptide set forth in SEQ ID NO:1635 are provided in FIG. 20. Such functional homologs include Ceres ANNOT ID no.1508307 (SEQ ID NO:1637), Public GI ID no.1495267 (SEQ ID NO:1642), Public GI ID no.87241310 (SEQ ID NO:1644), Ceres CLONE ID no.938390 (SEQ ID NO:1646), Ceres CLONE ID no.272338 (SEQ ID NO:1648), Ceres CLONE ID no.1993510 (SEQ ID NO:1650), Public GI ID no.125563862 (SEQ ID NO:1651), and Public GI ID no.125605833 (SEQ ID NO:1653). Other functional homologs of SEQ ID NO:1635 include Public GI ID no.6899919 (SEQ ID NO:1632), Ceres ANNOT ID no.1455110 (SEQ ID NO:1639), Ceres ANNOT ID no.1525218 (SEQ ID NO:1641), Public GI ID no.15231597 (SEQ ID NO:1643), Public GI ID no.125548147 (SEQ ID NO:1652), Public GI ID no.51091343 (SEQ ID NO:1654), Public GI ID no.115479355 (SEQ ID NO:1655), Ceres ANNOT ID no.6042086 (SEQ ID NO:1657), Ceres ANNOT ID no.6029903 (SEQ ID NO:1659), and sequences identified as functional homologs of the sequences of FIG. 20, as set forth in the sequence listing. In some cases, a functional homolog of SEQ ID NO:1635 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1635.

Amino acid sequences of functional homologs of the polypeptide set forth in SEQ ID NO:1540 are provided in FIG. 21. Such functional homologs include Ceres CLONE ID no.1943265 (SEQ ID NO:1543), Ceres ANNOT ID no.1454522 (SEQ ID NO:1547), Public GI ID no.31323447 (SEQ ID NO:1556), Ceres CLONE ID no.1583941 (SEQ ID NO:1561), Ceres CLONE ID no.1792942 (SEQ ID NO:1563), Public GI ID no.77548772 (SEQ ID NO:1565), and Public GI ID no.84453182 (SEQ ID NO:1567). Other functional homologs of SEQ ID NO:1540 include Public GI ID no.31746344 (SEQ ID NO:1541), Ceres CLONE ID no.1926640 (SEQ ID NO:1545), Ceres ANNOT ID no.1475125 (SEQ ID NO:1549), Ceres ANNOT ID no.1439653 (SEQ ID NO:1551), Ceres ANNOT ID no.1461995 (SEQ ID NO:1553), Public GI ID no.13877517 (SEQ ID NO:1554), Public GI ID no.7239157 (SEQ ID NO:1555), Public GI ID no.22652125 (SEQ ID NO:1557), Public GI ID no.22652115 (SEQ ID NO:1558), Public GI ID no.22652117 (SEQ ID NO:1559), Public GI ID no.125535858 (SEQ ID NO:1564), Public GI ID no.125578581 (SEQ ID NO:1566), Public GI ID no.13752407 (SEQ ID NO:1568), Ceres ANNOT ID no.6098817 (SEQ ID NO:1570), Ceres ANNOT ID no.6039430 (SEQ ID NO:1572), Ceres ANNOT ID no.6068141 (SEQ ID NO:1574), Ceres ANNOT ID no.6033916 (SEQ ID NO:1576), Ceres ANNOT ID no.6034399 (SEQ ID NO:1578), Ceres ANNOT ID no.6068617 (SEQ ID NO:1580), Ceres ANNOT ID no.6026318 (SEQ ID NO:1582), Ceres ANNOT ID no.6107650 (SEQ ID NO:1584), and sequences identified as functional homologs of the sequences of FIG. 21, as set forth in the sequence listing. In some cases, a functional homolog of SEQ ID NO:1540 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1540.

Figure 22:
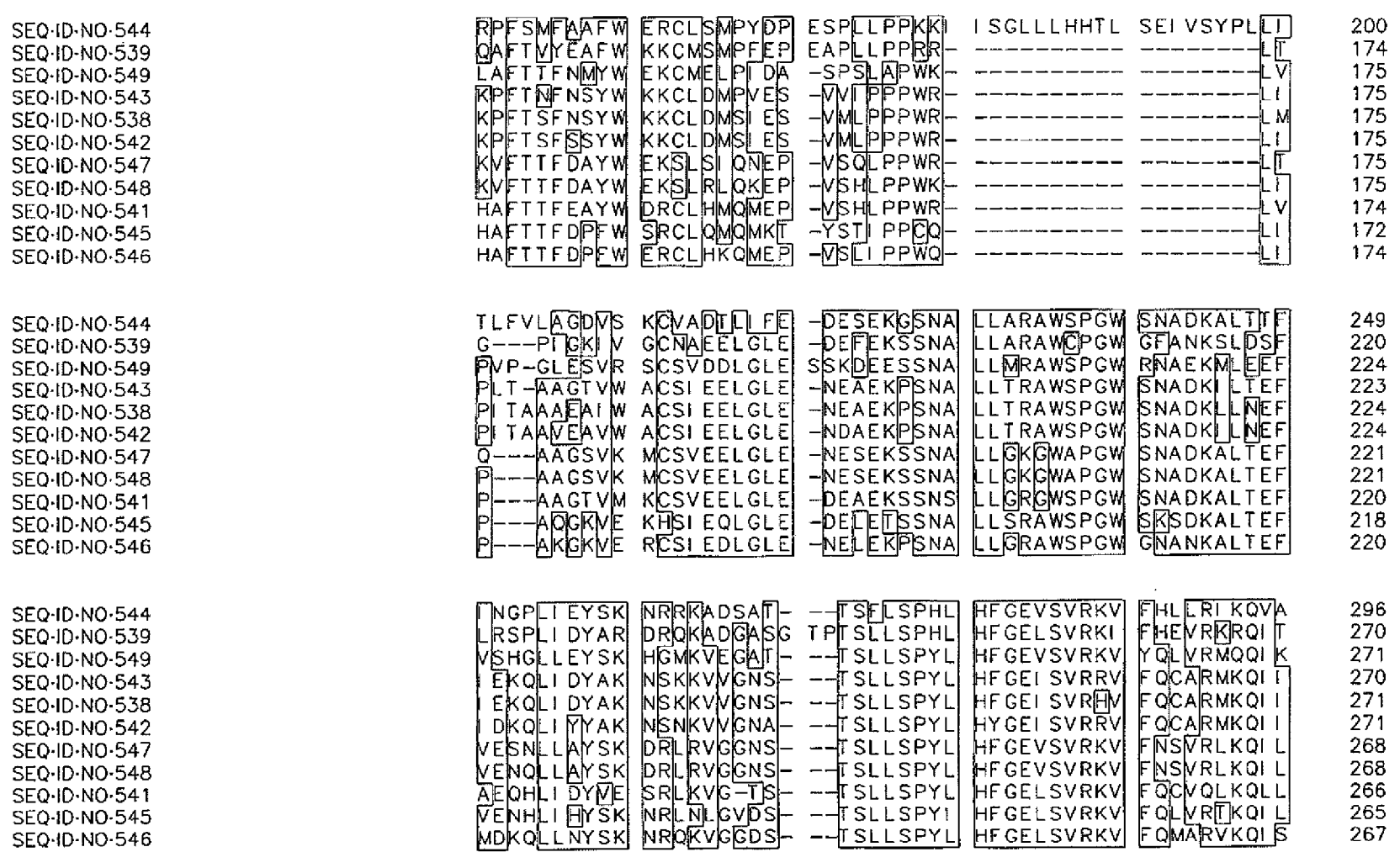
Figure 22:
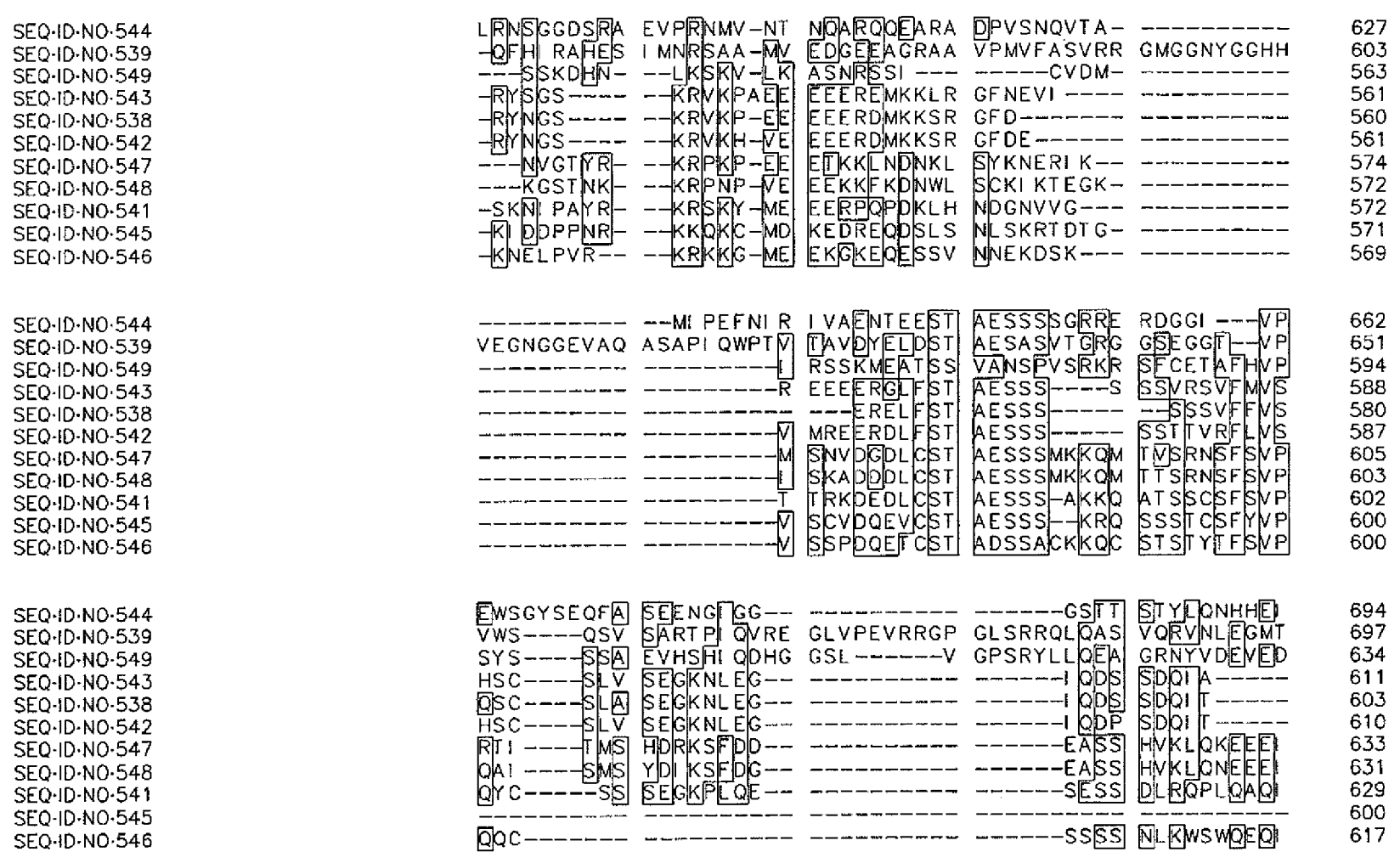

Amino acid sequences of functional homologs of the polypeptide set forth in SEQ ID NO:538 are provided in FIG. 22. Such functional homologs include Public GI ID no.5731739 (SEQ ID NO:539), Ceres ANNOT ID no.1538045 (SEQ ID NO:541), Public GI ID no.29467479 (SEQ ID NO:542), Public GI ID no.133921974 (SEQ ID NO:543), Public GI ID no.113197027 (SEQ ID NO:544), Public GI ID no.92879277 (SEQ ID NO:545), Public GI ID no.45935260 (SEQ ID NO:546), Public GI ID no.8101444 (SEQ ID NO:547), Public GI ID no.78217443 (SEQ ID NO:548), and Public GI ID no.28372347 (SEQ ID NO:549). Other functional homologs of SEQ ID NO:538 include Public GI ID no.16416405 (SEQ ID NO:550), Ceres ANNOT ID no.1484634 (SEQ ID NO:552), Ceres ANNOT ID no.1451869 (SEQ ID NO:554), Public GI ID no.25407462 (SEQ ID NO:555), Public GI ID no.29467481 (SEQ ID NO:556), Public GI ID no.29467477 (SEQ ID NO:557), Public GI ID no.45935264 (SEQ ID NO:558), Public GI ID no.5524201 (SEQ ID NO:559), Public GI ID no.78217441 (SEQ ID NO:560), Public GI ID no.3551221 (SEQ ID NO:561), Public GI ID no.3551219 (SEQ ID NO:562), Public GI ID no.23954324 (SEQ ID NO:563), Public GI ID no.125582937 (SEQ ID NO:564), Public GI ID no.83764373 (SEQ ID NO:565), Ceres ANNOT ID no.6045327 (SEQ ID NO:567), and sequences identified as functional homologs of the sequences of FIG. 22, as set forth in the sequence listing. In some cases, a functional homolog of SEQ ID NO:538 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:538.

Amino acid sequences of functional homologs of the polypeptide set forth in SEQ ID NO:606 are provided in FIG. 23. Such functional homologs include Public GI ID no.92873064 (SEQ ID NO:607), Public GI ID no.37051125 (SEQ ID NO:608), and Public GI ID no.112363376 (SEQ ID NO:609). Other functional homologs of SEQ ID NO:606 include Ceres CLONE ID no.1938524 (SEQ ID NO:611), Ceres ANNOT ID no.1473601 (SEQ ID NO:613), Ceres ANNOT ID no.1468397 (SEQ ID NO:615), Public GI ID no.21554185 (SEQ ID NO:616), Public GI ID no.18424330 (SEQ ID NO:617), Public GI ID no.8885571 (SEQ ID NO:618), Ceres CLONE ID no.20852 (SEQ ID NO:620), Public GI ID no.21553763 (SEQ ID NO:621), Public GI ID no.18401763 (SEQ ID NO:622), Ceres CLONE ID no.16423 (SEQ ID NO:624), Public GI ID no.112363380 (SEQ ID NO:625), Public GI ID no.6092016 (SEQ ID NO:626), Ceres CLONE ID no.770468 (SEQ ID NO:628), Public GI ID no.113205234 (SEQ ID NO:629), Ceres ANNOT ID no.6094775 (SEQ ID NO:631), and sequences identified as functional homologs of the sequences of FIG. 23, as set forth in the sequence listing. In some cases, a functional homolog of SEQ ID NO:606 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:606.

Figure 24:
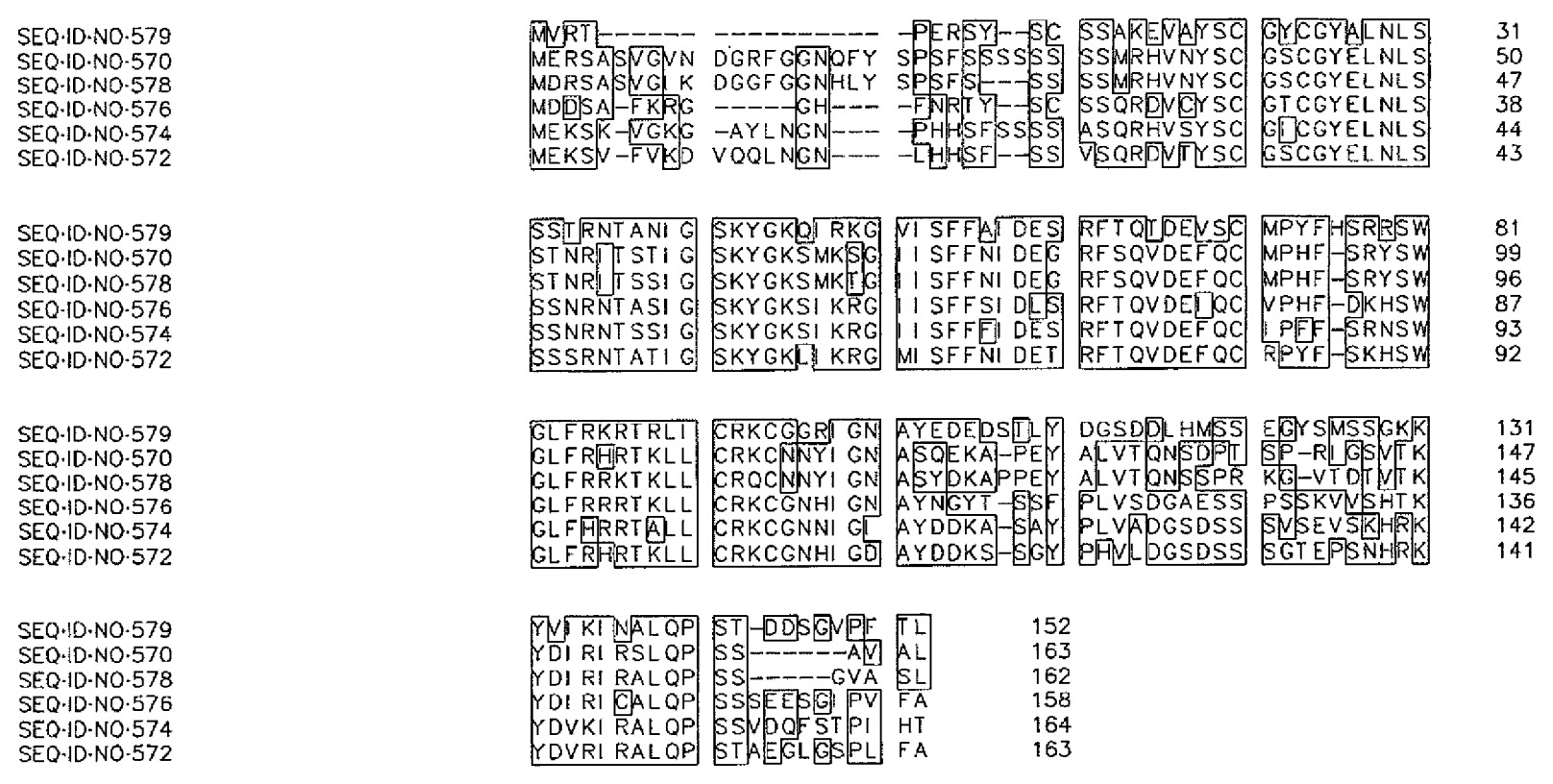

Amino acid sequences of functional homologs of the polypeptide set forth in SEQ ID NO:570 are provided in FIG. 24. Such functional homologs include Ceres CLONE ID no.1919714 (SEQ ID NO:572), Ceres ANNOT ID no.1443290 (SEQ ID NO:574), Ceres CLONE ID no.1042157 (SEQ ID NO:576), Ceres CLONE ID no.1384304 (SEQ ID NO:578), and Public GI ID no.115464375 (SEQ ID NO:579). Other functional homologs of SEQ ID NO:570 include Ceres CLONE ID no.100028078 (SEQ ID NO:580), Ceres ANNOT ID no.1452096 (SEQ ID NO:582), Ceres ANNOT ID no.1503869 (SEQ ID NO:584), Ceres ANNOT ID no.1525651 (SEQ ID NO:586), Ceres CLONE ID no.1645639 (SEQ ID NO:588), Ceres CLONE ID no.603237 (SEQ ID NO:590), Ceres CLONE ID no.340925 (SEQ ID NO:592), Ceres CLONE ID no.293238 (SEQ ID NO:594), Ceres CLONE ID no.483742 (SEQ ID NO:596), Ceres CLONE ID no.1460255 (SEQ ID NO:598), Ceres CLONE ID no.1400107 (SEQ ID NO:600), Public GI ID no.115440865 (SEQ ID NO:601), Ceres ANNOT ID no.6016008 (SEQ ID NO:603), and sequences identified as functional homologs of the sequences of FIG. 24, as set forth in the sequence listing. In some cases, a functional homolog of SEQ ID NO:570 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:570.

The identification of conserved regions in an SD+EODFR and/or low light tolerance polypeptide facilitates production of variants of SD+EODFR and/or low light tolerance polypeptides. Variants of SD+EODFR and/or low light tolerance polypeptides typically have 10 or fewer conservative amino acid substitutions within the primary amino acid sequence, e.g., 7 or fewer conservative amino acid substitutions, 5 or fewer conservative amino acid substitutions, or between 1 and 5 conservative substitutions. A useful variant polypeptide can be constructed based on one of the alignments set forth in FIGS. 1-24. Such a polypeptide includes the conserved regions, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at all positions marked by dashes, such a polypeptide has a length that is the sum of the amino acid residues in all conserved regions and all dashes.

D. Functional Homologs Identified by HMMER

In some embodiments, useful SD+EODFR and/or low light tolerance polypeptides include those that fit a Hidden Markov Model based on the polypeptides set forth in any one of FIGS. 1-24. A Hidden Markov Model (HMM) is a statistical model of a consensus sequence for a group of functional homologs. See, Durbin et al., *Biological Sequence Analysis: Probabilistic Models of Proteins and Nucleic Acids*, Cambridge University Press, Cambridge, UK (1998). An HMM is generated by the program HMMER 2.3.2 with default program parameters, using the sequences of the group of functional homologs as input. The multiple sequence alignment is generated by ProbCons (Do et al., Genome Res., 15(2):330-40 (2005)) version 1.11 using a set of default parameters: -c, -consistency REPS of 2; -ir, -iterative-refinement REPS of 100; -pre, -pre-training REPS of 0. ProbCons is a public domain software program provided by Stanford University.

The default parameters for building an HMM (hmmbuild) are as follows: the default "architecture prior" (archpri) used by MAP architecture construction is 0.85, and the default cutoff threshold (idlevel) used to determine the effective sequence number is 0.62. HMMER 2.3.2 was released Oct. 3, 2003 under a GNU general public license, and is available from various sources on the World Wide Web such as hmmer.janelia.org; hmmer wustl.edu; and fr.com/hmmer232/. Hmmbuild outputs the model as a text file.

The HMM for a group of functional homologs can be used to determine the likelihood that a candidate SD+EODFR and/or low light tolerance polypeptide sequence is a better fit to that particular HMM than to a null HMM generated using a group of sequences that are not structurally or functionally related. The likelihood that a candidate polypeptide sequence is a better fit to an HMM than to a null HMM is indicated by the HMM bit score, a number generated when the candidate sequence is fitted to the HMM profile using the HMMER hmmsearch program. The following default parameters are used when running hmmsearch: the default E-value cutoff (E) is 10.0, the default bit score cutoff (T) is negative infinity, the default number of sequences in a database (Z) is the real number of sequences in the database, the default E-value cutoff for the per-domain ranked hit list (domE) is infinity, and the default bit score cutoff for the per-domain ranked hit list (domT) is negative infinity. A high HMM bit score indicates a greater likelihood that the candidate sequence carries out one or more of the biochemical or physiological function(s) of the polypeptides used to generate the HMM. A high HMM bit score is at least 20, and often is higher. Slight variations in the HMM bit score of a particular sequence can occur due to factors such as the order in which sequences are processed for alignment by multiple sequence alignment algorithms such as the ProbCons program. Nevertheless, such HMM bit score variation is minor.

The SD+EODFR and/or low light tolerance polypeptides discussed below fit the indicated HMM with an HMM bit score greater than 20 (e.g., greater than 30, 40, 50, 60, 70, 80, 90, 100, 200, 300, 400, or 500). In some embodiments, the HMM bit score of an SD+EODFR and/or low light tolerance polypeptide discussed below is about 50%, 60%, 70%, 80%, 90%, or 95% of the HMM bit score of a functional homolog provided in the Sequence Listing. In some embodiments, an SD+EODFR and/or low light tolerance polypeptide discussed below fits the indicated HMM with an HMM bit score greater than 20, and has a domain indicative of an SD+EODFR and/or low light tolerance polypeptide. In some embodiments, an SD+EODFR and/or low light tolerance polypeptide discussed below fits the indicated HMM with an HMM bit score greater than 20, and has 70% or greater sequence identity (e.g., 75%, 80%, 85%, 90%, 95%, or 100% sequence identity) to an amino acid sequence shown in any one of FIGS. 1-24.

Polypeptides are shown in the sequence listing that have HMM bit scores greater than 170 when fitted to an HMM generated from the amino acid sequences set forth in FIG. 1. Such polypeptides include At4g37295 (SEQ ID NO:3), Ceres CLONE ID no. 1844057 (SEQ ID NO:7), Ceres ANNOT ID no. 1469148 (SEQ ID NO:22), Public GI ID no. 18390998 (SEQ ID NO:25), Ceres CLONE ID no. 1065656 (SEQ ID NO:32), Ceres CLONE ID no. 1652677 (SEQ ID NO:36), Public GI ID no. 92874556 (SEQ ID NO:49), Ceres CLONE ID no. 1329161 (SEQ ID NO:53), Ceres CLONE ID no. 1030378 (SEQ ID NO:55), Ceres CLONE ID no. 1413787 (SEQ ID NO:57), Public GI ID no. 125543598 (SEQ ID NO:60), Ceres CLONE ID no. 1793691 (SEQ ID NO:5), Ceres CLONE ID no. 1933784 (SEQ ID NO:9), Ceres CLONE ID no. 100030408 (SEQ ID NO:10), Ceres CLONE ID no. 1837059 (SEQ ID NO:12), Ceres CLONE ID no. 1793801 (SEQ ID NO:14), Ceres CLONE ID no. 1855480 (SEQ ID NO:16), Ceres CLONE ID no. 1915644 (SEQ ID NO:18), Ceres CLONE ID no. 1898104 (SEQ ID NO:20), Ceres ANNOT ID no. 1464241 (SEQ ID NO:24), Public GI ID no. 18697627 (SEQ ID NO:26), Ceres CLONE ID no. 9391 (SEQ ID NO:28), Ceres CLONE ID no. 111154 (SEQ ID NO:30), Ceres CLONE ID no. 973975 (SEQ ID NO:34), Ceres CLONE ID no. 676695 (SEQ ID NO:38), Ceres CLONE ID no. 680331 (SEQ ID NO:40), Ceres CLONE ID no. 654515 (SEQ ID NO:42), Ceres CLONE ID no. 626154 (SEQ ID NO:44), Ceres CLONE ID no. 710603 (SEQ ID NO:46), Ceres CLONE ID no. 648076 (SEQ ID NO:48), Ceres CLONE ID no. 749439 (SEQ ID NO:51), Ceres CLONE ID no. 295936 (SEQ ID NO:59), Public GI ID no. 125525139 (SEQ ID NO:61), Public GI ID no. 115452643 (SEQ ID NO:62), Public GI ID no. 24059889 (SEQ ID NO:63), Ceres ANNOT ID no. 6012747 (SEQ ID NO:65), Ceres ANNOT ID no. 6027628 (SEQ ID NO:67), and sequences identified as functional homologs of the sequences of FIG. 1, as set forth in the sequence listing.

Polypeptides are shown in the sequence listing that have HMM bit scores greater than 80 when fitted to an HMM generated from the amino acid sequences set forth in FIG. 2. Such polypeptides include At2g32710 (SEQ ID NO:70), Ceres CLONE ID no. 1975934 (SEQ ID NO:72), Ceres ANNOT ID no. 1529913 (SEQ ID NO:80), Ceres CLONE ID no. 977794 (SEQ ID NO:93), Public GI ID no. 42362378 (SEQ ID NO:96), Public GI ID no. 23899378 (SEQ ID NO:99), Public GI ID no. 15963346 (SEQ ID NO:101), Public GI ID no. 15963344+B816 (SEQ ID NO:102), Public GI ID no. 92429657 (SEQ ID NO:103), Ceres CLONE ID no. 746644 (SEQ ID NO:105), Ceres CLONE ID no. 623089 (SEQ ID NO:109), Ceres CLONE ID no. 1913678 (SEQ ID NO:115), Public GI ID no. 115450609 (SEQ ID NO:119), Ceres CLONE ID no. 1835084 (SEQ ID NO:74), Ceres CLONE ID no. 1846153 (SEQ ID NO:76), Ceres CLONE ID no. 1930884 (SEQ ID NO:78), Ceres ANNOT ID no. 1493858 (SEQ ID NO:82), Ceres ANNOT ID no. 1498646 (SEQ ID NO:84), Ceres ANNOT ID no. 1440974 (SEQ ID NO:86), Ceres CLONE ID no. 1189183 (SEQ ID NO:88), Public GI ID no. 26450253 (SEQ ID NO:89), Public GI ID no. 15239719 (SEQ ID NO:90), Public GI ID no. 15230194 (SEQ ID NO:91), Ceres CLONE ID no. 630905 (SEQ ID NO:95), Public GI ID no. 42362389 (SEQ ID NO:97), Public GI ID no. 70906129 (SEQ ID NO:98), Public GI ID no. 23899381 (SEQ ID NO:100), Ceres CLONE ID no. 298166 (SEQ ID NO:107), Ceres CLONE ID no. 1448390 (SEQ ID NO:111), Ceres CLONE ID no. 1734216 (SEQ ID NO:113), Public GI ID no. 125542322 (SEQ ID NO:116), Public GI ID no. 125532331 (SEQ ID NO:117), Public GI ID no. 125541233 (SEQ ID NO:118), Public GI ID no. 125584844 (SEQ ID NO:120), Public GI ID no. 115482472 (SEQ ID NO:121), Public GI ID no. 125575112 (SEQ ID NO:122), Ceres ANNOT ID no.6003994 (SEQ ID NO:124), Ceres ANNOT ID no. 6068427 (SEQ ID NO:126), and sequences identified as functional homologs of the sequences of FIG. 2, as set forth in the sequence listing.

Polypeptides are shown in the sequence listing that have HMM bit scores greater than 80 when fitted to an HMM generated from the amino acid sequences set forth in FIG. 3. Such polypeptides include Public GI ID no. 34550779 (SEQ ID NO:133), Ceres CLONE ID no. 1932235 (SEQ ID NO:137), Ceres CLONE ID no. 981738 (SEQ ID NO:201), Ceres CLONE ID no. 565974 (SEQ ID NO:209), Public GI ID no. 1352058 (SEQ ID NO:231), Public GI ID no. 11131101 (SEQ ID NO:234), Public GI ID no. 4887018 (SEQ ID NO:236), Public GI ID no. 4887018 (SEQ ID NO:236), Ceres CLONE ID no. 644455 (SEQ ID NO:247), Ceres CLONE ID no. 1731500 (SEQ ID NO:270), Public GI ID no. 20269063 (SEQ ID NO:300), Public GI ID no. 50404477 (SEQ ID NO:302), Public GI ID no. 62125392 (SEQ ID NO:303), Public GI ID no. 32396293 (SEQ ID NO:130), Public GI ID no. 32396299 (SEQ ID NO:131), Public GI ID no. 32396295 (SEQ ID NO:132), Ceres CLONE ID no. 1855369 (SEQ ID NO:135), Ceres CLONE ID no. 1948456 (SEQ ID NO:139), Ceres CLONE ID no. 1920182 (SEQ ID NO:141), Ceres CLONE ID no. 1835797 (SEQ ID NO:143), Ceres CLONE ID no. 1794204 (SEQ ID NO:145), Ceres CLONE ID no. 1853542 (SEQ ID NO:147), Ceres CLONE ID no. 1838776 (SEQ ID NO:149), Ceres CLONE ID no. 1854675 (SEQ ID NO:151), Ceres CLONE ID no. 1833078 (SEQ ID NO:153), Ceres CLONE ID no. 1850667 (SEQ ID NO:155), Ceres CLONE ID no. 1918745 (SEQ ID NO:157), Ceres CLONE ID no. 1929487 (SEQ ID NO:159), Ceres ANNOT ID no. 1497918 (SEQ ID NO:161), Ceres ANNOT ID no. 1459563 (SEQ ID NO:163), Ceres ANNOT ID no. 1452610 (SEQ ID NO:165), Ceres ANNOT ID no. 1496539 (SEQ ID NO:167), Ceres ANNOT ID no. 1498819 (SEQ ID NO:169), Ceres ANNOT ID no. 1446583 (SEQ ID NO:171), Ceres ANNOT ID no. 1535123 (SEQ ID NO:173), Ceres ANNOT ID no. 1463397 (SEQ ID NO:175), Ceres ANNOT ID no. 1499563 (SEQ ID NO:177), Ceres ANNOT ID no. 1495753 (SEQ ID NO:179), Ceres ANNOT ID no. 1488767 (SEQ ID NO:181), Ceres ANNOT ID no. 1522920 (SEQ ID NO:185), Ceres ANNOT ID no. 1469532 (SEQ ID NO:187), Public GI ID no. 15219692 (SEQ ID NO:188), Public GI ID no. 18420964 (SEQ ID NO:189), Ceres CLONE ID no. 1342080 (SEQ ID NO:191), Ceres CLONE ID no. 123105 (SEQ ID NO:193), Ceres CLONE ID no. 32727 (SEQ ID NO:195), Ceres CLONE ID no. 41161 (SEQ ID NO:197), Ceres CLONE ID no. 37274 (SEQ ID NO:199), Ceres CLONE ID no. 538020 (SEQ ID NO:203), Ceres CLONE ID no. 476244 (SEQ ID NO:205), Ceres CLONE ID no. 1623662 (SEQ ID NO:207), Ceres CLONE ID no. 626817 (SEQ ID NO:211), Ceres CLONE ID no. 537469 (SEQ ID NO:213), Ceres CLONE ID no. 582463 (SEQ ID NO:215), Ceres CLONE ID no.1069818 (SEQ ID NO:217), Ceres CLONE ID no. 511737 (SEQ ID NO:219), Ceres CLONE ID no. 565422 (SEQ ID NO:221), Ceres CLONE ID no. 514595 (SEQ ID NO:223), Ceres CLONE ID no. 566396 (SEQ ID NO:225), Ceres CLONE ID no. 612705 (SEQ ID NO:227), Ceres CLONE ID no. 564134 (SEQ ID NO:229), Public GI ID no. 92872146 (SEQ ID NO:230), Public GI ID no. 11131103 (SEQ ID NO:232), Public GI ID no. 416641 (SEQ ID NO:233), Public GI ID no. 11131105 (SEQ ID NO:235), Public GI ID no. 4887016 (SEQ ID NO:237), Public GI ID no. 4887022 (SEQ ID NO:238), Public GI ID no. 81074526 (SEQ ID NO:239), Ceres CLONE ID no. 742023 (SEQ ID NO:241), Ceres CLONE ID no. 576268 (SEQ ID NO:243), Ceres CLONE ID no. 615386 (SEQ ID NO:245), Ceres CLONE ID no. 756966 (SEQ ID NO:249), Ceres CLONE ID no. 1052710 (SEQ ID NO:251), Ceres CLONE ID no. 697018 (SEQ ID NO:253), Ceres CLONE ID no. 618577 (SEQ ID NO:255), Ceres CLONE ID no. 935194 (SEQ ID NO:257), Ceres CLONE ID no. 1557429 (SEQ ID NO:259), Ceres CLONE ID no. 305337 (SEQ ID NO:261), Ceres CLONE ID no. 100872943 (SEQ ID NO:262), Ceres CLONE ID no. 305454 (SEQ ID NO:264), Ceres CLONE ID no. 1534670 (SEQ ID NO:266), Ceres CLONE ID no. 207963 (SEQ ID NO:268), Public GI ID no. 20257219 (SEQ ID NO:271), Ceres CLONE ID no. 1876818 (SEQ ID NO:273), Ceres CLONE ID no. 1817533 (SEQ ID NO:275), Ceres CLONE ID no. 1958631 (SEQ ID NO:277), Ceres CLONE ID no. 1963215 (SEQ ID NO:279), Ceres CLONE ID no. 1770022 (SEQ ID NO:281), Ceres CLONE ID no. 1796223 (SEQ ID NO:283), Ceres CLONE ID no. 2016695 (SEQ ID NO:285), Ceres CLONE ID no. 1757085 (SEQ ID NO:287), Ceres CLONE ID no. 1769256 (SEQ ID NO:289), Ceres CLONE ID no. 1994871 (SEQ ID NO:291), Public GI ID no. 17154533 (SEQ ID NO:292), Public GI ID no. 125557426 (SEQ ID NO:293), Public GI ID no. 125524736 (SEQ ID NO:294), Public GI ID no. 125527656 (SEQ ID NO:295), Public GI ID no. 125599342 (SEQ ID NO:296), Public GI ID no. 125569626 (SEQ ID NO:297), Public GI ID no. 115465401 (SEQ ID NO:298), Public GI ID no. 40539038 (SEQ ID NO:299), Public GI ID no. 20269059 (SEQ ID NO:301), Public GI ID no. 110826446 (SEQ ID NO:304), Ceres ANNOT ID no. 6029073 (SEQ ID NO:306), Ceres ANNOT ID no. 6011329 (SEQ ID NO:308), Ceres ANNOT ID no. 6034498 (SEQ ID NO:310), Ceres ANNOT ID no. 6095057 (SEQ ID NO:312), Ceres ANNOT ID no. 6095058 (SEQ ID NO:314), and sequences identified as functional homologs of the sequences of FIG. 3, as set forth in the sequence listing.

Polypeptides are shown in the sequence listing that have HMM bit scores greater than 200 when fitted to an HMM generated from the amino acid sequences set forth in FIG. 4. Such polypeptides include At4g03250 (Ceres Seedline ME10007; SEQ ID NO:317), Ceres CLONE ID no. 1842125 (SEQ ID NO:319), Ceres ANNOT ID no. 1461360 (SEQ ID NO:321), Ceres CLONE ID no. 480906 (SEQ ID NO:327), Public GI ID no. 92889352 (SEQ ID NO:330), Public GI ID no. 56201850 (SEQ ID NO:330), Ceres ANNOT ID no. 1440334 (SEQ ID NO:323), Ceres ANNOT ID no. 1493205 (SEQ ID NO:325), Ceres CLONE ID no. 482270 (SEQ ID NO:329), Public GI ID no. 125571531 (SEQ ID NO:332), Ceres ANNOT ID no. 6042411 (SEQ ID NO:334), and sequences identified as functional homologs of the sequences of FIG. 4, as set forth in the sequence listing.

Polypeptides are shown in the sequence listing that have HMM bit scores greater than 80 when fitted to an HMM generated from the amino acid sequences set forth in FIG. 5. Such polypeptides include At2g04240 (SEQ ID NO:337), Ceres CLONE ID no. 952050 (SEQ ID NO:339), Public GI ID no. 115477050 (SEQ ID NO:349), Public GI ID no. 87162911 (SEQ ID NO:355), Ceres CLONE ID no. 1790901 (SEQ ID NO:357), Ceres CLONE ID no. 1460088 (SEQ ID NO:370), Ceres CLONE ID no. 1734065 (SEQ ID NO:393), Ceres CLONE ID no. 473509 (SEQ ID NO:395), Ceres CLONE ID no. 849918 (SEQ ID NO:401), Ceres CLONE ID no. 633470 (SEQ ID NO:409), Ceres CLONE ID no. 1808334 (SEQ ID NO:417), Ceres ANNOT ID no. 1525600 (SEQ ID NO:437), Ceres CLONE ID no. 1265097 (SEQ ID NO:341), Ceres CLONE ID no. 942980 (SEQ ID NO:343), Public GI ID no. 37901055 (SEQ ID NO:344), Ceres CLONE ID no. 1609912 (SEQ ID NO:346), Public GI ID no. 76446335 (SEQ ID NO:347), Public GI ID no. 125560204 (SEQ ID NO:348), Public GI ID no. 125303087 (SEQ ID NO:350), Public GI ID no. 115460088 (SEQ ID NO:351), Public GI ID no. 125591385 (SEQ ID NO:352), Public GI ID no. 115447931 (SEQ ID NO:353), Public GI ID no. 92893514 (SEQ ID NO:354), Ceres CLONE ID no. 2019320 (SEQ ID NO:359), Ceres CLONE ID no. 1890013 (SEQ ID NO:361), Public GI ID no. 20340241 (SEQ ID NO:362), Ceres CLONE ID no. 25801 (SEQ ID NO:364), Public GI ID no. 9743343 (SEQ ID NO:365), Public GI ID no. 15238072 (SEQ ID NO:366), Public GI ID no. 15222553 (SEQ ID NO:367), Public GI ID no. 21554155 (SEQ ID NO:368), Ceres CLONE ID no. 374439 (SEQ ID NO:372), Ceres CLONE ID no. 1465572 (SEQ ID NO:374), Ceres CLONE ID no. 1565524 (SEQ ID NO:376), Ceres CLONE ID no. 322302 (SEQ ID NO:378), Public GI ID no. 101136485 (SEQ ID NO:379), Ceres CLONE ID no. 1376133 (SEQ ID NO:381), Ceres CLONE ID no. 1374381 (SEQ ID NO:383), Ceres CLONE ID no. 1566473 (SEQ ID NO:385), Ceres CLONE ID no. 318088 (SEQ ID NO:387), Ceres CLONE ID no. 1452604 (SEQ ID NO:389), Ceres CLONE ID no. 337906 (SEQ ID NO:391), Ceres CLONE ID no. 1662513 (SEQ ID NO:397), Ceres CLONE ID no. 1662527 (SEQ ID NO:399), Ceres CLONE ID no. 571184 (SEQ ID NO:403), Ceres CLONE ID no. 665689 (SEQ ID NO:405), Ceres CLONE ID no. 1365853 (SEQ ID NO:407), Ceres CLONE ID no. 1052457 (SEQ ID NO:411), Ceres CLONE ID no. 579918 (SEQ ID NO:413), Ceres CLONE ID no. 863299 (SEQ ID NO:415), Ceres CLONE ID no. 1855611 (SEQ ID NO:419), Ceres CLONE ID no. 1845975 (SEQ ID NO:421), Ceres CLONE ID no. 1808298 (SEQ ID NO:423), Ceres CLONE ID no. 1841236 (SEQ ID NO:425), Ceres CLONE ID no. 1808269 (SEQ ID NO:427), Ceres CLONE ID no. 1850628 (SEQ ID NO:429), Ceres CLONE ID no. 1846911 (SEQ ID NO:431), Ceres CLONE ID no. 1916014 (SEQ ID NO:433), Ceres CLONE ID no. 1842594 (SEQ ID NO:435), Ceres ANNOT ID no. 1472192 (SEQ ID NO:439), Ceres ANNOT ID no. 1447489 (SEQ ID NO:441), Ceres ANNOT ID no. 1513000 (SEQ ID NO:443), Ceres ANNOT ID no. 1438658 (SEQ ID NO:445), Ceres ANNOT ID no. 1497255 (SEQ ID NO:447), Ceres ANNOT ID no. 6092104 (SEQ ID NO:449), Ceres ANNOT ID no. 6041700 (SEQ ID NO:451), Ceres ANNOT ID no. 6007297 (SEQ ID NO:453), and sequences identified as functional homologs of the sequences of FIG. 5, as set forth in the sequence listing.

Polypeptides are shown in the sequence listing that have HMM bit scores greater than 60 when fitted to an HMM generated from the amino acid sequences set forth in FIG. 6. Such polypeptides include At5g14370 (SEQ ID NO:456), Public GI ID no. 58430585 (SEQ ID NO:457), Ceres CLONE ID no. 1842825 (SEQ ID NO:466), Ceres ANNOT ID no. 1449721 (SEQ ID NO:474), Public GI ID no. 41323978 (SEQ ID NO:475), Public GI ID no. 2895186 (SEQ ID NO:478), Public GI ID no. 22854950 (SEQ ID NO:481), Public GI ID no. 116010474 (SEQ ID NO:485), Public GI ID no. 4091804 (SEQ ID NO:488), Public GI ID no. 60459257 (SEQ ID NO:494), Public GI ID no. 45544881 (SEQ ID NO:496), Public GI ID no. 36789802 (SEQ ID NO:498), Public GI ID no. 92875402 (SEQ ID NO:508), Public GI ID no. 118406898 (SEQ ID NO:510), Public GI ID no. 107770485 (SEQ ID NO:511), Public GI ID no. 90657642 (SEQ ID NO:536), Ceres CLONE ID no. 1569555 (SEQ ID NO:1842) Public GI ID no. 66841018 (SEQ ID NO:458), Public GI ID no. 66841020 (SEQ ID NO:459), Public GI ID no. 108859343 (SEQ ID NO:460), Ceres CLONE ID no. 1937613 (SEQ ID NO:462), Ceres CLONE ID no. 1834027 (SEQ ID NO:464), Ceres ANNOT ID no. 1477832 (SEQ ID NO:468), Ceres ANNOT ID no. 1482536 (SEQ ID NO:470), Ceres ANNOT ID no. 1478227 (SEQ ID NO:472), Ceres CLONE ID no. 19906 (SEQ ID NO:478), Public GI ID no. 2895184 (SEQ ID NO:479), Public GI ID no. 2895188 (SEQ ID NO:480), Public GI ID no. 11037313 (SEQ ID NO:482), Public GI ID no. 22854908 (SEQ ID NO:483), Public GI ID no. 40787165 (SEQ ID NO:484), Public GI ID no. 116010475 (SEQ ID NO:486), Public GI ID no. 3341723 (SEQ ID NO:487), Public GI ID no. 4091806 (SEQ ID NO:489), Ceres CLONE ID no. 523203 (SEQ ID NO:491), Ceres CLONE ID no.

463157 (SEQ ID NO:493), Public GI ID no. 61611678 (SEQ ID NO:495), Public GI ID no. 45544887 (SEQ ID NO:497), Public GI ID no. 36789793 (SEQ ID NO:481), Ceres CLONE ID no. 907473 (SEQ ID NO:501), Ceres CLONE ID no. 1674443 (SEQ ID NO:503), Ceres CLONE ID no. 1559496 (SEQ ID NO:505), Ceres CLONE ID no. 530984 (SEQ ID NO:507), Public GI ID no. 61611682 (SEQ ID NO:509), Public GI ID no. 36789785 (SEQ ID NO:512), Ceres CLONE ID no. 702632 (SEQ ID NO:514), Public GI ID no. 61657299 (SEQ ID NO:515), Public GI ID no. 10946337 (SEQ ID NO:516), Ceres CLONE ID no. 1996408 (SEQ ID NO:518), Ceres CLONE ID no. 1725313 (SEQ ID NO:520), Public GI ID no. 78058606 (SEQ ID NO:521), Public GI ID no. 125538317 (SEQ ID NO:522), Public GI ID no. 125556324 (SEQ ID NO:523), Public GI ID no. 125548890 (SEQ ID NO:524), Public GI ID no. 93211100 (SEQ ID NO:525), Public GI ID no. 115444217 (SEQ ID NO:526), Public GI ID no. 115467558 (SEQ ID NO:527), Public GI ID no. 11094209 (SEQ ID NO:528), Public GI ID no. 125596830 (SEQ ID NO:529), Public GI ID no. 115469296 (SEQ ID NO:530), Public GI ID no. 115447239 (SEQ ID NO:531), Public GI ID no. 21655154 (SEQ ID NO:532), Public GI ID no. 21667485 (SEQ ID NO:533), Public GI ID no. 21667475 (SEQ ID NO:534), Public GI ID no. 21655158 (SEQ ID NO:535), and sequences identified as functional homologs of the sequences of FIG. 6, as set forth in the sequence listing.

Polypeptides are shown in the sequence listing that have HMM bit scores greater than 20 when fitted to an HMM generated from the amino acid sequences set forth in FIG. 7. Such polypeptides include At1g70270 (SEQ ID NO:634), Public GI ID no. 98961985 (SEQ ID NO:637), Ceres CLONE ID no. 1916112 (SEQ ID NO:636), Public GI ID no. 9369405 (SEQ ID NO:638), Public GI ID no. 9369406 (SEQ ID NO:639), Ceres CLONE ID no. 1238706 (SEQ ID NO:641), and sequences identified as functional homologs of the sequences of FIG. 7, as set forth in the sequence listing.

Polypeptides are shown in the sequence listing that have HMM bit scores greater than 80 when fitted to an HMM generated from the amino acid sequences set forth in FIG. 8. Such polypeptides include At4g25480 (SEQ ID NO:644), SEQ ID NO:645, Ceres CLONE ID no. 1849479 (SEQ ID NO:767), Public GI ID no. 89275008 (SEQ ID NO:796), Public GI ID no. 120400525 (SEQ ID NO:797), Public GI ID no. 98980426 (SEQ ID NO:804), Public GI ID no. 71983373 (SEQ ID NO:808), Public GI ID no. 41351817 (SEQ ID NO:809), Public GI ID no. 76446191 (SEQ ID NO:811), Public GI ID no. 5616086 (SEQ ID NO:813), Ceres CLONE ID no. 1052602 (SEQ ID NO:826), Public GI ID no. 72068957 (SEQ ID NO:830), Public GI ID no. 71534113 (SEQ ID NO:831), Public GI ID no. 37147896 (SEQ ID NO:832), Public GI ID no. 92918850 (SEQ ID NO:834), Public GI ID no. 40647095 (SEQ ID NO:835), Ceres ANNOT ID no. 1527711 (SEQ ID NO:837), Public GI ID no. 71041116 (SEQ ID NO:838), Public GI ID no. 12003384 (SEQ ID NO:839), Public GI ID no. 18535580 (SEQ ID NO:840), Ceres CLONE ID no. 991178 (SEQ ID NO:647), Ceres CLONE ID no. 1626038 (SEQ ID NO:649), Ceres CLONE ID no. 341615 (SEQ ID NO:651), Ceres CLONE ID no. 1832518 (SEQ ID NO:653), Ceres CLONE ID no. 1832588 (SEQ ID NO:655), Ceres CLONE ID no. 1936806 (SEQ ID NO:657), Ceres CLONE ID no. 973892 (SEQ ID NO:659), Ceres CLONE ID no. 565251 (SEQ ID NO:661), Ceres CLONE ID no. 681088 (SEQ ID NO:663), Ceres CLONE ID no. 707775 (SEQ ID NO:665), Ceres CLONE ID no. 453357 (SEQ ID NO:667), Ceres CLONE ID no. 1916958 (SEQ ID NO:669), Ceres CLONE ID no. 1940632 (SEQ ID NO:671), Ceres CLONE ID no. 476784 (SEQ ID NO:673), Ceres CLONE ID no. 1869284 (SEQ ID NO:675), Public GI ID no. 125540662 (SEQ ID NO:676), Ceres CLONE ID no. 1648272 (SEQ ID NO:678), Ceres CLONE ID no. 1987804 (SEQ ID NO:680), Ceres CLONE ID no. 1675695 (SEQ ID NO:682), Ceres CLONE ID no. 1169111 (SEQ ID NO:684), Ceres CLONE ID no. 572121 (SEQ ID NO:686), Ceres CLONE ID no. 1674836 (SEQ ID NO:688), Ceres ANNOT ID no. 1486207 (SEQ ID NO:690), Ceres CLONE ID no. 2023610 (SEQ ID NO:692), Ceres ANNOT ID no. 1496976 (SEQ ID NO:694), Public GI ID no. 116310031 (SEQ ID NO:695), Ceres CLONE ID no. 1626363 (SEQ ID NO:697), Ceres ANNOT ID no. 1483747 (SEQ ID NO:699), Ceres ANNOT ID no. 1471330 (SEQ ID NO:701), Ceres CLONE ID no. 101144964 (SEQ ID NO:702), Ceres ANNOT ID no. 1439439 (SEQ ID NO:704), Ceres CLONE ID no. 1446565 (SEQ ID NO:706), Ceres CLONE ID no. 1951962 (SEQ ID NO:708), Ceres CLONE ID no. 100960656 (SEQ ID NO:709), Ceres CLONE ID no. 285154 (SEQ ID NO:711), Public GI ID no. 61968916 (SEQ ID NO:712), Public GI ID no. 118026854 (SEQ ID NO:713), Public GI ID no. 63098612 (SEQ ID NO:714), Ceres ANNOT ID no. 1522310 (SEQ ID NO:716), Ceres CLONE ID no. 1854375 (SEQ ID NO:718), Ceres CLONE ID no. 709819 (SEQ ID NO:720), Public GI ID no. 115447695 (SEQ ID NO:721), Ceres CLONE ID no. 1726356 (SEQ ID NO:723), Ceres CLONE ID no. 1762419 (SEQ ID NO:725), Public GI ID no. 63098606 (SEQ ID NO:726), Ceres CLONE ID no. 1766572 (SEQ ID NO:728), Ceres CLONE ID no. 281871 (SEQ ID NO:730), Ceres CLONE ID no. 1560970 (SEQ ID NO:732), Ceres CLONE ID no. 1760747 (SEQ ID NO:734), Ceres ANNOT ID no. 1438772 (SEQ ID NO:736), Ceres ANNOT ID no. 1447378 (SEQ ID NO:738), Ceres ANNOT ID no. 1453360 (SEQ ID NO:740), Public GI ID no. 33637698 (SEQ ID NO:741), Public GI ID no. 118026860 (SEQ ID NO:742), Public GI ID no. 60116232 (SEQ ID NO:743), Public GI ID no.115477639 (SEQ ID NO:744), Public GI ID no.126567023 (SEQ ID NO:745), Ceres CLONE ID no.988971 (SEQ ID NO:747), Ceres CLONE ID no.1464521 (SEQ ID NO:749), Public GI ID no.63098610 (SEQ ID NO:750), Public GI ID no.126566972 (SEQ ID NO:751), Ceres CLONE ID no.1556129 (SEQ ID NO:753), Ceres CLONE ID no.1761385 (SEQ ID NO:755), Ceres ANNOT ID no.1488325 (SEQ ID NO:757), Ceres ANNOT ID no.1460483 (SEQ ID NO:759), Ceres CLONE ID no.1837825 (SEQ ID NO:761), Public GI ID no.27228310 (SEQ ID NO:762), Public GI ID no.117653881 (SEQ ID NO:763), Public GI ID no.115480233 (SEQ ID NO:764), Public GI ID no.37694048 (SEQ ID NO:765), Ceres CLONE ID no.1934653 (SEQ ID NO:769), Ceres CLONE ID no.1608106 (SEQ ID NO:771), Ceres CLONE ID no.1604576 (SEQ ID NO:773), Public GI ID no.55824656 (SEQ ID NO:774), Ceres CLONE ID no.1620272 (SEQ ID NO:776), Ceres CLONE ID no.1853170 (SEQ ID NO:778), Public GI ID no.79013962 (SEQ ID NO:779), Public GI ID no.98975385 (SEQ ID NO:780), Ceres ANNOT ID no.1438775 (SEQ ID NO:782), Public GI ID no.23495460 (SEQ ID NO:783), Public GI ID no.98975377 (SEQ ID NO:784), Ceres ANNOT ID no.1438776 (SEQ ID NO:786), Ceres CLONE ID no.1853601 (SEQ ID NO:788), Ceres CLONE ID no.1609048 (SEQ ID NO:790), Ceres CLONE ID no.322305 (SEQ ID NO:792), Ceres CLONE ID no.1823713 (SEQ ID NO:794), Public GI ID no.3660548 (SEQ ID NO:795), Public GI ID no.56154991 (SEQ ID NO:798), Public GI ID no.2980802 (SEQ ID NO:799), Public GI ID no.7269398 (SEQ ID NO:800), Public GI ID no.18416557 (SEQ ID NO:801), Public GI ID no.56154992 (SEQ ID NO:802), Public GI ID no.4091984 (SEQ ID NO:803), Public GI ID no.1899058 (SEQ ID NO:805), Public GI ID no.56154990 (SEQ ID NO:806), Public GI ID no.18416562 (SEQ ID NO:807), Public GI ID no.38683266 (SEQ ID NO:810), Public GI ID no.39983638 (SEQ ID NO:812), Public GI ID no.38426954 (SEQ ID NO:814), Public GI ID no.38426948 (SEQ ID NO:815), Public GI ID no.38146944 (SEQ ID NO:816), Public GI ID no.38426952 (SEQ ID NO:817), Public GI ID no.20303011 (SEQ ID NO:818), Public GI ID no.66269982 (SEQ ID NO:819), Public GI ID no.89212816 (SEQ ID NO:820), Public GI ID no.20303015 (SEQ ID NO:821), Public GI ID no.38426950 (SEQ ID NO:822), Public GI ID no.15242244 (SEQ ID NO:823), Public GI ID no.116831599 (SEQ ID NO:824), Public GI ID no.66269671 (SEQ ID NO:827), Ceres ANNOT ID no.1468919 (SEQ ID NO:829), Public GI ID no.57903606 (SEQ ID NO:833), Public GI ID no.45826358 (SEQ ID NO:841), Ceres ANNOT ID no.6085912 (SEQ ID NO:843), Ceres ANNOT ID no.6026171 (SEQ ID NO:845), Ceres ANNOT ID no.6031706 (SEQ ID NO:847), Public GI ID no. 115353971 (SEQ ID NO:1843), and sequences identified as functional homologs of the sequences of FIG. 8, as set forth in the sequence listing.

Polypeptides are shown in the sequence listing that have HMM bit scores greater than 170 when fitted to an HMM generated from the amino acid sequences set forth in FIG. 9. Such polypeptides include A2g33780 (SEQ ID NO:850), Ceres CLONE ID no.1833093 (SEQ ID NO:853), Ceres ANNOT ID no.1502190 (SEQ ID NO:857), Ceres CLONE ID no.565641 (SEQ ID NO:876), Public GI ID no.87240507 (SEQ ID NO:877), Ceres CLONE ID no.1325382 (SEQ ID NO:881), Ceres CLONE ID no.1558265 (SEQ ID NO:885), Ceres CLONE ID no.1823669 (SEQ ID NO:895), Public GI ID no.115464921 (SEQ ID NO:898), Ceres CLONE ID no.100040598 (SEQ ID NO:851), Ceres CLONE ID no.1847967 (SEQ ID NO:855), Ceres ANNOT ID no.1449186 (SEQ ID NO:859), Ceres ANNOT ID no.1466723 (SEQ ID NO:861), Public GI ID no.21805688 (SEQ ID NO:862), Public GI ID no.9795609 (SEQ ID NO:863), Public GI ID no.13877535 (SEQ ID NO:864), Public GI ID no.15232547 (SEQ ID NO:865), Public GI ID no.15238851 (SEQ ID NO:866), Ceres CLONE ID no.123863 (SEQ ID NO:868), Ceres CLONE ID no.652496 (SEQ ID NO:870), Ceres CLONE ID no.1656707 (SEQ ID NO:872), Ceres CLONE ID no.1660346 (SEQ ID NO:874), Ceres CLONE ID no.678878 (SEQ ID NO:879), Ceres CLONE ID no.340102 (SEQ ID NO:883), Ceres CLONE ID no.330491 (SEQ ID NO:887), Ceres CLONE ID no.992304 (SEQ ID NO:889), Ceres CLONE ID no.1509925 (SEQ ID NO:891), Ceres CLONE ID no.1543852 (SEQ ID NO:893), Ceres CLONE ID no.1785736 (SEQ ID NO:897), Ceres ANNOT ID no.6079909 (SEQ ID NO:900), Ceres ANNOT ID no.6040353 (SEQ ID NO:902), Ceres ANNOT ID no.6100173 (SEQ ID NO:904), and sequences identified as functional homologs of the sequences of FIG. 9, as set forth in the sequence listing.

Polypeptides are shown in the sequence listing that have HMM bit scores greater than 80 when fitted to an HMM generated from the amino acid sequences set forth in FIG. 10. Such polypeptides include At4g17810 (SEQ ID NO:907), Ceres CLONE ID no.1940797 (SEQ ID NO:909), Ceres ANNOT ID no.1538900 (SEQ ID NO:911), Ceres CLONE ID no.1126868 (SEQ ID NO:922), Public GI ID no.89257684 (SEQ ID NO:923), Public GI ID no.124360460 (SEQ ID NO:929), Public GI ID no.62865694 (SEQ ID NO:931), Public GI ID no.62865692 (SEQ ID NO:932), Ceres CLONE ID no.260368 (SEQ ID NO:936), Ceres CLONE ID no.1873510 (SEQ ID NO:947), Public GI ID no.125541662 (SEQ ID NO:948), Public GI ID no.48716268 (SEQ ID NO:950), Ceres ANNOT ID no.1529131 (SEQ ID NO:913), Ceres ANNOT ID no.1454060 (SEQ ID NO:915), Ceres ANNOT ID no.1442787 (SEQ ID NO:917), Ceres ANNOT ID no.1452648 (SEQ ID NO:919), Public GI ID no.2245140 (SEQ ID NO:920), Public GI ID no.89274212 (SEQ ID NO:924), Ceres CLONE ID no.1104523 (SEQ ID NO:926), Ceres CLONE ID no.654265 (SEQ ID NO:928), Public GI ID no.42627704 (SEQ ID NO:930), Ceres CLONE ID no.887222 (SEQ ID NO:934), Public GI ID no.62865690 (SEQ ID NO:937), Public GI ID no.64175600 (SEQ ID NO:938), Public GI ID no.64175634 (SEQ ID NO:939), Public GI ID no.64175606 (SEQ ID NO:940), Public GI ID no.64175648 (SEQ ID NO:941), Ceres CLONE ID no.312184 (SEQ ID NO:943), Ceres CLONE ID no.380740 (SEQ ID NO:945), Public GI ID no.125531536 (SEQ ID NO:949), Public GI ID no. 62865696 (SEQ ID NO:1844), and sequences identified as functional homologs of the sequences of FIG. 10, as set forth in the sequence listing.

Polypeptides are shown in the sequence listing that have HMM bit scores greater than 60 when fitted to an HMM generated from the amino acid sequences set forth in FIG. 11. Such polypeptides include At1g13360 (SEQ ID NO:951), Ceres CLONE ID no.1798705 (SEQ ID NO:955), Ceres ANNOT ID no.1458907 (SEQ ID NO:963), Ceres CLONE ID no.1090409 (SEQ ID NO:971), Ceres CLONE ID no.479817 (SEQ ID NO:977), Ceres CLONE ID no.1041793 (SEQ ID NO:979), Ceres CLONE ID no.684633 (SEQ ID NO:985), Ceres CLONE ID no.371815 (SEQ ID NO:991), Ceres CLONE ID no.1686460 (SEQ ID NO:993), Ceres CLONE ID no.1448595 (SEQ ID NO:995), Ceres CLONE ID no.1734477 (SEQ ID NO:999), Ceres CLONE ID no.1605693 (SEQ ID NO:1005), Ceres CLONE ID no.1757400 (SEQ ID NO:1009), Public GI ID no.115434334 (SEQ ID NO:1015), Ceres CLONE ID no.1793754 (SEQ ID NO:957), Ceres CLONE ID no.1938045 (SEQ ID NO:959), Ceres CLONE ID no.1850004 (SEQ ID NO:961), Ceres ANNOT ID no.1489548 (SEQ ID NO:965), Public GI ID no.22329538 (SEQ ID NO:966), Public GI ID no.18404714 (SEQ ID NO:967), Ceres CLONE ID no.1110032 (SEQ ID NO:969), Ceres CLONE ID no.1095353 (SEQ ID NO:973), Ceres CLONE ID no.872121 (SEQ ID NO:975), Ceres CLONE ID no.562208 (SEQ ID NO:981), Ceres CLONE ID no.1042364 (SEQ ID NO:983), Ceres CLONE ID no.1031873 (SEQ ID NO:987), Ceres CLONE ID no.1377698 (SEQ ID NO:989), Ceres CLONE ID no.1742945 (SEQ ID NO:997), Ceres CLONE ID no.1742053 (SEQ ID NO:1001), Ceres CLONE ID no.1728365 (SEQ ID NO:1003), Ceres CLONE ID no.1609807 (SEQ ID NO:1007), Ceres CLONE ID no.1778566 (SEQ ID NO:1011), Ceres CLONE ID no.2020580 (SEQ ID NO:1013), Public GI ID no.125524285 (SEQ ID NO:1014), Public GI ID no.125568898 (SEQ ID NO:1016), Ceres ANNOT ID no.6055303 (SEQ ID NO:1018), and sequences identified as functional homologs of the sequences of FIG. 11, as set forth in the sequence listing.

Polypeptides are shown in the sequence listing that have HMM bit scores greater than 140 when fitted to an HMM generated from the amino acid sequences set forth in FIG. 12. Such polypeptides include At1g75860 (SEQ ID NO:1024), Ceres ANNOT ID no.1452905 (SEQ ID NO:1029), Ceres CLONE ID no.956176 (SEQ ID NO:1039), Public GI ID no.92870366 (SEQ ID NO:1040), Ceres CLONE ID no.294166 (SEQ ID NO:1042), Public GI ID no.125543067 (SEQ ID NO:1043), SEQ ID NO:1025, Ceres ANNOT ID no.1442522 (SEQ ID NO:1027), Public GI ID no.8778818 (SEQ ID NO:1030), Ceres CLONE ID no.108095 (SEQ ID NO:1032), Public GI ID no.18394821 (SEQ ID NO:1033), Ceres CLONE ID no.6332 (SEQ ID NO:1035), Ceres CLONE ID no.1069047 (SEQ ID NO:1037), Public GI ID no.115480956 (SEQ ID NO:1044), and sequences identified as functional homologs of the sequences of FIG. 12, as set forth in the sequence listing.

Polypeptides are shown in the sequence listing that have HMM bit scores greater than 80 when fitted to an HMM generated from the amino acid sequences set forth in FIG. 13. Such polypeptides include At4g19700 (SEQ ID NO:1047), Ceres CLONE ID no.1837694 (SEQ ID NO:1053), Ceres ANNOT ID no.1483367 (SEQ ID NO:1057), Ceres CLONE ID no.1077781 (SEQ ID NO:1083), Ceres CLONE ID no.471026 (SEQ ID NO:1085), Public GI ID no.92888885 (SEQ ID NO:1099), Public GI ID no.45544873 (SEQ ID NO:1100), Public GI ID no.45758663 (SEQ ID NO:1101), Ceres CLONE ID no.772927 (SEQ ID NO:1105), Ceres CLONE ID no.895080 (SEQ ID NO:1111), Ceres CLONE ID no.1806128 (SEQ ID NO:1131), Public GI ID no.115458192 (SEQ ID NO:1134), Public GI ID no.82470795 (SEQ ID NO:1139), Ceres CLONE ID no.1837746 (SEQ ID NO:1049), Ceres CLONE ID no.1834764 (SEQ ID NO:1051), Ceres CLONE ID no.1853547 (SEQ ID NO:1055), Ceres ANNOT ID no.1474088 (SEQ ID NO:1059), Ceres ANNOT ID no.1536919 (SEQ ID NO:1061), Ceres ANNOT ID no.1467033 (SEQ ID NO:1063), Ceres ANNOT ID no.1485401 (SEQ ID NO:1065), Ceres ANNOT ID no.1486505 (SEQ ID NO:1067), Public GI ID no.17065054 (SEQ ID NO:1068), Public GI ID no.30694690 (SEQ ID NO:1069), Ceres CLONE ID no.12997 (SEQ ID NO:1071), Public GI ID no.30694694 (SEQ ID NO:1072), Public GI ID no.42572167 (SEQ ID NO:1073), Public GI ID no.110739742 (SEQ ID NO:1074), Public GI ID no.18412263 (SEQ ID NO:1075), Ceres CLONE ID no.36412 (SEQ ID NO:1077), Public GI ID no.18399792 (SEQ ID NO:1078), Ceres CLONE ID no.924 (SEQ ID NO:1080), Public GI ID no.15238000 (SEQ ID NO:1081), Ceres CLONE ID no.1626330 (SEQ ID NO:1087), Ceres CLONE ID no.1650419 (SEQ ID NO:1089), Ceres CLONE ID no.1641329 (SEQ ID NO:1091), Ceres CLONE ID no.1620406 (SEQ ID NO:1093), Ceres CLONE ID no.546832 (SEQ ID NO:1095), Ceres CLONE ID no.1243138 (SEQ ID NO:1097), Public GI ID no.92887260 (SEQ ID NO:1098), Ceres CLONE ID no.885628 (SEQ ID NO:1103), Ceres CLONE ID no.1376391 (SEQ ID NO:1107), Ceres CLONE ID no.465893 (SEQ ID NO:1109), Ceres CLONE ID no.218243 (SEQ ID NO:1113), Ceres CLONE ID no.1558456 (SEQ ID NO:1115), Ceres CLONE ID no.343008 (SEQ ID NO:1117), Ceres CLONE ID no.218463 (SEQ ID NO:1119), Ceres CLONE ID no.1565409 (SEQ ID NO:1121), Ceres CLONE ID no.1060968 (SEQ ID NO:1123), Ceres CLONE ID no.236111 (SEQ ID NO:1125), Ceres CLONE ID no.285598 (SEQ ID NO:1127), Ceres CLONE ID no.225881 (SEQ ID NO:1129), Ceres CLONE ID no.1811383 (SEQ ID NO:1133), Public GI ID no.49388268 (SEQ ID NO:1135), Public GI ID no.125590268 (SEQ ID NO:1136), Public GI ID no.115444009 (SEQ ID NO:1137), Public GI ID no.115447993 (SEQ ID NO:1138), Ceres ANNOT ID no.6033842 (SEQ ID NO:1141), Ceres ANNOT ID no.6029952 (SEQ ID NO:1143), Ceres ANNOT ID no.6035837 (SEQ ID NO:1145), Ceres ANNOT ID no.6035830 (SEQ ID NO:1147), Ceres ANNOT ID no.6029981 (SEQ ID NO:1149), and sequences identified as functional homologs of the sequences of FIG. 13, as set forth in the sequence listing.

Polypeptides are shown in the sequence listing that have HMM bit scores greater than 80 when fitted to an HMM generated from the amino acid sequences set forth in FIG. 14. Such polypeptides include At1g58100 (SEQ ID NO:1151), Ceres CLONE ID no.1851526 (SEQ ID NO:1155), Ceres ANNOT ID no.1486769 (SEQ ID NO:1172), Public GI ID no.83032232 (SEQ ID NO:1209), Ceres CLONE ID no.1620420 (SEQ ID NO:1211), Public GI ID no.92892428 (SEQ ID NO:1215), Ceres CLONE ID no.884742 (SEQ ID NO:1223), Ceres CLONE ID no.1821559 (SEQ ID NO:1246), Public GI ID no.51535021 (SEQ ID NO:1258), Public GI ID no.113205304 (SEQ ID NO:1263), Public GI ID no.37719051 (SEQ ID NO:1264), Ceres CLONE ID no.1918070 (SEQ ID NO:1153), Ceres CLONE ID no.1948426 (SEQ ID NO:1157), Ceres CLONE ID no.1937875 (SEQ ID NO:1159), Ceres CLONE ID no.100056542 (SEQ ID NO:1160), Public GI ID no.5731257 (SEQ ID NO:1161), Ceres CLONE ID no.100058043 (SEQ ID NO:1162), Ceres CLONE ID no.1838288 (SEQ ID NO:1164), Ceres CLONE ID no.1793597 (SEQ ID NO:1166), Ceres ANNOT ID no.1543031 (SEQ ID NO:1168), Ceres ANNOT ID no.1489643 (SEQ ID NO:1170), Ceres ANNOT ID no.1479721 (SEQ ID NO:1174), Ceres ANNOT ID no.1449170 (SEQ ID NO:1176), Ceres ANNOT ID no.1493696 (SEQ ID NO:1178), Ceres ANNOT ID no.1543534 (SEQ ID NO:1180), Ceres ANNOT ID no.1440815 (SEQ ID NO:1182), Ceres ANNOT ID no.1490137 (SEQ ID NO:1184), Ceres ANNOT ID no.1451054 (SEQ ID NO:1186), Ceres ANNOT ID no.1456669 (SEQ ID NO:1188), Ceres ANNOT ID no.1509865 (SEQ ID NO:1190), Ceres ANNOT ID no.1447910 (SEQ ID NO:1192), Ceres ANNOT ID no.1471068 (SEQ ID NO:1194), Ceres ANNOT ID no.1504118 (SEQ ID NO:1196), Ceres CLONE ID no.1343621 (SEQ ID NO:1198), Public GI ID no.15218305 (SEQ ID NO:1199), Public GI ID no.15219640 (SEQ ID NO:1200), Public GI ID no.18409345 (SEQ ID NO:1201), Public GI ID no.6522545 (SEQ ID NO:1202), Public GI ID no.15237274 (SEQ ID NO:1203), Public GI ID no.26452377 (SEQ ID NO:1204), Ceres CLONE ID no.33629 (SEQ ID NO:1206), Ceres CLONE ID no.1064407 (SEQ ID NO:1208), Ceres CLONE ID no.1656310 (SEQ ID NO:1213), Public GI ID no.92885257 (SEQ ID NO:1214), Public GI ID no.92868571 (SEQ ID NO:1216), Public GI ID no.53689778 (SEQ ID NO:1217), Ceres CLONE ID no.835598 (SEQ ID NO:1219), Ceres CLONE ID no.575649 (SEQ ID NO:1221), Ceres CLONE ID no.376567 (SEQ ID NO:1225), Ceres CLONE ID no.1284191 (SEQ ID NO:1227), Ceres CLONE ID no.367175 (SEQ ID NO:1229), Ceres CLONE ID no.100748296 (SEQ ID NO:1230), Ceres CLONE ID no.1597176 (SEQ ID NO:1232), Ceres CLONE ID no.375636 (SEQ ID NO:1234), Ceres CLONE ID no.288123 (SEQ ID NO:1236), Ceres CLONE ID no.303582 (SEQ ID NO:1238), Ceres CLONE ID no.1604759 (SEQ ID NO:1240), Ceres CLONE ID no.1955192 (SEQ ID NO:1242), Ceres CLONE ID no.2008687 (SEQ ID NO:1244), Ceres CLONE ID no.1995843 (SEQ ID NO:1248), Ceres CLONE ID no.2008591 (SEQ ID NO:1250), Ceres CLONE ID no.2046826 (SEQ ID NO:1252), Ceres CLONE ID no.1985573 (SEQ ID NO:1254), Public GI ID no.125541129 (SEQ ID NO:1255), Public GI ID no.125528922 (SEQ ID NO:1256), Public GI ID no.115487590 (SEQ ID NO:1257), Public GI ID no.115448671 (SEQ ID NO:1259), Public GI ID no.125596564 (SEQ ID NO:1260), Public GI ID no.125573161 (SEQ ID NO:1261), Public GI ID no.48716463 (SEQ ID NO:1262), Ceres ANNOT ID no.6054246 (SEQ ID NO:1266), Ceres ANNOT ID no.6086570 (SEQ ID NO:1268), Ceres ANNOT ID no.6024957 (SEQ ID NO:1270), Ceres ANNOT ID no.6016867 (SEQ ID NO:1272), Ceres ANNOT ID no.6091369 (SEQ ID NO:1274), and sequences identified as functional homologs of the sequences of FIG. 14, as set forth in the sequence listing.

Polypeptides are shown in the sequence listing that have HMM bit scores greater than 180 when fitted to an HMM generated from the amino acid sequences set forth in FIG. 15. Such polypeptides include At5g46170 (SEQ ID NO:1277), Ceres CLONE ID no.1926352 (SEQ ID NO:1279), Ceres ANNOT ID no.1448905 (SEQ ID NO:1285), Public GI ID no.15236865 (SEQ ID NO:1294), Ceres CLONE ID no.934771 (SEQ ID NO:1301), Ceres CLONE ID no.338386 (SEQ ID NO:1303), Ceres CLONE ID no.1780691 (SEQ ID NO:1317), Public GI ID no.115464819 (SEQ ID NO:1326), Ceres CLONE ID no.1848576 (SEQ ID NO:1281), Ceres CLONE ID no.1981528 (SEQ ID NO:1283), Ceres ANNOT ID no.1465978 (SEQ ID NO:1287), Ceres ANNOT ID no.1504997 (SEQ ID NO:1289), Ceres ANNOT ID no.1451909 (SEQ ID NO:1291), Ceres ANNOT ID no.1461635 (SEQ ID NO:1293), Public GI ID no.18397400 (SEQ ID NO:1295), Ceres CLONE ID no.16226 (SEQ ID NO:1297), Public GI ID no.18411823 (SEQ ID NO:1298), Public GI ID no.15219845 (SEQ ID NO:1299), Ceres CLONE ID no.1276710 (SEQ ID NO:1305), Ceres CLONE ID no.1479310 (SEQ ID NO:1307), Ceres CLONE ID no.376230 (SEQ ID NO:1309), Ceres CLONE ID no.1290713 (SEQ ID NO:1311), Ceres CLONE ID no.321681 (SEQ ID NO:1313), Ceres CLONE ID no.1869072 (SEQ ID NO:1315), Ceres CLONE ID no.1818502 (SEQ ID NO:1319), Ceres CLONE ID no.1750477 (SEQ ID NO:1321), Public GI ID no.125552947 (SEQ ID NO:1322), Public GI ID no.125527862 (SEQ ID NO:1323), Public GI ID no.125543660 (SEQ ID NO:1324), Public GI ID no.125528123 (SEQ ID NO:1325), Public GI ID no.115440195 (SEQ ID NO:1327), Public GI ID no.115452717 (SEQ ID NO:1328), Public GI ID no.115440629 (SEQ ID NO:1329), Public GI ID no.115464599 (SEQ ID NO:1330), Public GI ID no.20161462 (SEQ ID NO:1331), Public GI ID no.125586076 (SEQ ID NO:1332), Ceres CLONE ID no.1823216 (SEQ ID NO:1334), Ceres ANNOT ID no.6040230 (SEQ ID NO:1336), Ceres ANNOT ID no.6015489 (SEQ ID NO:1338), Ceres ANNOT ID no.6042890 (SEQ ID NO:1340), Ceres ANNOT ID no.6040033 (SEQ ID NO:1342), Ceres ANNOT ID no.6018414 (SEQ ID NO:1344), and sequences identified as functional homologs of the sequences of FIG. 15, as set forth in the sequence listing.

Polypeptides are shown in the sequence listing that have HMM bit scores greater than 60 when fitted to an HMM generated from the amino acid sequences set forth in FIG. 16. Such polypeptides include At4g32280 (SEQ ID NO:1347), Ceres CLONE ID no.285028 (SEQ ID NO:1419), Ceres CLONE ID no.100969565 (SEQ ID NO:1422), Public GI ID no.1352057 (SEQ ID NO:1427), Ceres ANNOT ID no.1453784 (SEQ ID NO:1429), Public GI ID no.452777 (SEQ ID NO:1430), Public GI ID no.92873297 (SEQ ID NO:1431), Ceres ANNOT ID no.1452612 (SEQ ID NO:1349), Ceres CLONE ID no.520455 (SEQ ID NO:1351), Public GI ID no.75271810 (SEQ ID NO:1352), Public GI ID no.115489446 (SEQ ID NO:1353), Ceres CLONE ID no.499878 (SEQ ID NO:1355), Ceres ANNOT ID no.1491840 (SEQ ID NO:1357), Public GI ID no.125587204 (SEQ ID NO:1358), Ceres CLONE ID no.320997 (SEQ ID NO:1360), Ceres ANNOT ID no.1455585 (SEQ ID NO:1362), Ceres ANNOT ID no.1499460 (SEQ ID NO:1364), Ceres CLONE ID no.334484 (SEQ ID NO:1366), Ceres CLONE ID no.100819481 (SEQ ID NO:1367), Public GI ID no.115462401 (SEQ ID NO:1368), Ceres CLONE ID no.1448136 (SEQ ID NO:1370), Ceres CLONE ID no.277751 (SEQ ID NO:1372), Ceres ANNOT ID no.1491839 (SEQ ID NO:1374), Ceres CLONE ID no.100913241 (SEQ ID NO:1375), Ceres CLONE ID no.1053224 (SEQ ID NO:1377), Ceres CLONE ID no.425766 (SEQ ID NO:1379), Ceres CLONE ID no.485480 (SEQ ID NO:1381), Ceres CLONE ID no.474845 (SEQ ID NO:1383), Ceres CLONE ID no.354561 (SEQ ID NO:1385), Ceres CLONE ID no.540858 (SEQ ID NO:1387), Ceres CLONE ID no.2032994 (SEQ ID NO:1389), Ceres CLONE ID no.2015315 (SEQ ID NO:1391), Ceres CLONE ID no.2016149 (SEQ ID NO:1393), Ceres CLONE ID no.1922843 (SEQ ID NO:1395), Ceres CLONE ID no.2000263 (SEQ ID NO:1397), Ceres CLONE ID no.1943510 (SEQ ID NO:1399), Ceres CLONE ID no.1835498 (SEQ ID NO:1401), Ceres CLONE ID no.101116694 (SEQ ID NO:1402), Ceres CLONE ID no.1930596 (SEQ ID NO:1404), Ceres CLONE ID no.846036 (SEQ ID NO:1406), Ceres CLONE ID no.941614 (SEQ ID NO:1408), Ceres CLONE ID no.238788 (SEQ ID NO:1410), Public GI ID no.125554220 (SEQ ID NO:1411), Public GI ID no.125559895 (SEQ ID NO:1412), Public GI ID no.75252070 (SEQ ID NO:1413), Public GI ID no.115466632 (SEQ ID NO:1414), Public GI ID no.125541525 (SEQ ID NO:1415), Ceres CLONE ID no.1805110 (SEQ ID NO:1417), Ceres CLONE ID no.1725309 (SEQ ID NO:1421), Ceres CLONE ID no.100861679 (SEQ ID NO:1423), Public GI ID no.75226278 (SEQ ID NO:1424), Public GI ID no.125525030 (SEQ ID NO:1425), Public GI ID no.115435474 (SEQ ID NO:1426), Ceres CLONE ID no.1728516 (SEQ ID NO:1433), Public GI ID no.115467910 (SEQ ID NO:1434), Public GI ID no.15239950 (SEQ ID NO:1435), Public GI ID no.4887012 (SEQ ID NO:1436), Ceres ANNOT ID no.1478544 (SEQ ID NO:1438), Public GI ID no.90811713 (SEQ ID NO:1439), Public GI ID no.25989504 (SEQ ID NO:1440), Ceres CLONE ID no.1113354 (SEQ ID NO:1442), Ceres CLONE ID no.1113630 (SEQ ID NO:1444), Ceres ANNOT ID no.6072030 (SEQ ID NO:1446), Ceres ANNOT ID no.6025654 (SEQ ID NO:1448), Ceres ANNOT ID no.6091150 (SEQ ID NO:1450), Ceres ANNOT ID no.6100390 (SEQ ID NO:1452), and sequences identified as functional homologs of the sequences of FIG. 16, as set forth in the sequence listing.

Polypeptides are shown in the sequence listing that have HMM bit scores greater than 270 when fitted to an HMM generated from the amino acid sequences set forth in FIG. 17. Such polypeptides include At3g02830 (SEQ ID NO:1457), Ceres CLONE ID no.1924904 (SEQ ID NO:1460), Ceres ANNOT ID no.1543346 (SEQ ID NO:1462), Public GI ID no.18396338 (SEQ ID NO:1467), Ceres CLONE ID no.833872 (SEQ ID NO:1471), Ceres CLONE ID no.1579587 (SEQ ID NO:1475), Ceres CLONE ID no.1786411 (SEQ ID NO:1477), Public GI ID no.108864370 (SEQ ID NO:1480), SEQ ID NO:1458, Ceres ANNOT ID no.1532932 (SEQ ID NO:1464), Ceres ANNOT ID no.1489955 (SEQ ID NO:1466), Public GI ID no.4928917 (SEQ ID NO:1468), Public GI ID no.6728979 (SEQ ID NO:1469), Ceres CLONE ID no.285780 (SEQ ID NO:1473), Public GI ID no.125528863 (SEQ ID NO:1478), Public GI ID no.125536365 (SEQ ID NO:1479), Public GI ID no.108864369 (SEQ ID NO:1481), Public GI ID no.115488274 (SEQ ID NO:1482), Public GI ID no.125577099 (SEQ ID NO:1483), Public GI ID no.125573110 (SEQ ID NO:1484), Public GI ID no.124359159 (SEQ ID NO:1485), Public GI ID no.62901479 (SEQ ID NO:1486), Ceres ANNOT ID no.6016783 (SEQ ID NO:1488), Ceres ANNOT ID no.6020759 (SEQ ID NO:1490), Ceres ANNOT ID no.6028676 (SEQ ID NO:1492), Ceres ANNOT ID no.6028677 (SEQ ID NO:1494), and sequences identified as functional homologs of the sequences of FIG. 17, as set forth in the sequence listing.

Polypeptides are shown in the sequence listing that have HMM bit scores greater than 70 when fitted to an HMM generated from the amino acid sequences set forth in FIG. 18. Such polypeptides include At4g08920 (SEQ ID NO:1497), Ceres ANNOT ID no.1443463 (SEQ ID NO:1499), Public GI ID no.13605525 (SEQ ID NO:1502), Public GI ID no.94965681 (SEQ ID NO:1506), Public GI ID no.28201254 (SEQ ID NO:1512), Ceres ANNOT ID no.1504954 (SEQ ID NO:1501), Public GI ID no.2499553 (SEQ ID NO:1503), Public GI ID no.738308 (SEQ ID NO:1504), Public GI ID no.4325368 (SEQ ID NO:1505), Ceres CLONE ID no.919923 (SEQ ID NO:1508), Ceres CLONE ID no.1659764 (SEQ ID NO:1510), Public GI ID no.125539984 (SEQ ID NO:1511), Public GI ID no.21740729 (SEQ ID NO:1513), Public GI ID no.115458700 (SEQ ID NO:1514), Public GI ID no.125590574 (SEQ ID NO:1515), Public GI ID no.16444957 (SEQ ID NO:1516), Ceres CLONE ID no.1784494 (SEQ ID NO:1518), Public GI ID no.77963980 (SEQ ID NO:1519), Public GI ID 110.124361190 (SEQ ID NO:1520), Public GI ID no.37725007 (SEQ ID NO:1521), Public GI ID no.45935258 (SEQ ID NO:1522), Public GI ID no.15559008 (SEQ ID NO:1523), Public GI ID no.38037416 (SEQ ID NO:1524), Public GI ID no.77963974 (SEQ ID NO:1525), Ceres ANNOT ID no.6112581 (SEQ ID NO:1527), Public GI ID no.56553448 (SEQ ID NO:1528), Public GI ID no.23506659 (SEQ ID NO:1529), Ceres ANNOT ID no.6118060 (SEQ ID NO:1531), Public GI ID no.46446306 (SEQ ID NO:1532), Public GI ID no.114321405 (SEQ ID NO:1533), Public GI ID no.83858274 (SEQ ID NO:1534), Public GI ID no.154250969 (SEQ ID NO:1535), Public GI ID no.83594235 (SEQ ID NO:1536), and sequences identified as functional homologs of the sequences of FIG. 18, as set forth in the sequence listing.

Polypeptides are shown in the sequence listing that have HMM bit scores greater than 130 when fitted to an HMM generated from the amino acid sequences set forth in FIG. 19. Such polypeptides include At4g11660 (SEQ ID NO:1587), Ceres CLONE ID no.1839577 (SEQ ID NO:1589), Ceres ANNOT ID no.1491567 (SEQ ID NO:1591), Ceres CLONE ID no.574505 (SEQ ID NO:1596), Public GI ID no.56117815 (SEQ ID NO:1597), Public GI ID no.92874021 (SEQ ID NO:1603), Public GI ID no.123684 (SEQ ID NO:1605), Public GI ID no.5821136 (SEQ ID NO:1606), Ceres CLONE ID no.283366 (SEQ ID NO:1609), Public GI ID no.16118447 (SEQ ID NO:1612), Public GI ID no.125562434 (SEQ ID NO:1614), Ceres ANNOT ID no.1438739 (SEQ ID NO:1593), Public GI ID no.89274218 (SEQ ID NO:1594), Public GI ID no.115521211 (SEQ ID NO:1598), Public GI ID no.115521213 (SEQ ID NO:1599), Public GI ID no.115521217 (SEQ ID NO:1600), Public GI ID no.115521209 (SEQ ID NO:1601), Public GI ID no.115521215 (SEQ ID NO:1602), Public GI ID no.11386827 (SEQ ID NO:1604), Public GI ID no.25052685 (SEQ ID NO:1607), Ceres CLONE ID no.1440437 (SEQ ID NO:1611), Public GI ID no.125564440 (SEQ ID NO:1613), Public GI ID no.116309817 (SEQ ID NO:1615), Public GI ID no.125549382 (SEQ ID NO:1616), Public GI ID no.52077317 (SEQ ID NO:1617), Public GI ID no.115477655 (SEQ ID NO:1618), Public GI ID no.42408097 (SEQ ID NO:1619), Public GI ID no.115459982 (SEQ ID NO:1620), Public GI ID no.33591096 (SEQ ID NO:1621), Ceres CLONE ID no.484753 (SEQ ID NO:1623), Ceres ANNOT ID no.6035291 (SEQ ID NO:1625), and sequences identified as functional homologs of the sequences of FIG. 19, as set forth in the sequence listing.

Polypeptides are shown in the sequence listing that have HMM bit scores greater than 570 when fitted to an HMM generated from the amino acid sequences set forth in FIG. 20. Such polypeptides include At2g45700 (SEQ ID NO:1635), Ceres ANNOT ID no.1508307 (SEQ ID NO:1637), Public GI ID no.1495267 (SEQ ID NO:1642), Public GI ID no.87241310 (SEQ ID NO:1644), Ceres CLONE ID no.938390 (SEQ ID NO:1646), Ceres CLONE ID no.272338 (SEQ ID NO:1648), Ceres CLONE ID no.1993510 (SEQ ID NO:1650), Public GI ID no.125563862 (SEQ ID NO:1651), Public GI ID no.125605833 (SEQ ID NO:1653), Public GI ID no.6899919 (SEQ ID NO:1632), Ceres ANNOT ID no.1455110 (SEQ ID NO:1639), Ceres ANNOT ID no.1525218 (SEQ ID NO:1641), Public GI ID no.15231597 (SEQ ID NO:1643), Public GI ID no.125548147 (SEQ ID NO:1652), Public GI ID no.51091343 (SEQ ID NO:1654), Public GI ID no.115479355 (SEQ ID NO:1655), Ceres ANNOT ID no.6042086 (SEQ ID NO:1657), Ceres ANNOT ID no.6029903 (SEQ ID NO:1659), and sequences identified as functional homologs of the sequences of FIG. 20, as set forth in the sequence listing.

Polypeptides are shown in the sequence listing that have HMM bit scores greater than 150 when fitted to an HMM generated from the amino acid sequences set forth in FIG. 21. Such polypeptides include At2g35940 (SEQ ID NO:1540), Ceres CLONE ID no.1943265 (SEQ ID NO:1543), Ceres ANNOT ID no.1454522 (SEQ ID NO:1547), Public GI ID no.31323447 (SEQ ID NO:1556), Ceres CLONE ID no.1583941 (SEQ ID NO:1561), Ceres CLONE ID no.1792942 (SEQ ID NO:1563), Public GI ID no.77548772 (SEQ ID NO:1565), Public GI ID no.84453182 (SEQ ID NO:1567), Public GI ID no.31746344 (SEQ ID NO:1541), Ceres CLONE ID no.1926640 (SEQ ID NO:1545), Ceres ANNOT ID no.1475125 (SEQ ID NO:1549), Ceres ANNOT ID no.1439653 (SEQ ID NO:1551), Ceres ANNOT ID no.1461995 (SEQ ID NO:1553), Public GI ID no.13877517 (SEQ ID NO:1554), Public GI ID no.7239157 (SEQ ID NO:1555), Public GI ID no.22652125 (SEQ ID NO:1557), Public GI ID no.22652115 (SEQ ID NO:1558), Public GI ID no.22652117 (SEQ ID NO:1559), Public GI ID no.125535858 (SEQ ID NO:1564), Public GI ID no.125578581 (SEQ ID NO:1566), Public GI ID no.13752407 (SEQ ID NO:1568), Ceres ANNOT ID no.6098817 (SEQ ID NO:1570), Ceres ANNOT ID no.6039430 (SEQ ID NO:1572), Ceres ANNOT ID no.6068141 (SEQ ID NO:1574), Ceres ANNOT ID no.6033916 (SEQ ID NO:1576), Ceres ANNOT ID no.6034399 (SEQ ID NO:1578), Ceres ANNOT ID no.6068617 (SEQ ID NO:1580), Ceres ANNOT ID no.6026318 (SEQ ID NO:1582), Ceres ANNOT ID no.6107650 (SEQ ID NO:1584), and sequences identified as functional homologs of the sequences of FIG. 21, as set forth in the sequence listing.

Polypeptides are shown in the sequence listing that have HMM bit scores greater than 1340 when fitted to an HMM generated from the amino acid sequences set forth in FIG. 22. Such polypeptides include At1g04400 (SEQ ID NO:538), Public GI ID no.5731739 (SEQ ID NO:539), Ceres ANNOT ID no.1538045 (SEQ ID NO:541), Public GI ID no.29467479 (SEQ ID NO:542), Public GI ID no.133921974 (SEQ ID NO:543), Public GI ID no.113197027 (SEQ ID NO:544), Public GI ID no.92879277 (SEQ ID NO:545), Public GI ID no.45935260 (SEQ ID NO:546), Public GI ID no.8101444 (SEQ ID NO:547), Public GI ID no.78217443 (SEQ ID NO:548), Public GI ID no.28372347 (SEQ ID NO:549), Public GI ID no.16416405 (SEQ ID NO:550), Ceres ANNOT ID no.1484634 (SEQ ID NO:552), Ceres ANNOT ID no.1451869 (SEQ ID NO:554), Public GI ID no.25407462 (SEQ ID NO:555), Public GI ID no.29467481 (SEQ ID NO:556), Public GI ID no.29467477 (SEQ ID NO:557), Public GI ID no.45935264 (SEQ ID NO:558), Public GI ID no.5524201 (SEQ ID NO:559), Public GI ID no.78217441 (SEQ ID NO:560), Public GI ID no.3551221 (SEQ ID NO:561), Public GI ID no.3551219 (SEQ ID NO:562), Public GI ID no.23954324 (SEQ ID NO:563), Public GI ID no.125582937 (SEQ ID NO:564), Public GI ID no.83764373 (SEQ ID NO:565), Ceres ANNOT ID no.6045327 (SEQ ID NO:567), and sequences identified as functional homologs of the sequences of FIG. 22, as set forth in the sequence listing.

Polypeptides are shown in the sequence listing that have HMM bit scores greater than 80 when fitted to an HMM generated from the amino acid sequences set forth in FIG. 23. Such polypeptides include At3g45610 (SEQ ID NO:606), Public GI ID no.92873064 (SEQ ID NO:607), Public GI ID no.37051125 (SEQ ID NO:608), Public GI ID no.112363376 (SEQ ID NO:609), Ceres CLONE ID no.1938524 (SEQ ID NO:611), Ceres ANNOT ID no.1473601 (SEQ ID NO:613), Ceres ANNOT ID no.1468397 (SEQ ID NO:615), Public GI ID no.21554185 (SEQ ID NO:616), Public GI ID no.18424330 (SEQ ID NO:617), Public GI ID no.8885571 (SEQ ID NO:618), Ceres CLONE ID no.20852 (SEQ ID NO:620), Public GI ID no.21553763 (SEQ ID NO:621), Public GI ID no.18401763 (SEQ ID NO:622), Ceres CLONE ID no.16423 (SEQ ID NO:624), Public GI ID no.112363380 (SEQ ID NO:625), Public GI ID no.6092016 (SEQ ID NO:626), Ceres CLONE ID no.770468 (SEQ ID NO:628), Public GI ID no.113205234 (SEQ ID NO:629), Ceres ANNOT ID no.6094775 (SEQ ID NO:631), and sequences identified as functional homologs of the sequences of FIG. 23, as set forth in the sequence listing.

Polypeptides are shown in the sequence listing that have HMM bit scores greater than 110 when fitted to an HMM generated from the amino acid sequences set forth in FIG. 24. Such polypeptides include At4g08330 (SEQ ID NO:570), Ceres CLONE ID no.1919714 (SEQ ID NO:572), Ceres ANNOT ID no.1443290 (SEQ ID NO:574), Ceres CLONE ID no.1042157 (SEQ ID NO:576), Ceres CLONE ID no.1384304 (SEQ ID NO:578), Public GI ID no.115464375 (SEQ ID NO:579), Ceres CLONE ID no.100028078 (SEQ ID NO:580), Ceres ANNOT ID no.1452096 (SEQ ID NO:582), Ceres ANNOT ID no.1503869 (SEQ ID NO:584), Ceres ANNOT ID no.1525651 (SEQ ID NO:586), Ceres CLONE ID no.1645639 (SEQ ID NO:588), Ceres CLONE ID no.603237 (SEQ ID NO:590), Ceres CLONE ID no.340925 (SEQ ID NO:592), Ceres CLONE ID no.293238 (SEQ ID NO:594), Ceres CLONE ID no.483742 (SEQ ID NO:596), Ceres CLONE ID no.1460255 (SEQ ID NO:598), Ceres CLONE ID no.1400107 (SEQ ID NO:600), Public GI ID no.115440865 (SEQ ID NO:601), Ceres ANNOT ID no.6016008 (SEQ ID NO:603), and sequences identified as functional homologs of the sequences of FIG. 24, asset forth in the sequence listing.

E. Percent Identity

In some embodiments, an SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to one of the amino acid sequences set forth in SEQ ID NO:3, SEQ ID NO:70, SEQ ID NO:129, SEQ ID NO:317, SEQ ID NO:337, SEQ ID NO:456, SEQ ID NO:538, SEQ ID NO:570, SEQ ID NO:606, SEQ ID NO:634, SEQ ID NO:644, SEQ ID NO:850, SEQ ID NO:907, SEQ ID NO:953, SEQ ID NO:1024, SEQ ID NO:1047, SEQ ID NO:1151, SEQ ID NO:1277, SEQ ID NO:1347, SEQ ID NO:1457, SEQ ID NO:1497, SEQ ID NO:1540, SEQ ID NO:1587, SEQ ID NO:1630, and SEQ ID NO:1635. Polypeptides having such a percent sequence identity often have a domain indicative of an SD+EODFR and/or low light-tolerance polypeptide and/or have an HMM bit score that is greater than 20, as discussed above. Amino acid sequences of SD+EODFR and/or low light-tolerance polypeptides having at least 40% sequence identity to one of the amino acid sequences set forth in SEQ ID NO:3, SEQ ID NO:70, SEQ ID NO:129, SEQ ID NO:317, SEQ ID NO:337, SEQ ID NO:456, SEQ ID NO:538, SEQ ID NO:570, SEQ ID NO:606, SEQ ID NO:634, SEQ ID NO:644, SEQ ID NO:850, SEQ ID NO:907, SEQ ID NO:953, SEQ ID NO:1024, SEQ ID NO:1047, SEQ ID NO:1151, SEQ ID NO:1277, SEQ ID NO:1347, SEQ ID NO:1457, SEQ ID NO:1497, SEQ ID NO:1540, SEQ ID NO:1587, and SEQ ID NO:1635 are provided in FIGS. 1-24.

"Percent sequence identity" refers to the degree of sequence identity between any given reference sequence, e.g., SEQ ID NO:3, and a candidate SD+EODFR and/or low light-tolerance sequence. A candidate sequence typically has a length that is from 80 percent to 200 percent of the length of the reference sequence, e.g., 82, 85, 87, 89, 90, 93, 95, 97, 99, 100, 105, 110, 115, 120, 130, 140, 150, 160, 170, 180, 190, or 200 percent of the length of the reference sequence. A percent identity for any candidate nucleic acid or polypeptide relative to a reference nucleic acid or polypeptide can be determined as follows. A reference sequence (e.g., a nucleic acid sequence or an amino acid sequence) is aligned to one or more candidate sequences using the computer program ClustalW (version 1.83, default parameters), which allows alignments of nucleic acid or polypeptide sequences to be carried out across their entire length (global alignment). Chenna et al., Nucleic Acids Res., 31(13):3497-500 (2003).

ClustalW calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple sequence alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site (searchlauncher.bcm.tmc.edu/multi-align/multi-align.html) and at the European Bioinformatics Institute site on the World Wide Web (ebi.ac.uk/clustalw).

To determine percent identity of a candidate nucleic acid or amino acid sequence to a reference sequence, the sequences are aligned using ClustalW, the number of identical matches in the alignment is divided by the length of the reference sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

In some cases, an SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:3. Amino acid sequences of polypeptides having greater than 40% sequence identity to the polypeptide set forth in SEQ ID NO:3 are provided in FIG. 1. Such polypeptides include Ceres CLONE ID no. 1844057 (SEQ ID NO:7), Ceres ANNOT ID no. 1469148 (SEQ ID NO:22), Public GI ID no. 18390998 (SEQ ID NO:25), Ceres CLONE ID no. 1065656 (SEQ ID NO:32), Ceres CLONE ID no. 1652677 (SEQ ID NO:36), Public GI ID no. 92874556 (SEQ ID NO:49), Ceres CLONE ID no. 1329161 (SEQ ID NO:53), Ceres CLONE ID no. 1030378 (SEQ ID NO:55), Ceres CLONE ID no. 1413787 (SEQ ID NO:57), and Public GI ID no. 125543598 (SEQ ID NO:60).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:70. Amino acid sequences of polypeptides having greater than 40% sequence identity to the polypeptide set forth in SEQ ID NO:70 are provided in FIG. 2. Such polypeptides include Ceres CLONE ID no. 1975934 (SEQ ID NO:72), Ceres ANNOT ID no. 1529913 (SEQ ID NO:80), Ceres CLONE ID no. 977794 (SEQ ID NO:93), Public GI ID no. 42362378 (SEQ ID NO:96), Public GI ID no. 23899378 (SEQ ID NO:99), Public GI ID no. 15963346 (SEQ ID NO:101), Public GI ID no. 15963344+B816 (SEQ ID NO:102), Public GI ID no. 92429657 (SEQ ID NO:103), Ceres CLONE ID no. 746644 (SEQ ID NO:105), Ceres CLONE ID no. 623089 (SEQ ID NO:109), Ceres CLONE ID no. 1913678 (SEQ ID NO:115), and Public GI ID no. 115450609 (SEQ ID NO:119).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:129. Amino acid sequences of polypeptides having greater than 40% sequence identity to the polypeptide set forth in SEQ ID NO:129 are provided in FIG. 3. Such polypeptides include Public GI ID no. 34550779 (SEQ ID NO:133), Ceres CLONE ID no. 1932235 (SEQ ID NO:137), Ceres CLONE ID no. 981738 (SEQ ID NO:201), Ceres CLONE ID no. 565974 (SEQ ID NO:209), Public GI ID no. 1352058 (SEQ ID NO:231), Public GI ID no. 11131101 (SEQ ID NO:234), Public GI ID no. 4887018 (SEQ ID NO:236), Public GI ID no. 4887018 (SEQ ID NO:236), Ceres CLONE ID no. 644455 (SEQ ID NO:247), Ceres CLONE ID no. 1731500 (SEQ ID NO:270), Public GI ID no. 20269063 (SEQ ID NO:300), Public GI ID no. 50404477 (SEQ ID NO:302), and Public GI ID no. 62125392 (SEQ ID NO:303).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:317. Amino acid sequences of polypeptides having greater than 40% sequence identity to the polypeptide set forth in SEQ ID NO:317 are provided in FIG. 4. Such polypeptides include Ceres CLONE ID no. 1842125 (SEQ ID NO:319), Ceres ANNOT ID no. 1461360 (SEQ ID NO:321), Ceres CLONE ID no. 480906 (SEQ ID NO:327), Public GI ID no. 92889352 (SEQ ID NO:330), and Public GI ID no. 56201850 (SEQ ID NO:330).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:337. Amino acid sequences of polypeptides having greater than 40% sequence identity to the polypeptide set forth in SEQ ID NO:337 are provided in FIG. 5. Such polypeptides include At2g04240 Ceres CLONE ID no. 952050 (SEQ ID NO:339), Public GI ID no. 115477050 (SEQ ID NO:349), Public GI ID no. 87162911 (SEQ ID NO:355), Ceres CLONE ID no. 1790901 (SEQ ID NO:357), Ceres CLONE ID no. 1460088 (SEQ ID NO:370), Ceres CLONE ID no. 1734065 (SEQ ID NO:393), Ceres CLONE ID no. 473509 (SEQ ID NO:395), Ceres CLONE ID no. 849918 (SEQ ID NO:401), Ceres CLONE ID no. 633470 (SEQ ID NO:409), Ceres CLONE ID no. 1808334 (SEQ ID NO:417), and Ceres ANNOT ID no. 1525600 (SEQ ID NO:437).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:456. Amino acid sequences of polypeptides having greater than 40% sequence identity to the polypeptide set forth in SEQ ID NO:456 are provided in FIG. 6. Such polypeptides include Public GI ID no. 58430585 (SEQ ID NO:457), Ceres CLONE ID no. 1842825 (SEQ ID NO:466), Ceres ANNOT ID no. 1449721 (SEQ ID NO:474), Public GI ID no. 41323978 (SEQ ID NO:475), Public GI ID no. 2895186 (SEQ ID NO:478), Public GI ID no. 22854950 (SEQ ID NO:481), Public GI ID no. 116010474 (SEQ ID NO:485), Public GI ID no. 4091804 (SEQ ID NO:488), Public GI ID no. 60459257 (SEQ ID NO:494), Public GI ID no. 45544881 (SEQ ID NO:496), Public GI ID no. 36789802 (SEQ ID NO:498), Public GI ID no. 92875402 (SEQ ID NO:508), Public GI ID no. 118406898 (SEQ ID NO:510), Public GI ID no. 107770485 (SEQ ID NO:511), Public GI ID no. 21655154 (SEQ ID NO:532), Public GI ID no. 90657642 (SEQ ID NO:536), and Ceres CLONE ID no. 1569555 (SEQ ID NO:1842).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:634. Amino acid sequences of polypeptides having greater than 40% sequence identity to the polypeptide set forth in SEQ ID NO:634 are provided in FIG. 7. Such polypeptides include Public GI ID no. 98961985 (SEQ ID NO:637).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:644. Amino acid sequences of polypeptides having greater than 40% sequence identity to the polypeptide set forth in SEQ ID NO:644 are provided in FIG. 8. Such polypeptides include SEQ ID NO:645, Ceres CLONE ID no. 1849479 (SEQ ID NO:767), Public GI ID no. 89275008 (SEQ ID NO:796), Public GI ID no. 120400525 (SEQ ID NO:797), Public GI ID no. 98980426 (SEQ ID NO:804), Public GI ID no. 71983373 (SEQ ID NO:808), Public GI ID no. 41351817 (SEQ ID NO:809), Public GI ID no. 76446191 (SEQ ID NO:811), Public GI ID no. 5616086 (SEQ ID NO:813), Ceres CLONE ID no. 1052602 (SEQ ID NO:826), Public GI ID no. 72068957 (SEQ ID NO:830), Public GI ID no. 71534113 (SEQ ID NO:831), Public GI ID no. 37147896 (SEQ ID NO:832), Public GI ID no. 92918850 (SEQ ID NO:834), Public GI ID no. 40647095 (SEQ ID NO:835), Ceres ANNOT ID no. 1527711 (SEQ ID NO:837), Public GI ID no. 71041116 (SEQ ID NO:838), Public GI ID no. 12003384 (SEQ ID NO:839), Public GI ID no. 18535580 (SEQ ID NO:840), and Public GI ID no. 115353971 (SEQ ID NO:1843).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:850. Amino acid sequences of polypeptides having greater than 40% sequence identity to the polypeptide set forth in SEQ ID NO:850 are provided in FIG. 9. Such polypeptides include Ceres CLONE ID no.1833093 (SEQ ID NO:853), Ceres ANNOT ID no.1502190 (SEQ ID NO:857), Ceres CLONE ID no.565641 (SEQ ID NO:876), Public GI ID no.87240507 (SEQ ID NO:877), Ceres CLONE ID no.1325382 (SEQ ID NO:881), Ceres CLONE ID no.1558265 (SEQ ID NO:885), Ceres CLONE ID no.1823669 (SEQ ID NO:895), and Public GI ID no.115464921 (SEQ ID NO:898).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:907. Amino acid sequences of polypeptides having greater than 40% sequence identity to the polypeptide set forth in SEQ ID NO:907 are provided in FIG. 10. Such polypeptides include Ceres CLONE ID no.1940797 (SEQ ID NO:909), Ceres ANNOT ID no.1538900 (SEQ ID NO:911), Ceres CLONE ID no.1126868 (SEQ ID NO:922), Public GI ID no.89257684 (SEQ ID NO:923), Public GI ID no.124360460 (SEQ ID NO:929), Public GI ID no.62865694 (SEQ ID NO:931), Public GI ID no.62865692 (SEQ ID NO:932), Ceres CLONE ID no.260368 (SEQ ID NO:936), Ceres CLONE ID no.1873510 (SEQ ID NO:947), Public GI ID no.125541662 (SEQ ID NO:948), Public GI ID no.48716268 (SEQ ID NO:950), and Public GI ID no. 62865696 (SEQ ID NO:1844).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:953. Amino acid sequences of polypeptides having greater than 40% sequence identity to the polypeptide set forth in SEQ ID NO:953 are provided in FIG. 11. Such polypeptides include Ceres CLONE ID no.1798705 (SEQ ID NO:955), Ceres ANNOT ID no.1458907 (SEQ ID NO:963), Ceres CLONE ID no.1090409 (SEQ ID NO:971), Ceres CLONE ID no.479817 (SEQ ID NO:977), Ceres CLONE ID no.1041793 (SEQ ID NO:979), Ceres CLONE ID no.684633 (SEQ ID NO:985), Ceres CLONE ID no.371815 (SEQ ID NO:991), Ceres CLONE ID no.1686460 (SEQ ID NO:993), Ceres CLONE ID no.1448595 (SEQ ID NO:995), Ceres CLONE ID no.1734477 (SEQ ID NO:999), Ceres CLONE ID no.1605693 (SEQ ID NO:1005), Ceres CLONE ID no.1757400 (SEQ ID NO:1009), and Public GI ID no.115434334 (SEQ ID NO:1015).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1024 Amino acid sequences of polypeptides having greater than 40% sequence identity to the polypeptide set forth in SEQ ID NO:1024 are provided in FIG. 12. Such polypeptides include Ceres ANNOT ID no.1452905 (SEQ ID NO:1029), Ceres CLONE ID no.956176 (SEQ ID NO:1039), Public GI ID no.92870366 (SEQ ID NO:1040), Ceres CLONE ID no.294166 (SEQ ID NO:1042), and Public GI ID no.125543067 (SEQ ID NO:1043).

In some cases, an SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1047 Amino acid sequences of polypeptides having greater than 40% sequence identity to the polypeptide set forth in SEQ ID NO:1047 are provided in FIG. 13. Such polypeptides include Ceres CLONE ID no.1837694 (SEQ ID NO:1053), Ceres ANNOT ID no.1483367 (SEQ ID NO:1057), Ceres CLONE ID no.1077781 (SEQ ID NO:1083), Ceres CLONE ID no.471026 (SEQ ID NO:1085), Public GI ID no.92888885 (SEQ ID NO:1099), Public GI ID no.45544873 (SEQ ID NO:1100), Public GI ID no.45758663 (SEQ ID NO:1101), Ceres CLONE ID no.772927 (SEQ ID NO:1105), Ceres CLONE ID no.895080 (SEQ ID NO:1111), Ceres CLONE ID no.1806128 (SEQ ID NO:1131), Public GI ID no.115458192 (SEQ ID NO:1134), and Public GI ID no.82470795 (SEQ ID NO:1139).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1151 Amino acid sequences of polypeptides having greater than 40% sequence identity to the polypeptide set forth in SEQ ID NO:1151 are provided in FIG. 14. Such polypeptides include Ceres CLONE ID no.1851526 (SEQ ID NO:1155), Ceres ANNOT ID no.1486769 (SEQ ID NO:1172), Public GI ID no.83032232 (SEQ ID NO:1209), Ceres CLONE ID no.1620420 (SEQ ID NO:1211), Public GI ID no.92892428 (SEQ ID NO:1215), Ceres CLONE ID no.884742 (SEQ ID NO:1223), Ceres CLONE ID no.1821559 (SEQ ID NO:1246), Public GI ID no.51535021 (SEQ ID NO:1258), Public GI ID no.113205304 (SEQ ID NO:1263), and Public GI ID no.37719051 (SEQ ID NO:1264).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1277 Amino acid sequences of polypeptides having greater than 40% sequence identity to the polypeptide set forth in SEQ ID NO:1277 are provided in FIG. 15. Such polypeptides include Ceres CLONE ID no.1926352 (SEQ ID NO:1279), Ceres ANNOT ID no.1448905 (SEQ ID NO:1285), Public GI ID no.15236865 (SEQ ID NO:1294), Ceres CLONE ID no.934771 (SEQ ID NO:1301), Ceres CLONE ID no.338386 (SEQ ID NO:1303), Ceres CLONE ID no.1780691 (SEQ ID NO:1317), and Public GI ID no.115464819 (SEQ ID NO:1326).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1347 Amino acid sequences of polypeptides having greater than 40% sequence identity to the polypeptide set forth in SEQ ID NO:1347 are provided in FIG. 16. Such polypeptides include Ceres CLONE ID no.285028 (SEQ ID NO:1419), Ceres CLONE ID no.100969565 (SEQ ID NO:1422), Public GI ID no.1352057 (SEQ ID NO:1427), Ceres ANNOT ID no.1453784 (SEQ ID NO:1429), Public GI ID no.452777 (SEQ ID NO:1430), and Public GI ID no.92873297 (SEQ ID NO:1431).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1457 Amino acid sequences of polypeptides having greater than 40% sequence identity to the polypeptide set forth in SEQ ID NO:1457 are provided in FIG. 17. Such polypeptides include Ceres CLONE ID no.1924904 (SEQ ID NO:1460), Ceres ANNOT ID no.1543346 (SEQ ID NO:1462), Public GI ID no.18396338 (SEQ ID NO:1467), Ceres CLONE ID no.833872 (SEQ ID NO:1471), Ceres CLONE ID no.1579587 (SEQ ID NO:1475), Ceres CLONE ID no.1786411 (SEQ ID NO:1477), and Public GI ID no.108864370 (SEQ ID NO:1480).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1497 Amino acid sequences of polypeptides having greater than 40% sequence identity to the polypeptide set forth in SEQ ID NO:1497 are provided in FIG. 18. Such polypeptides include Ceres ANNOT ID no.1443463 (SEQ ID NO:1499), Public GI ID no.13605525 (SEQ ID NO:1502), Public GI ID no.94965681 (SEQ ID NO:1506), and Public GI ID no.28201254 (SEQ ID NO:1512).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1587 Amino acid sequences of polypeptides having greater than 40% sequence identity to the polypeptide set forth in SEQ ID NO:1587 are provided in FIG. 19. Such polypeptides include Ceres CLONE ID no.1839577 (SEQ ID NO:1589), Ceres ANNOT ID no.1491567 (SEQ ID NO:1591), Ceres CLONE ID no.574505 (SEQ ID NO:1596), Public GI ID no.56117815 (SEQ ID NO:1597), Public GI ID no.92874021 (SEQ ID NO:1603), Public GI ID no.123684 (SEQ ID NO:1605), Public GI ID no.5821136 (SEQ ID NO:1606), Ceres CLONE ID no.283366 (SEQ ID NO:1609), Public GI ID no.16118447 (SEQ ID NO:1612), and Public GI ID no.125562434 (SEQ ID NO:1614).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1635 Amino acid sequences of polypeptides having greater than 40% sequence identity to the polypeptide set forth in SEQ ID NO:1635 are provided in FIG. 20. Such polypeptides include Ceres ANNOT ID no.1508307 (SEQ ID NO:1637), Public GI ID no.1495267 (SEQ ID NO:1642), Public GI ID no.87241310 (SEQ ID NO:1644), Ceres CLONE ID no.938390 (SEQ ID NO:1646), Ceres CLONE ID no.272338 (SEQ ID NO:1648), Ceres CLONE ID no.1993510 (SEQ ID NO:1650), Public GI ID no.125563862 (SEQ ID NO:1651), and Public GI ID no.125605833 (SEQ ID NO:1653).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1540 Amino acid sequences of polypeptides having greater than 40% sequence identity to the polypeptide set forth in SEQ ID NO:1540 are provided in FIG. 21. Such polypeptides include Ceres CLONE ID no.1943265 (SEQ ID NO:1543), Ceres ANNOT ID no.1454522 (SEQ ID NO:1547), Public GI ID no.31323447 (SEQ ID NO:1556), Ceres CLONE ID no.1583941 (SEQ ID NO:1561), Ceres CLONE ID no.1792942 (SEQ ID NO:1563), Public GI ID no.77548772 (SEQ ID NO:1565), and Public GI ID no.84453182 (SEQ ID NO:1567).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:538. Amino acid sequences of polypeptides having greater than 40% sequence identity to the polypeptide set forth in SEQ ID NO:538 are provided in FIG. 22. Such polypeptides include Public GI ID no.5731739 (SEQ ID NO:539), Ceres ANNOT ID no.1538045 (SEQ ID NO:541), Public GI ID no.29467479 (SEQ ID NO:542), Public GI ID no.133921974 (SEQ ID NO:543), Public GI ID no.113197027 (SEQ ID NO:544), Public GI ID no.92879277 (SEQ ID NO:545), Public GI ID no.45935260 (SEQ ID NO:546), Public GI ID no.8101444 (SEQ ID NO:547), Public GI ID no.78217443 (SEQ ID NO:548), and Public GI ID no.28372347 (SEQ ID NO:549).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:606. Amino acid sequences of polypeptides having greater than 40% sequence identity to the polypeptide set forth in SEQ ID NO:606 are provided in FIG. 23. Such polypeptides include Public GI ID no.92873064 (SEQ ID NO:607), Public GI ID no.37051125 (SEQ ID NO:608), and Public GI ID no.112363376 (SEQ ID NO:609).

In some cases, a SD+EODFR and/or low light-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:570. Amino acid sequences of polypeptides having greater than 40% sequence identity to the polypeptide set forth in SEQ ID NO:570 are provided in FIG. 24. Such polypeptides include Ceres CLONE ID no.1919714 (SEQ ID NO:572), Ceres ANNOT ID no.1443290 (SEQ ID NO:574), Ceres CLONE ID no.1042157 (SEQ ID NO:576), Ceres CLONE ID no.1384304 (SEQ ID NO:578), and Public GI ID no.115464375 (SEQ ID NO:579).

In some cases, a red light specific response pathway polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:456. Amino acid sequences of polypeptides having greater than 40% sequence identity to the polypeptide set forth in SEQ ID NO:456 are provided in FIG. 6. Such polypeptides include Public GI ID no. 58430585 (SEQ ID NO:457), Ceres CLONE ID no. 1842825 (SEQ ID NO:466), Ceres ANNOT ID no. 1449721 (SEQ ID NO:474), Public GI ID no. 41323978 (SEQ ID NO:475), Public GI ID no. 2895186 (SEQ ID NO:478), Public GI ID no. 22854950 (SEQ ID NO:481), Public GI ID no. 116010474 (SEQ ID NO:485), Public GI ID no. 4091804 (SEQ ID NO:488), Public GI ID no. 60459257 (SEQ ID NO:494), Public GI ID no. 45544881 (SEQ ID NO:496), Public GI ID no. 36789802 (SEQ ID NO:498), Public GI ID no. 92875402 (SEQ ID NO:508), Public GI ID no. 118406898 (SEQ ID NO:510), Public GI ID no. 107770485 (SEQ ID NO:511), Public GI ID no. 21655154 (SEQ ID NO:532), Public GI ID no. 90657642 (SEQ ID NO:536), and Ceres CLONE ID no. 1569555 (SEQ ID NO:1842).

In some cases, red light specific response pathway polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:953. Amino acid sequences of polypeptides having greater than 40% sequence identity to the polypeptide set forth in SEQ ID NO:953 are provided in FIG. 11. Such polypeptides include Ceres CLONE ID no.1798705 (SEQ ID NO:955), Ceres ANNOT ID no.1458907 (SEQ ID NO:963), Ceres CLONE ID no.1090409 (SEQ ID NO:971), Ceres CLONE ID no.479817 (SEQ ID NO:977), Ceres CLONE ID no.1041793 (SEQ ID NO:979), Ceres CLONE ID no.684633 (SEQ ID NO:985), Ceres CLONE ID no.371815 (SEQ ID NO:991), Ceres CLONE ID no.1686460 (SEQ ID NO:993), Ceres CLONE ID no.1448595 (SEQ ID NO:995), Ceres CLONE ID no.1734477 (SEQ ID NO:999), Ceres CLONE ID no.1605693 (SEQ ID NO:1005), Ceres CLONE ID no.1757400 (SEQ ID NO:1009), and Public GI ID no.115434334 (SEQ ID NO:1015).

In some cases, a red light specific response pathway polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1540 Amino acid sequences of polypeptides having greater than 40% sequence identity to the polypeptide set forth in SEQ ID NO:1540 are provided in FIG. 21. Such polypeptides include Ceres CLONE ID no.1943265 (SEQ ID NO:1543), Ceres ANNOT ID no.1454522 (SEQ ID NO:1547), Public GI ID no.31323447 (SEQ ID NO:1556), Ceres CLONE ID no.1583941 (SEQ ID NO:1561), Ceres CLONE ID no.1792942 (SEQ ID NO:1563), Public GI ID no.77548772 (SEQ ID NO:1565), and Public GI ID no.84453182 (SEQ ID NO:1567).

F. Other Sequences

It should be appreciated that an SD+EODFR and/or low light-tolerance polypeptide and red light specific response pathway polypeptide can include additional amino acids that are not involved in an SD+EODFR and/or low light tolerance, or a red light specific response pathway, and thus such a polypeptide can be longer than would otherwise be the case. For example, an SD+EODFR and/or low light-tolerance polypeptide can include a purification tag, a chloroplast transit peptide, a mitochondrial transit peptide, an amyloplast peptide, or a leader sequence added to the amino or carboxy terminus. In some embodiments, an SD+EODFR and/or low light-tolerance polypeptide includes an amino acid sequence that functions as a reporter, e.g., a green fluorescent protein or yellow fluorescent protein.

III. Nucleic Acids

Nucleic acids described herein include nucleic acids that are effective to modulate SD+EODFR and/or low light tolerance when transcribed in a plant or plant cell. Such nucleic acids include, without limitation, those that encode an SD+EODFR and/or low light-tolerance polypeptide and those that can be used to inhibit expression of an SD+EODFR and/or low light-tolerance polypeptide or a red light specific response pathway polypeptide via a nucleic acid based method.

A. Nucleic Acids Encoding SD+EODFR and/or Low Light-Tolerance Polypeptides

Nucleic acids encoding SD+EODFR and/or low light-tolerance polypeptides are described herein. Such nucleic acids include SEQ ID NOs:1, 2, 4, 6, 8, 11, 13, 15, 17, 19, 21, 23, 27, 29, 31, 33, 35, 37, 39, 41, 43, 45, 47, 50, 52, 54, 56, 58, 64, 66, 68, 69, 71, 73, 75, 77, 79, 81, 83, 85, 87, 92, 94, 104, 106, 108, 110, 112, 114, 123, 125, 127, 128, 134, 136, 138, 140, 142, 144, 146, 148, 150, 152, 154, 156, 158, 160, 162, 164, 166, 168, 170, 172, 174, 176, 178, 180, 182, 184, 186, 190, 192, 194, 196, 198, 200, 202, 204, 206, 208, 210, 212, 214, 216, 218, 220, 222, 224, 226, 228, 240, 242, 244, 246, 248, 250, 252, 254, 256, 258, 260, 263, 265, 267, 269, 272, 274, 276, 278, 280, 282, 284, 286, 288, 290, 305, 307, 309, 311, 313, 315, 316, 318, 320, 322, 324, 326, 328, 333, 335, 336, 338, 340, 342, 345, 356, 358, 360, 363, 369, 371, 373, 375, 377, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 455, 461, 463, 465, 467, 469, 471, 473, 476, 490, 492, 500, 502, 504, 506, 513, 517, 519, 537, 540, 551, 553, 566, 568, 569, 571, 573, 575, 577, 581, 583, 585, 587, 589, 591, 593, 595, 597, 599, 602, 604, 605, 610, 612, 614, 619, 623, 627, 630, 632, 633, 635, 640, 642, 643, 646, 648, 650, 652, 654, 656, 658, 660, 662, 664, 666, 668, 670, 672, 674, 677, 679, 681, 683, 685, 687, 689, 691, 693, 696, 698, 700, 703, 705, 707, 710, 715, 717, 719, 722, 724, 727, 729, 731, 733, 735, 737, 739, 746, 748, 752, 754, 756, 758, 760, 766, 768, 770, 772, 775, 777, 781, 785, 787, 789, 791, 793, 825, 828, 836, 842, 844, 846, 848, 849, 852, 854, 856, 858, 860, 867, 869, 871, 873, 875, 878, 880, 882, 884, 886, 888, 890, 892, 894, 896, 899, 901, 903, 905, 906, 908, 910, 912, 914, 916, 918, 921, 925, 927, 933, 935, 942, 944, 946, 951, 952, 954, 956, 958, 960, 962, 964, 968, 970, 972, 974, 976, 978, 980, 982, 984, 986, 988, 990, 992, 994, 996, 998, 1000, 1002, 1004, 1006, 1008, 1010, 1012, 1017, 1019, 1020, 1021, 1022, 1023, 1026, 1028, 1031, 1034, 1036, 1038, 1041, 1045, 1046, 1048, 1050, 1052, 1054, 1056, 1058, 1060, 1062, 1064, 1066, 1070, 1076, 1079, 1082, 1084, 1086, 1088, 1090, 1092, 1094, 1096, 1102, 1104, 1106, 1108, 1110, 1112, 1114, 1116, 1118, 1120, 1122, 1124, 1126, 1128, 1130, 1132, 1140, 1142, 1144, 1146, 1148, 1150, 1152, 1154, 1156, 1158, 1163, 1165, 1167, 1169, 1171, 1173, 1175, 1177, 1179, 1181, 1183, 1185, 1187, 1189, 1191, 1193, 1195, 1197, 1205, 1207, 1210, 1212, 1218, 1220, 1222, 1224, 1226, 1228, 1231, 1233, 1235, 1237, 1239, 1241, 1243, 1245, 1247, 1249, 1251, 1253, 1265, 1267, 1269, 1271, 1273, 1275, 1276, 1278, 1280, 1282, 1284, 1286, 1288, 1290, 1292, 1296, 1300, 1302, 1304, 1306, 1308, 1310, 1312, 1314, 1316, 1318, 1320, 1333, 1335, 1337, 1339, 1341, 1343, 1345, 1346, 1348, 1350, 1354, 1356, 1359, 1361, 1363, 1365, 1369, 1371, 1373, 1376, 1378, 1380, 1382, 1384, 1386, 1388, 1390, 1392, 1394, 1396, 1398, 1400, 1403, 1405, 1407, 1409, 1416, 1418, 1420, 1428, 1432, 1437, 1441, 1443, 1445, 1447, 1449, 1451, 1453, 1454, 1455, 1456, 1459, 1461, 1463, 1465, 1470, 1472, 1474, 1476, 1487, 1489, 1491, 1493, 1495, 1496, 1498, 1500, 1507, 1509, 1517, 1526, 1530, 1537, 1538, 1539, 1542, 1544, 1546, 1548, 1550, 1552, 1560, 1562, 1569, 1571, 1573, 1575, 1577, 1579, 1581, 1583, 1585, 1586, 1588, 1590, 1592, 1595, 1608, 1610, 1622, 1624, 1626, 1627, 1628, 1629, 1633, 1634, 1636, 1638, 1640, 1645, 1647, 1649, 1656, 1658, 1660, 1662, 1664, 1666, 1668, 1670, 1672, 1674, 1676, 1678, 1680, 1683, 1685, 1687, 1689, 1691, 1693, 1695, 1697, 1706, 1708, 1710, 1712, 1714, 1716, 1718, 1724, 1726, 1728, 1731, 1733, 1735, 1737, 1747, 1749, 1753, 1755, 1757, 1759, 1761, 1763, 1765, 1779, 1781, 1783, 1785, 1787, 1789, 1791, 1793, 1795, 1797, 1799, 1801, 1803, 1841, 1849, 1851, 1853, 1855, 1857, 1868, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2068, 2071, 2073, 2075, 2077, 2079, 2082, 2086, 2088, 2090, 2092, 2094, 2096, 2098, 2100, 2102, 2104, 2106, 2108, 2110, 2112, 2122, 2124, 2126, 2128, 2130, 2132, 2134, 2145, 2147, 2149, 2151, 2153, 2155, 2157, 2159, 2161, 2163, 2165, 2167, 2169, 2171, 2173, 2175, 2177, 2179, 2181, 2265, 2267, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2349, 2351, 2353, 2355, 2357, 2359, 2361, 2363, 2365, 2367, 2369, 2371, and 2373 as described in more detail below. A nucleic acid also can be a fragment that is at least 40% (e.g., at least 45, 50, 55, 60, 65, 70, 75, 80, 85, 90, 95, or 99%) of the length of the full-length nucleic acid set forth in SEQ ID NOs:1, 2, 4, 6, 8, 11, 13, 15, 17, 19, 21, 23, 27, 29, 31, 33, 35, 37, 39, 41, 43, 45, 47, 50, 52, 54, 56, 58, 64, 66, 68, 69, 71, 73, 75, 77, 79, 81, 83, 85, 87, 92, 94, 104, 106, 108, 110, 112, 114, 123, 125, 127, 128, 134, 136, 138, 140, 142, 144, 146, 148, 150, 152, 154, 156, 158, 160, 162, 164, 166, 168, 170, 172, 174, 176, 178, 180, 182, 184, 186, 190, 192, 194, 196, 198, 200, 202, 204, 206, 208, 210, 212, 214, 216, 218, 220, 222, 224, 226, 228, 240, 242, 244, 246, 248, 250, 252, 254, 256, 258, 260, 263, 265, 267, 269, 272, 274, 276, 278, 280, 282, 284, 286, 288, 290, 305, 307, 309, 311, 313, 315, 316, 318, 320, 322, 324, 326, 328, 333, 335, 336, 338, 340, 342, 345, 356, 358, 360, 363, 369, 371, 373, 375, 377, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 455, 461, 463, 465, 467, 469, 471, 473, 476, 490, 492, 500, 502, 504, 506, 513, 517, 519, 537, 540, 551, 553, 566, 568, 569, 571, 573, 575, 577, 581, 583, 585, 587, 589, 591, 593, 595, 597, 599, 602, 604, 605, 610, 612, 614, 619, 623, 627, 630, 632, 633, 635, 640, 642, 643, 646, 648, 650, 652, 654, 656, 658, 660, 662, 664, 666, 668, 670, 672, 674, 677, 679, 681, 683, 685, 687, 689, 691, 693, 696, 698, 700, 703, 705, 707, 710, 715, 717, 719, 722, 724, 727, 729, 731, 733, 735, 737, 739, 746, 748, 752, 754, 756, 758, 760, 766, 768, 770, 772, 775, 777, 781, 785, 787, 789, 791, 793, 825, 828, 836, 842, 844, 846, 848, 849, 852, 854, 856, 858, 860, 867, 869, 871, 873, 875, 878, 880, 882, 884, 886, 888, 890, 892, 894, 896, 899, 901, 903, 905, 906, 908, 910, 912, 914, 916, 918, 921, 925, 927, 933, 935, 942, 944, 946, 951, 952, 954, 956, 958, 960, 962, 964, 968, 970, 972, 974, 976, 978, 980, 982, 984, 986, 988, 990, 992, 994, 996, 998, 1000, 1002, 1004, 1006, 1008, 1010, 1012, 1017, 1019, 1020, 1021, 1022, 1023, 1026, 1028, 1031, 1034, 1036, 1038, 1041, 1045, 1046, 1048, 1050, 1052, 1054, 1056, 1058, 1060, 1062, 1064, 1066, 1070, 1076, 1079, 1082, 1084, 1086, 1088, 1090, 1092, 1094, 1096, 1102, 1104, 1106, 1108, 1110, 1112, 1114, 1116, 1118, 1120, 1122, 1124, 1126, 1128, 1130, 1132, 1140, 1142, 1144, 1146, 1148, 1150, 1152, 1154, 1156, 1158, 1163, 1165, 1167, 1169, 1171, 1173, 1175, 1177, 1179, 1181, 1183, 1185, 1187, 1189, 1191, 1193, 1195, 1197, 1205, 1207, 1210, 1212, 1218, 1220, 1222, 1224, 1226, 1228, 1231, 1233, 1235, 1237, 1239, 1241, 1243, 1245, 1247, 1249, 1251, 1253, 1265, 1267, 1269, 1271, 1273, 1275, 1276, 1278, 1280, 1282, 1284, 1286, 1288, 1290, 1292, 1296, 1300, 1302, 1304, 1306, 1308, 1310, 1312, 1314, 1316, 1318, 1320, 1333, 1335, 1337, 1339, 1341, 1343, 1345, 1346, 1348, 1350, 1354, 1356, 1359, 1361, 1363, 1365, 1369, 1371, 1373, 1376, 1378, 1380, 1382, 1384, 1386, 1388, 1390, 1392, 1394, 1396, 1398, 1400, 1403, 1405, 1407, 1409, 1416, 1418, 1420, 1428, 1432, 1437, 1441, 1443, 1445, 1447, 1449, 1451, 1453, 1454, 1455, 1456, 1459, 1461, 1463, 1465, 1470, 1472, 1474, 1476, 1487, 1489, 1491, 1493, 1495, 1496, 1498, 1500, 1507, 1509, 1517, 1526, 1530, 1537, 1538, 1539, 1542, 1544, 1546, 1548, 1550, 1552, 1560, 1562, 1569, 1571, 1573, 1575, 1577, 1579, 1581, 1583, 1585, 1586, 1588, 1590, 1592, 1595, 1608, 1610, 1622, 1624, 1626, 1627, 1628, 1629, 1633, 1634, 1636, 1638, 1640, 1645, 1647, 1649, 1656, 1658, 1660, 1662, 1664, 1666, 1668, 1670, 1672, 1674, 1676, 1678, 1680, 1683, 1685, 1687, 1689, 1691, 1693, 1695, 1697, 1706, 1708, 1710, 1712, 1714, 1716, 1718, 1724, 1726, 1728, 1731, 1733, 1735, 1737, 1747, 1749, 1753, 1755, 1757, 1759, 1761, 1763, 1765, 1779, 1781, 1783, 1785, 1787, 1789, 1791, 1793, 1795, 1797, 1799, 1801, 1803, 1841, 1849, 1851, 1853, 1855, 1857, 1868, 1872, 1874, 1876, 1878, 1880, 1882, 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, 2008, 2010, 2012, 2014, 2016, 2018, 2020, 2022, 2024, 2026, 2028, 2068, 2071, 2073, 2075, 2077, 2079, 2082, 2086, 2088, 2090, 2092, 2094, 2096, 2098, 2100, 2102, 2104, 2106, 2108, 2110, 2112, 2122, 2124, 2126, 2128, 2130, 2132, 2134, 2145, 2147, 2149, 2151, 2153, 2155, 2157, 2159, 2161, 2163, 2165, 2167, 2169, 2171, 2173, 2175, 2177, 2179, 2181, 2265, 2267, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2349, 2351, 2353, 2355, 2357, 2359, 2361, 2363, 2365, 2367, 2369, 2371, and 2373.

An SD+EODFR and/or low light-tolerance nucleic acid can comprise the nucleotide sequence set forth in SEQ ID NO:1 or SEQ ID NO:2. Alternatively, an SD+EODFR and/or low light-tolerance nucleic acid can be a variant of the nucleic acid having the nucleotide sequence set forth in SEQ ID NO:1 or SEQ ID NO:2. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1 or SEQ ID NO:2.

An SD+EODFR and/or low light-tolerance nucleic acid can comprise the nucleotide sequence set forth in SEQ ID NO:68 or SEQ ID NO:69. Alternatively, an SD+EODFR and/or low light-tolerance nucleic acid can be a variant of the nucleic acid having the nucleotide sequence set forth in SEQ ID NO:68 or SEQ ID NO:69. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:68 or SEQ ID NO:69.

An SD+EODFR and/or low light-tolerance nucleic acid can comprise the nucleotide sequence set forth in SEQ ID NO:127 or SEQ ID NO:128. Alternatively, an SD+EODFR and/or low light-tolerance nucleic acid can be a variant of the nucleic acid having the nucleotide sequence set forth in SEQ ID NO:127 or SEQ ID NO:128. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:127 or SEQ ID NO:128.

An SD+EODFR and/or low light-tolerance nucleic acid can comprise the nucleotide sequence set forth in SEQ ID NO:315 or SEQ ID NO:316. Alternatively, an SD+EODFR and/or low light-tolerance nucleic acid can be a variant of the nucleic acid having the nucleotide sequence set forth in SEQ ID NO:315 or SEQ ID NO:316. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:315 or SEQ ID NO:316.

An SD+EODFR and/or low light-tolerance nucleic acid can comprise the nucleotide sequence set forth in SEQ ID NO:335 or SEQ ID NO:336. Alternatively, an SD+EODFR and/or low light-tolerance nucleic acid can be a variant of the nucleic acid having the nucleotide sequence set forth in SEQ ID NO:335 or SEQ ID NO:336. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:335 or SEQ ID NO:336.

An SD+EODFR and/or low light-tolerance nucleic acid can comprise the nucleotide sequence set forth in SEQ ID NO:454 or SEQ ID NO:455. Alternatively, an SD+EODFR and/or low light-tolerance nucleic acid can be a variant of the nucleic acid having the nucleotide sequence set forth in SEQ ID NO:454 or SEQ ID NO:455. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:454 or SEQ ID NO:455.

An SD+EODFR and/or low light-tolerance nucleic acid can comprise the nucleotide sequence set forth in SEQ ID NO:537. Alternatively, an SD+EODFR and/or low light-tolerance nucleic acid can be a variant of the nucleic acid having the nucleotide sequence set forth in SEQ ID NO:537. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:537.

An SD+EODFR and/or low light-tolerance nucleic acid can comprise the nucleotide sequence set forth in SEQ ID NO:568 or SEQ ID NO:569. Alternatively, an SD+EODFR and/or low light-tolerance nucleic acid can be a variant of the nucleic acid having the nucleotide sequence set forth in SEQ ID NO:568 or SEQ ID NO:569. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:568 or SEQ ID NO:569.

An SD+EODFR and/or low light-tolerance nucleic acid can comprise the nucleotide sequence set forth in SEQ ID NO:604 or SEQ ID NO:605. Alternatively, an SD+EODFR and/or low light-tolerance nucleic acid can be a variant of the nucleic acid having the nucleotide sequence set forth in SEQ ID NO:604 or SEQ ID NO:605. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:604 or SEQ ID NO:605.

An SD+EODFR and/or low light-tolerance nucleic acid can comprise the nucleotide sequence set forth in SEQ ID NO:632 or SEQ ID NO:633. Alternatively, an SD+EODFR and/or low light-tolerance nucleic acid can be a variant of the nucleic acid having the nucleotide sequence set forth in SEQ ID NO:632 or SEQ ID NO:633. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:632 or SEQ ID NO:633.

An SD+EODFR and/or low light-tolerance nucleic acid can comprise the nucleotide sequence set forth in SEQ ID NO:642 or SEQ ID NO:643. Alternatively, an SD+EODFR and/or low light-tolerance nucleic acid can be a variant of the nucleic acid having the nucleotide sequence set forth in SEQ ID NO:642 or SEQ ID NO:643. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:642 or SEQ ID NO:643.

An SD+EODFR and/or low light-tolerance nucleic acid can comprise the nucleotide sequence set forth in SEQ ID NO:848 or SEQ ID NO:849. Alternatively, an SD+EODFR and/or low light-tolerance nucleic acid can be a variant of the nucleic acid having the nucleotide sequence set forth in SEQ ID NO:848 or SEQ ID NO:849. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:848 or SEQ ID NO:849.

An SD+EODFR and/or low light-tolerance nucleic acid can comprise the nucleotide sequence set forth in SEQ ID NO:905 or SEQ ID NO:906. Alternatively, an SD+EODFR and/or low light-tolerance nucleic acid can be a variant of the nucleic acid having the nucleotide sequence set forth in SEQ ID NO:905 or SEQ ID NO:906. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:905 or SEQ ID NO:906.

An SD+EODFR and/or low light-tolerance nucleic acid can comprise the nucleotide sequence set forth in SEQ ID NO:951 or SEQ ID NO:952. Alternatively, an SD+EODFR and/or low light-tolerance nucleic acid can be a variant of the nucleic acid having the nucleotide sequence set forth in SEQ ID NO:951 or SEQ ID NO:952. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:951 or SEQ ID NO:952.

An SD+EODFR and/or low light-tolerance nucleic acid can comprise the nucleotide sequence set forth in SEQ ID NO:1019, SEQ ID NO:1020, SEQ ID NO:1021, SEQ ID NO:1022, or SEQ ID NO:1023. Alternatively, an SD+EODFR and/or low light-tolerance nucleic acid can be a variant of the nucleic acid having the nucleotide sequence set forth in SEQ ID NO:1019, SEQ ID NO:1020, SEQ ID NO:1021, SEQ ID NO:1022, or SEQ ID NO:1023. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1019, SEQ ID NO:1020, SEQ ID NO:1021, SEQ ID NO:1022, or SEQ ID NO:1023.

An SD+EODFR and/or low light-tolerance nucleic acid can comprise the nucleotide sequence set forth in SEQ ID NO:1045 or SEQ ID NO:1046. Alternatively, an SD+EODFR and/or low light-tolerance nucleic acid can be a variant of the nucleic acid having the nucleotide sequence set forth in SEQ ID NO:1045 or SEQ ID NO:1046. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1045 or SEQ ID NO:1046.

An SD+EODFR and/or low light-tolerance nucleic acid can comprise the nucleotide sequence set forth in SEQ ID NO:1150. Alternatively, an SD+EODFR and/or low light-tolerance nucleic acid can be a variant of the nucleic acid having the nucleotide sequence set forth in SEQ ID NO:1150. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1150.

An SD+EODFR and/or low light-tolerance nucleic acid can comprise the nucleotide sequence set forth in SEQ ID NO:1275 or SEQ ID NO:1276. Alternatively, an SD+EODFR and/or low light-tolerance nucleic acid can be a variant of the nucleic acid having the nucleotide sequence set forth in SEQ ID NO:1275 or SEQ ID NO:1276. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1275 or SEQ ID NO:1276.

An SD+EODFR and/or low light-tolerance nucleic acid can comprise the nucleotide sequence set forth in SEQ ID NO:1345 or SEQ ID NO:1346. Alternatively, an SD+EODFR and/or low light-tolerance nucleic acid can be a variant of the nucleic acid having the nucleotide sequence set forth in SEQ ID NO:1345 or SEQ ID NO:1346. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1345 or SEQ ID NO:1346.

An SD+EODFR and/or low light-tolerance nucleic acid can comprise the nucleotide sequence set forth in SEQ ID NO:1453, SEQ ID NO:1454, SEQ ID NO:1455, or SEQ ID NO:1456. Alternatively, an SD+EODFR and/or low light-tolerance nucleic acid can be a variant of the nucleic acid having the nucleotide sequence set forth in SEQ ID NO:1453, SEQ ID NO:1454, SEQ ID NO:1455, or SEQ ID NO:1456. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1453, SEQ ID NO:1454, SEQ ID NO:1455, or SEQ ID NO:1456.

An SD+EODFR and/or low light-tolerance nucleic acid can comprise the nucleotide sequence set forth in SEQ ID NO:1495 or SEQ ID NO:1496. Alternatively, an SD+EODFR and/or low light-tolerance nucleic acid can be a variant of the nucleic acid having the nucleotide sequence set forth in SEQ ID NO:1495 or SEQ ID NO:1496. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1495 or SEQ ID NO:1496.

An SD+EODFR and/or low light-tolerance nucleic acid can comprise the nucleotide sequence set forth in SEQ ID NO:1537, SEQ ID NO:1538, or SEQ ID NO:1539. Alternatively, an SD+EODFR and/or low light-tolerance nucleic acid can be a variant of the nucleic acid having the nucleotide sequence set forth in SEQ ID NO:1537, SEQ ID NO:1538, or SEQ ID NO:1539. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1537, SEQ ID NO:1538, or SEQ ID NO:1539.

An SD+EODFR and/or low light-tolerance nucleic acid can comprise the nucleotide sequence set forth in SEQ ID NO:1585 or SEQ ID NO:1586. Alternatively, an SD+EODFR and/or low light-tolerance nucleic acid can be a variant of the nucleic acid having the nucleotide sequence set forth in SEQ ID NO:1585 or SEQ ID NO:1586. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1585 or SEQ ID NO:1586.

An SD+EODFR and/or low light-tolerance nucleic acid can comprise the nucleotide sequence set forth in SEQ ID NO:1626, SEQ ID NO:1627, SEQ ID NO:1628, or SEQ ID NO:1629. Alternatively, an SD+EODFR and/or low light-tolerance nucleic acid can be a variant of the nucleic acid having the nucleotide sequence set forth in SEQ ID NO:1626, SEQ ID NO:1627, SEQ ID NO:1628, or SEQ ID NO:1629. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1626, SEQ ID NO:1627, SEQ ID NO:1628, or SEQ ID NO:1629.

An SD+EODFR and/or low light-tolerance nucleic acid can comprise the nucleotide sequence set forth in SEQ ID NO:1633 or SEQ ID NO:1634. Alternatively, an SD+EODFR and/or low light-tolerance nucleic acid can be a variant of the nucleic acid having the nucleotide sequence set forth in SEQ ID NO:1633 or SEQ ID NO:1634. For example, an SD+EODFR and/or low light-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1633 or SEQ ID NO:1634.

B. Nucleic Acids Encoding Red Light Specific Response Pathway Polypeptides

Nucleic acids encoding red light specific response pathway polypeptides are described herein. Such nucleic acids include SEQ ID NOs: 454, 455, 461, 463, 465, 467, 469, 471, 473, 476, 490, 492, 500, 502, 504, 506, 513, 517, 519, 951, 952, 954, 956, 958, 960, 962, 964, 968, 970, 972, 974, 976, 978, 980, 982, 984, 986, 988, 990, 992, 994, 996, 998, 1000, 1002, 1004, 1006, 1008, 1010, 1012, 1017, 1537, 1538, 1539, 1542, 1544, 1546, 1548, 1550, 1552, 1560, 1562, 1569, 1571, 1573, 1575, 1577, 1579, 1581, 1583, 1660, 1662, 1664, 1666, 1668, 1670, 1672, 1674, 1676, 1779, 1781, 1783, 1785, 1787, 1789, 1791, 1793, 1795, 1797, 1799, 1801, 1803, 1841, and 2267 as described in more detail below. A nucleic acid also can be a fragment that is at least 40% (e.g., at least 45, 50, 55, 60, 65, 70, 75, 80, 85, 90, 95, or 99%) of the length of the full-length nucleic acid set forth in SEQ ID NOs: 454, 455, 461, 463, 465, 467, 469, 471, 473, 476, 490, 492, 500, 502, 504, 506, 513, 517, 519, 951, 952, 954, 956, 958, 960, 962, 964, 968, 970, 972, 974, 976, 978, 980, 982, 984, 986, 988, 990, 992, 994, 996, 998, 1000, 1002, 1004, 1006, 1008, 1010, 1012, 1017, 1537, 1538, 1539, 1542, 1544, 1546, 1548, 1550, 1552, 1560, 1562, 1569, 1571, 1573, 1575, 1577, 1579, 1581, 1583, 1660, 1662, 1664, 1666, 1668, 1670, 1672, 1674, 1676, 1779, 1781, 1783, 1785, 1787, 1789, 1791, 1793, 1795, 1797, 1799, 1801, 1803, 1841, and 2267.

A red light specific response pathway nucleic acid can comprise the nucleotide sequence set forth in SEQ ID NO:454 or SEQ ID NO:455. Alternatively, a red light specific response pathway nucleic acid can be a variant of the nucleic acid having the nucleotide sequence set forth in SEQ ID NO:454 or SEQ ID NO:455. For example, a red light specific response pathway nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:454 or SEQ ID NO:455.

A red light specific response pathway nucleic acid can comprise the nucleotide sequence set forth in SEQ ID NO:951 or SEQ ID NO:952. Alternatively, a red light specific response pathway nucleic acid can be a variant of the nucleic acid having the nucleotide sequence set forth in SEQ ID NO:951 or SEQ ID NO:952. For example, a red light specific response pathway nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:951 or SEQ ID NO:952.

A red light specific response pathway nucleic acid can comprise the nucleotide sequence set forth in SEQ ID NO:1537, SEQ ID NO:1538, or SEQ ID NO:1539. Alternatively, a red light specific response pathway nucleic acid can be a variant of the nucleic acid having the nucleotide sequence set forth in SEQ ID NO:1537, SEQ ID NO:1538, or SEQ ID NO:1539. For example, a red light specific response pathway nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1537, SEQ ID NO:1538, or SEQ ID NO:1539.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

C. Use of Nucleic Acids to Modulate Expression of Polypeptides Expression of an SD+EODFR and/or Low Light-Tolerance Polypeptide A nucleic acid encoding one of the SD+EODFR and/or low light-tolerance polypeptides described herein can be used to express the polypeptide in a plant species of interest, typically by transforming a plant cell with a nucleic acid having the coding sequence for the polypeptide operably linked in sense orientation to one or more regulatory regions. It will be appreciated that because of the degeneracy of the genetic code, a number of nucleic acids can encode a particular SD+EODFR and/or low light-tolerance polypeptide; i.e., for many amino acids, there is more than one nucleotide triplet that serves as the codon for the amino acid. Thus, codons in the coding sequence for a given SD+EODFR and/or low light-tolerance polypeptide can be modified such that optimal expression in a particular plant species is obtained, using appropriate codon bias tables for that species.

In some cases, expression of an SD+EODFR and/or low light-tolerance polypeptide inhibits one or more functions of an endogenous polypeptide. For example, a nucleic acid that encodes a dominant negative polypeptide can be used to inhibit protein function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation.

D. Use of Nucleic Acids to Inhibit Expression of a Red Light Specific Response Pathway Polypeptide Polynucleotides and recombinant constructs described herein can be used to inhibit expression of a red light specific response pathway polypeptide in a plant species of interest. See, e.g., Matzke and Birchler, *Nature Reviews Genetics*, 6:24-35 (2005); Akashi et al., *Nature Reviews Mol. Cell Biology*, 6:413-422 (2005); Mittal, *Nature Reviews Genetics*, 5:355-365 (2004); and *Nature Reviews RNA interference collection*, October 2005 at nature.com/reviews/focus/mai. A number of nucleic acid based methods, including anti-sense RNA, ribozyme directed RNA cleavage, post-transcriptional gene silencing (PTGS), e.g., RNA interference (RNAi), and transcriptional gene silencing (TGS) are known to inhibit gene expression in plants. Suitable polynucleotides include full-length nucleic acids encoding red light specific response pathway polypeptides or fragments of such full-length nucleic acids. In some embodiments, a complement of the full-length nucleic acid or a fragment thereof can be used. Typically, a fragment is at least 10 nucleotides, e.g., at least 12, 13, 14, 15, 16, 17, 18, 19, 20, 21, 22, 23, 24, 25, 26, 27, 30, 35, 40, 50, 80, 100, 200, 500 nucleotides or more. Generally, higher homology can be used to compensate for the use of a shorter sequence.

Antisense technology is one well-known method. In this method, a nucleic acid of a gene to be repressed is cloned and operably linked to a regulatory region and a transcription termination sequence so that the antisense strand of RNA is transcribed. The recombinant construct is then transformed into plants, as described herein, and the antisense strand of RNA is produced. The nucleic acid need not be the entire sequence of the gene to be repressed, but typically will be substantially complementary to at least a portion of the sense strand of the gene to be repressed.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contains a 5 '-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad. Sci. USA*, 92(13):6175-6179 (1995); de Feyter and Gaudron, Methods in Molecular Biology, Vol. 74, Chapter 43, "Expressing Ribozymes in Plants", Edited by Turner, P. C., Humana Press Inc., Totowa, N.J. RNA endoribonucleases which have been described, such as the one that occurs naturally in *Tetrahymena thermophila*, can be useful. See, for example, U.S. Pat. Nos. 4,987,071 and 6,423,885.

PTGS, e.g., RNAi, can also be used to inhibit the expression of a gene. For example, a construct can be prepared that includes a sequence that is transcribed into an RNA that can anneal to itself, e.g., a double stranded RNA having a stem-loop structure. In some embodiments, one strand of the stem portion of a double stranded RNA comprises a sequence that is similar or identical to the sense coding sequence or a fragment thereof of a red light specific response pathway polypeptide, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand or a fragment thereof of the coding sequence of the red light specific response pathway polypeptide, and can have a length that is shorter, the same as, or longer than the corresponding length of the sense sequence. In some cases, one strand of the stem portion of a double stranded RNA comprises a sequence that is similar or identical to the 3' or 5' untranslated region, or a fragment thereof, of an mRNA encoding a red light specific response pathway polypeptide, and the other strand of the stem portion of the double stranded RNA comprises a sequence that is similar or identical to the sequence that is complementary to the 3' or 5' untranslated region, respectively, or a fragment thereof, of the mRNA encoding the red light specific response pathway polypeptide. In other embodiments, one strand of the stem portion of a double stranded RNA comprises a sequence that is similar or identical to the sequence of an intron, or a fragment thereof, in the pre-mRNA encoding a red light specific response pathway polypeptide, and the other strand of the stem portion comprises a sequence that is similar or identical to the sequence that is complementary to the sequence of the intron, or a fragment thereof, in the pre-mRNA.

The loop portion of a double stranded RNA can be from 3 nucleotides to 5,000 nucleotides, e.g., from 3 nucleotides to 25 nucleotides, from 15 nucleotides to 1,000 nucleotides, from 20 nucleotides to 500 nucleotides, or from 25 nucleotides to 200 nucleotides. The loop portion of the RNA can include an intron or a fragment thereof. A double stranded RNA can have zero, one, two, three, four, five, six, seven, eight, nine, ten, or more stem-loop structures.

A construct including a sequence that is operably linked to a regulatory region and a transcription termination sequence, and that is transcribed into an RNA that can form a double stranded RNA, is transformed into plants as described herein. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

Constructs containing regulatory regions operably linked to nucleic acid molecules in sense orientation can also be used to inhibit the expression of a gene. The transcription product can be similar or identical to the sense coding sequence, or a fragment thereof, of a red light specific response pathway polypeptide. The transcription product also can be unpolyadenylated, lack a 5' cap structure, or contain an unspliceable intron. Methods of inhibiting gene expression using a full-length cDNA as well as a partial cDNA sequence are known in the art. See, e.g., U.S. Pat. No. 5,231,020.

In some embodiments, a construct containing a nucleic acid having at least one strand that is a template for both sense and antisense sequences that are complementary to each other is used to inhibit the expression of a gene. The sense and antisense sequences can be part of a larger nucleic acid molecule or can be part of separate nucleic acid molecules having sequences that are not complementary. The sense or antisense sequence can be a sequence that is identical or complementary to the sequence of an mRNA, the 3' or 5' untranslated region of an mRNA, or an intron in a pre-mRNA encoding a red light specific response pathway polypeptide, or a fragment of such sequences. In some embodiments, the sense or antisense sequence is identical or complementary to a sequence of the regulatory region that drives transcription of the gene encoding a red light specific response pathway polypeptide. In each case, the sense sequence is the sequence that is complementary to the antisense sequence.

The sense and antisense sequences can be a length greater than about 10 nucleotides (e.g., 12, 13, 14, 15, 16, 17, 18, 19, 20, 21, 22, 23, 24, 25, 26, 27, 28, 29, 30, or more nucleotides). For example, an antisense sequence can be 21 or 22 nucleotides in length. Typically, the sense and antisense sequences range in length from about 15 nucleotides to about 30 nucleotides, e.g., from about 18 nucleotides to about 28 nucleotides, or from about 21 nucleotides to about 25 nucleotides.

In some embodiments, an antisense sequence is a sequence complementary to an mRNA sequence, or a fragment thereof, encoding a red light specific response pathway polypeptide described herein. The sense sequence complementary to the antisense sequence can be a sequence present within the mRNA of the red light specific response pathway polypeptide. Typically, sense and antisense sequences are designed to correspond to a 15-30 nucleotide sequence of a target mRNA such that the level of that target mRNA is reduced.

In some embodiments, a construct containing a nucleic acid having at least one strand that is a template for more than one sense sequence (e.g., 2, 3, 4, 5, 6, 7, 8, 9, 10 or more sense sequences) can be used to inhibit the expression of a gene. Likewise, a construct containing a nucleic acid having at least one strand that is a template for more than one antisense sequence (e.g., 2, 3, 4, 5, 6, 7, 8, 9, 10 or more antisense sequences) can be used to inhibit the expression of a gene. For example, a construct can contain a nucleic acid having at least one strand that is a template for two sense sequences and two antisense sequences. The multiple sense sequences can be identical or different, and the multiple antisense sequences can be identical or different. For example, a construct can have a nucleic acid having one strand that is a template for two identical sense sequences and two identical antisense sequences that are complementary to the two identical sense sequences. Alternatively, an isolated nucleic acid can have one strand that is a template for (1) two identical sense sequences 20 nucleotides in length, (2) one antisense sequence that is complementary to the two identical sense sequences 20 nucleotides in length, (3) a sense sequence 30 nucleotides in length, and (4) three identical antisense sequences that are complementary to the sense sequence 30 nucleotides in length. The constructs provided herein can be designed to have a suitable arrangement of sense and antisense sequences. For example, two identical sense sequences can be followed by two identical antisense sequences or can be positioned between two identical antisense sequences.

A nucleic acid having at least one strand that is a template for one or more sense and/or antisense sequences can be operably linked to a regulatory region to drive transcription of an RNA molecule containing the sense and/or antisense sequence(s). In addition, such a nucleic acid can be operably linked to a transcription terminator sequence, such as the terminator of the nopaline synthase (nos) gene. In some cases, two regulatory regions can direct transcription of two transcripts: one from the top strand, and one from the bottom strand. See, for example, Yan et al., Plant Physiol., 141: 1508-1518 (2006). The two regulatory regions can be the same or different. The two transcripts can form double-stranded RNA molecules that induce degradation of the target RNA. In some cases, a nucleic acid can be positioned within a T-DNA or plant-derived transfer DNA (P-DNA) such that the left and right T-DNA border sequences, or the left and right border-like sequences of the P-DNA, flank or are on either side of the nucleic acid. See, US 2006/0265788. The nucleic acid sequence between the two regulatory regions can be from about 15 to about 300 nucleotides in length. In some embodiments, the nucleic acid sequence between the two regulatory regions is from about 15 to about 200 nucleotides in length, from about 15 to about 100 nucleotides in length, from about 15 to about 50 nucleotides in length, from about 18 to about 50 nucleotides in length, from about 18 to about 40 nucleotides in length, from about 18 to about 30 nucleotides in length, or from about 18 to about 25 nucleotides in length.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, 1997, *Antisense Nucleic Acid Drug Dev.*, 7:187-195; Hyrup et al., *Bioorgan. Med. Chem.*, 4:5-23 (1996). In addition, the deoxyphosphate backbone can be replaced with, for example, a phosphorothioate or phosphorodithioate backbone, a phosphoroamidite, or an alkyl phosphotriester backbone.

E. Constructs/Vectors

Recombinant constructs provided herein can be used to transform plants or plant cells in order to modulate SD+EODFR, low light tolerance, and/or red light specific response pathways. A recombinant nucleic acid construct can comprise a nucleic acid encoding an SD+EODFR and/or low light-tolerance polypeptide as described herein, operably linked to a regulatory region suitable for expressing the SD+EODFR and/or low light-tolerance polypeptide in the plant or cell. Thus, a nucleic acid can comprise a coding sequence that encodes any of the SD+EODFR and/or low light-tolerance polypeptides as set forth in SEQ ID NOs:3, 5, 7, 9, 10, 12, 14, 16, 18, 20, 22, 24, 25, 26, 28, 30, 32, 34, 36, 38, 40, 42, 44, 46, 48, 49, 51, 53, 55, 57, 59, 60, 61, 62, 63, 65, 67, 70, 72, 74, 76, 78, 80, 82, 84, 86, 88, 89, 90, 91, 93, 95, 96, 97, 98, 99, 100, 101, 102, 103, 105, 107, 109, 111, 113, 115, 116, 117, 118, 119, 120, 121, 122, 124, 126, 129, 130, 131, 132, 133, 135, 137, 139, 141, 143, 145, 147, 149, 151, 153, 155, 157, 159, 161, 163, 165, 167, 169, 171, 173, 175, 177, 179, 181, 183, 185, 187, 188, 189, 191, 193, 195, 197, 199, 201, 203, 205, 207, 209, 211, 213, 215, 217, 219, 221, 223, 225, 227, 229, 230, 231, 232, 233, 234, 235, 236, 237, 238, 239, 241, 243, 245, 247, 249, 251, 253, 255, 257, 259, 261, 262, 264, 266, 268, 270, 271, 273, 275, 277, 279, 281, 283, 285, 287, 289, 291, 292, 293, 294, 295, 296, 297, 298, 299, 300, 301, 302, 303, 304, 306, 308, 310, 312, 314, 317, 319, 321, 323, 325, 327, 329, 330, 331, 332, 334, 337, 339, 341, 343, 344, 346, 347, 348, 349, 350, 351, 352, 353, 354, 355, 357, 359, 361, 362, 364, 365, 366, 367, 368, 370, 372, 374, 376, 378, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 456, 457, 458, 459, 460, 462, 464, 466, 468, 470, 472, 474, 475, 477, 478, 479, 480, 481, 482, 483, 484, 485, 486, 487, 488, 489, 491, 493, 494, 495, 496, 497, 498, 499, 501, 503, 505, 507, 508, 509, 510, 511, 512, 514, 515, 516, 518, 520, 521, 522, 523, 524, 525, 526, 527, 528, 529, 530, 531, 532, 533, 534, 535, 536, 538, 539, 541, 542, 543, 544, 545, 546, 547, 548, 549, 550, 552, 554, 555, 556, 557, 558, 559, 560, 561, 562, 563, 564, 565, 567, 570, 572, 574, 576, 578, 579, 580, 582, 584, 586, 588, 590, 592, 594, 596, 598, 600, 601, 603, 606, 607, 608, 609, 611, 613, 615, 616, 617, 618, 620, 621, 622, 624, 625, 626, 628, 629, 631, 634, 636, 637, 638, 639, 641, 644, 645, 647, 649, 651, 653, 655, 657, 659, 661, 663, 665, 667, 669, 671, 673, 675, 676, 678, 680, 682, 684, 686, 688, 690, 692, 694, 695, 697, 699, 701, 702, 704, 706, 708, 709, 711, 712, 713, 714, 716, 718, 720, 721, 723, 725, 726, 728, 730, 732, 734, 736, 738, 740, 741, 742, 743, 744, 745, 747, 749, 750, 751, 753, 755, 757, 759, 761, 762, 763, 764, 765, 767, 769, 771, 773, 774, 776, 778, 779, 780, 782, 783, 784, 786, 788, 790, 792, 794, 795, 796, 797, 798, 799, 800, 801, 802, 803, 804, 805, 806, 807, 808, 809, 810, 811, 812, 813, 814, 815, 816, 817, 818, 819, 820, 821, 822, 823, 824, 826, 827, 829, 830, 831, 832, 833, 834, 835, 837, 838, 839, 840, 841, 843, 845, 847, 850, 851, 853, 855, 857, 859, 861, 862, 863, 864, 865, 866, 868, 870, 872, 874, 876, 877, 879, 881, 883, 885, 887, 889, 891, 893, 895, 897, 898, 900, 902, 904, 907, 909, 911, 913, 915, 917, 919, 920, 922, 923, 924, 926, 928, 929, 930, 931, 932, 934, 936, 937, 938, 939, 940, 941, 943, 945, 947, 948, 949, 950, 953, 955, 957, 959, 961, 963, 965, 966, 967, 969, 971, 973, 975, 977, 979, 981, 983, 985, 987, 989, 991, 993, 995, 997, 999, 1001, 1003, 1005, 1007, 1009, 1011, 1013, 1014, 1015, 1016, 1018, 1024, 1025, 1027, 1029, 1030, 1032, 1033, 1035, 1037, 1039, 1040, 1042, 1043, 1044, 1047, 1049, 1051, 1053, 1055, 1057, 1059, 1061, 1063, 1065, 1067, 1068, 1069, 1071, 1072, 1073, 1074, 1075, 1077, 1078, 1080, 1081, 1083, 1085, 1087, 1089, 1091, 1093, 1095, 1097, 1098, 1099, 1100, 1101, 1103, 1105, 1107, 1109, 1111, 1113, 1115, 1117, 1119, 1121, 1123, 1125, 1127, 1129, 1131, 1133, 1134, 1135, 1136, 1137, 1138, 1139, 1141, 1143, 1145, 1147, 1149, 1151, 1153, 1155, 1157, 1159, 1160, 1161, 1162, 1164, 1166, 1168, 1170, 1172, 1174, 1176, 1178, 1180, 1182, 1184, 1186, 1188, 1190, 1192, 1194, 1196, 1198, 1199, 1200, 1201, 1202, 1203, 1204, 1206, 1208, 1209, 1211, 1213, 1214, 1215, 1216, 1217, 1219, 1221, 1223, 1225, 1227, 1229, 1230, 1232, 1234, 1236, 1238, 1240, 1242, 1244, 1246, 1248, 1250, 1252, 1254, 1255, 1256, 1257, 1258, 1259, 1260, 1261, 1262, 1263, 1264, 1266, 1268, 1270, 1272, 1274, 1277, 1279, 1281, 1283, 1285, 1287, 1289, 1291, 1293, 1294, 1295, 1297, 1298, 1299, 1301, 1303, 1305, 1307, 1309, 1311, 1313, 1315, 1317, 1319, 1321, 1322, 1323, 1324, 1325, 1326, 1327, 1328, 1329, 1330, 1331, 1332, 1334, 1336, 1338, 1340, 1342, 1344, 1347, 1349, 1351, 1352, 1353, 1355, 1357, 1358, 1360, 1362, 1364, 1366, 1367, 1368, 1370, 1372, 1374, 1375, 1377, 1379, 1381, 1383, 1385, 1387, 1389, 1391, 1393, 1395, 1397, 1399, 1401, 1402, 1404, 1406, 1408, 1410, 1411, 1412, 1413, 1414, 1415, 1417, 1419, 1421, 1422, 1423, 1424, 1425, 1426, 1427, 1429, 1430, 1431, 1433, 1434, 1435, 1436, 1438, 1439, 1440, 1442, 1444, 1446, 1448, 1450, 1452, 1457, 1458, 1460, 1462, 1464, 1466, 1467, 1468, 1469, 1471, 1473, 1475, 1477, 1478, 1479, 1480, 1481, 1482, 1483, 1484, 1485, 1486, 1488, 1490, 1492, 1494, 1497, 1499, 1501, 1502, 1503, 1504, 1505, 1506, 1508, 1510, 1511, 1512, 1513, 1514, 1515, 1516, 1518, 1519, 1520, 1521, 1522, 1523, 1524, 1525, 1527, 1528, 1529, 1531, 1532, 1533, 1534, 1535, 1536, 1540, 1541, 1543, 1545, 1547, 1549, 1551, 1553, 1554, 1555, 1556, 1557, 1558, 1559, 1561, 1563, 1564, 1565, 1566, 1567, 1568, 1570, 1572, 1574, 1576, 1578, 1580, 1582, 1584, 1587, 1589, 1591, 1593, 1594, 1596, 1597, 1598, 1599, 1600, 1601, 1602, 1603, 1604, 1605, 1606, 1607, 1609, 1611, 1612, 1613, 1614, 1615, 1616, 1617, 1618, 1619, 1620, 1621, 1623, 1625, 1630, 1631, 1632, 1635, 1637, 1639, 1641, 1642, 1643, 1644, 1646, 1648, 1650, 1651, 1652, 1653, 1654, 1655, 1657, 1659, 1661, 1663, 1665, 1667, 1669, 1671, 1673, 1675, 1677, 1679, 1681, 1682, 1684, 1686, 1688, 1690, 1692, 1694, 1696, 1698, 1699, 1700, 1701, 1702, 1703, 1704, 1705, 1707, 1709, 1711, 1713, 1715, 1717, 1719, 1720, 1721, 1722, 1723, 1725, 1727, 1729, 1730, 1732, 1734, 1736, 1738, 1739, 1740, 1741, 1742, 1743, 1744, 1745, 1746, 1748, 1750, 1751, 1752, 1754, 1756, 1758, 1760, 1762, 1764, 1766, 1767, 1768, 1769, 1770, 1771, 1772, 1773, 1774, 1775, 1776, 1777, 1778, 1780, 1782, 1784, 1786, 1788, 1790, 1792, 1794, 1796, 1798, 1800, 1802, 1804, 1805, 1806, 1807, 1808, 1809, 1810, 1811, 1812, 1813, 1814, 1815, 1816, 1817, 1818, 1819, 1820, 1821, 1822, 1823, 1824, 1825, 1826, 1827, 1828, 1829, 1830, 1831, 1832, 1833, 1834, 1835, 1836, 1837, 1838, 1839, 1840, 1842, 1843, 1844, 1845, 1846, 1847, 1848, 1850, 1852, 1854, 1856, 1858, 1859, 1860, 1861, 1862, 1863, 1864, 1865, 1866, 1867, 1869, 1870, 1871, 1873, 1875, 1877, 1879, 1881, 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2009, 2011, 2013, 2015, 2017, 2019, 2021, 2023, 2025, 2027, 2029, 2030, 2031, 2032, 2033, 2034, 2035, 2036, 2037, 2038, 2039, 2040, 2041, 2042, 2043, 2044, 2045, 2046, 2047, 2048, 2049, 2050, 2051, 2052, 2053, 2054, 2055, 2056, 2057, 2058, 2059, 2060, 2061, 2062, 2063, 2064, 2065, 2066, 2067, 2069, 2070, 2072, 2074, 2076, 2078, 2080, 2081, 2083, 2084, 2085, 2087, 2089, 2091, 2093, 2095, 2097, 2099, 2101, 2103, 2105, 2107, 2109, 2111, 2113, 2114, 2115, 2116, 2117, 2118, 2119, 2120, 2121, 2123, 2125, 2127, 2129, 2131, 2133, 2135, 2136, 2137, 2138, 2139, 2140, 2141, 2142, 2143, 2144, 2146, 2148, 2150, 2152, 2154, 2156, 2158, 2160, 2162, 2164, 2166, 2168, 2170, 2172, 2174, 2176, 2178, 2180, 2182, 2183, 2184, 2185, 2186, 2187, 2188, 2189, 2190, 2191, 2192, 2193, 2194, 2195, 2196, 2197, 2198, 2199, 2200, 2201, 2202, 2203, 2204, 2205, 2206, 2207, 2208, 2209, 2210, 2211, 2212, 2213, 2214, 2215, 2216, 2217, 2218, 2219, 2220, 2221, 2222, 2223, 2224, 2225, 2226, 2227, 2228, 2229, 2230, 2231, 2232, 2233, 2234, 2235, 2236, 2237, 2238, 2239, 2240, 2241, 2242, 2243, 2244, 2245, 2246, 2247, 2248, 2249, 2250, 2251, 2252, 2253, 2254, 2255, 2256, 2257, 2258, 2259, 2260, 2261, 2262, 2263, 2264, 2266, 2268, 2269, 2270, 2271, 2272, 2273, 2274, 2275, 2276, 2277, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2323, 2324, 2325, 2326, 2327, 2328, 2329, 2330, 2331, 2332, 2333, 2334, 2335, 2336, 2337, 2338, 2339, 2340, 2341, 2342, 2343, 2344, 2345, 2346, 2347, 2348, 2350, 2352, 2354, 2356, 2358, 2360, 2362, 2364, 2366, 2368, 2370, 2372, 2374, 2375, 2376, 2377, 2378, 2379, 2380, 2381. Examples of nucleic acids encoding SD+EODFR and/or low light-tolerance polypeptides are described herein. The SD+EODFR and/or low light-tolerance polypeptide encoded by a recombinant nucleic acid can be a native SD+EODFR and/or low light-tolerance polypeptide, or can be heterologous to the cell. In some cases, the recombinant construct contains a nucleic acid that inhibits expression of an SD+EODFR and/or low light-tolerance polypeptide, operably linked to a regulatory region. Examples of suitable regulatory regions are described in the section entitled "Regulatory Regions."

Vectors containing recombinant nucleic acid constructs such as those described herein also are provided. Suitable vector backbones include, for example, those routinely used in the art such as plasmids, viruses, artificial chromosomes, BACs, YACs, or PACs. Suitable expression vectors include, without limitation, plasmids and viral vectors derived from, for example, bacteriophage, baculoviruses, and retroviruses. Numerous vectors and expression systems are commercially available from such corporations as Novagen (Madison, Wis.), Clontech (Palo Alto, Calif.), Stratagene (La Jolla, Calif.), and Invitrogen/Life Technologies (Carlsbad, Calif.).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., glyphosate, chlorsulfuron or phosphinothricin). In addition, an expression vector can include a tag sequence designed to facilitate manipulation or detection (e.g., purification or localization) of the expressed polypeptide. Tag sequences, such as luciferase, β-glucuronidase (GUS), green fluorescent protein (GFP), glutathione S-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus.

F. Regulatory Regions

The choice of regulatory regions to be included in a recombinant construct depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence. Transcription of a nucleic acid can be modulated in a similar manner.

Some suitable regulatory regions initiate transcription only, or predominantly, in certain cell types. Methods for identifying and characterizing regulatory regions in plant genomic DNA are known, including, for example, those described in the following references: Jordano et al., *Plant Cell*, 1:855-866 (1989); Bustos et al., *Plant Cell*, 1:839-854 (1989); Green et al., *EMBO J.*, 7:4035-4044 (1988); Meier et al., *Plant Cell*, 3:309-316 (1991); and Zhang et al., *Plant Physiology*, 110:1069-1079 (1996).

Examples of various classes of regulatory regions are described below. Some of the regulatory regions indicated below as well as additional regulatory regions are described in more detail in U.S. Patent Application Ser. Nos. 60/505,689; 60/518,075; 60/544,771; 60/558,869; 60/583,691; 60/619,181; 60/637,140; 60/757,544; 60/776,307; 10/957,569; 11/058,689; 11/172,703; 11/208,308; 11/274,890; 60/583,609; 60/612,891; 11/097,589; 11/233,726; 11/408,791; 11/414,142; 10/950,321; 11/360,017; PCT/US05/011105; PCT/US05/23639; PCT/US05/034308; PCT/US05/034343; and PCT/US06/038236; PCT/US06/040572; and PCT/US07/62762.

For example, the sequences of regulatory regions p326, YP0144, YP0190, p13879, YP0050, p32449, 21876, YP0158, YP0214, YP0380, PT0848, PT0633, YP0128, YP0275, PT0660, PT0683, PT0758, PT0613, PT0672, PT0688, PT0837, YP0092, PT0676, PT0708, YP0396, YP0007, YP0111, YP0103, YP0028, YP0121, YP0008, YP0039, YP0115, YP0119, YP0120, YP0374, YP0101, YP0102, YP0110, YP0117, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, PT0710, YP0356, YP0385, YP0384, YP0286, YP0377, PD1367, PT0863, PT0829, PT0665, PT0678, YP0086, YP0188, YP0263, PT0743 and YP0096 are set forth in the sequence listing of PCT/US06/040572; the sequence of regulatory region PT0625 is set forth in the sequence listing of PCT/US05/034343; the sequences of regulatory regions PT0623, YP0388, YP0087, YP0093, YP0108, YP0022 and YP0080 are set forth in the sequence listing of U.S. patent application Ser. No. 11/172,703; the sequence of regulatory region PR0924 is set forth in the sequence listing of PCT/US07/62762; and the sequences of regulatory regions p530c10, pOsFIE2-2, pOsMEA, pOsYp102, and pOsYp285 are set forth in the sequence listing of PCT/US06/038236.

It will be appreciated that a regulatory region may meet criteria for one classification based on its activity in one plant species, and yet meet criteria for a different classification based on its activity in another plant species.

i. Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

ii. Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA*, 86:7890-7894 (1989)), root cell specific promoters reported by Conkling et al., *Plant Physiol.*, 93:1203-1211 (1990), and the tobacco RD2 promoter.

iii. Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell*, 1(9):839-853 (1989)), the soybean trypsin inhibitor promoter (Riggs et al., *Plant Cell*, 1(6):609-621 (1989)), the ACP promoter (Baerson et al., *Plant Mol. Biol.*, 22(2):255-267 (1993)), the stearoyl-ACP desaturase promoter (Slocombe et al., *Plant Physiol.*, 104(4):167-176 (1994)), the soybean α' subunit of β-conglycinin promoter (Chen et al., *Proc. Natl. Acad. Sci. USA*, 83:8560-8564 (1986)), the oleosin promoter (Hong et al., *Plant Mol. Biol.*, 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell Biol.*, 13:5829-5842 (1993)), the beta-amylase promoter, and the barley hordein promoter. Other maturing endosperm promoters include the YP0092, PT0676, and PT0708 promoters.

iv. Ovary Tissue Promoters

Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

v. Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see, Urao (1996) Plant Mol. Biol., 32:571-57; Conceicao (1994) Plant, 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) Genetics, 142:1009-1020); maize Cat3 (see, GenBank No. L05934; Abler (1993) Plant Mol. Biol., 22:10131-1038). Other promoters include the following *Arabidopsis* promoters: YP0039, YP0101, YP0102, YP0110, YP0117, YP0119, YP0137, DME, YP0285, and YP0212. Other promoters that may be useful include the following rice promoters: p530c10, pOsFIE2-2, pOsMEA, pOsYp102, and pOsYp285.

vi. Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* (2001) 20:647-654), YP0097, YP0107, YP0088, YP0143, YP0156, PT0650, PT0695, PT0723, PT0838, PT0879, and PT0740.

vii. Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104:997-1006 (1994)), the cab1R promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA*, 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

viii. Vascular Tissue Promoters

Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, *Plant Cell*, 3(10):1051-1061 (1991)), the Commelina yellow mottle virus (CoYMV) promoter (Medberry et al., *Plant Cell*, 4(2):185-192 (1992)), and the rice tungro bacilliform virus (RTBV) promoter (Dai et al., *Proc. Natl. Acad. Sci. USA*, 101(2):687-692 (2004)).

ix. Inducible Promoters

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, PD1367, and PD0901. Examples of nitrogen-inducible promoters include PT0863, PT0829, PT0665, and PT0886. Examples of shade-inducible promoters include PR0924 and PT0678. An example of a promoter induced by salt is rd29A (Kasuga et al. (1999) Nature Biotech 17: 287-291).

x. Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

xi. Other Promoters

Other classes of promoters include, but are not limited to, shoot-preferential, callus-preferential, trichome cell-preferential, guard cell-preferential such as PT0678, tuber-preferential, parenchyma cell-preferential, and senescence-preferential promoters. Promoters designated YP0086, YP0188, YP0263, PT0758, PT0743, PT0829, YP0119, and YP0096, as described in the above-referenced patent applications, may also be useful.

xii. Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding an SD+EODFR and/or low light-tolerance polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

IV. Transgenic Plants and Plant Cells

A. Transformation

The invention also features transgenic plant cells and plants comprising at least one recombinant nucleic acid construct described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Transgenic plant cells used in methods described herein can constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species, or for further selection of other desirable traits. Alternatively, transgenic plants can be propagated vegetatively for those species amenable to such techniques. As used herein, a transgenic plant also refers to progeny of an initial transgenic plant provided the progeny inherits the transgene. Seeds produced by a transgenic plant can be grown and then selfed (or outcrossed and selfed) to obtain seeds homozygous for the nucleic acid construct.

Transgenic plants can be grown in suspension culture, or tissue or organ culture. For the purposes of this invention, solid and/or liquid tissue culture techniques can be used. When using solid medium, transgenic plant cells can be placed directly onto the medium or can be placed onto a filter that is then placed in contact with the medium. When using liquid medium, transgenic plant cells can be placed onto a flotation device, e.g., a porous membrane that contacts the liquid medium. A solid medium can be, for example, Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous SD+EODFR and/or low light-tolerance polypeptide whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880; 5,204,253; 6,329,571 and 6,013,863. If a cell or cultured tissue is used as the recipient tissue for transformation, plants can be regenerated from transformed cultures if desired, by techniques known to those skilled in the art.

B. Screening/Selection

A population of transgenic plants can be screened and/or selected for those members of the population that have a trait or phenotype conferred by expression of the transgene. For example, a population of progeny of a single transformation event can be screened for those plants having a desired level of expression of an SD+EODFR and/or low light-tolerance polypeptide or nucleic acid. Physical and biochemical methods can be used to identify expression levels. These include Southern analysis or PCR amplification for detection of a polynucleotide; Northern blots, 51 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known. As an alternative, a population of plants comprising independent transformation events can be screened for those plants having a desired trait, such as a modulated level SD+EODFR and/or low light tolerance. Selection and/or screening can be carried out over one or more generations, and/or in more than one geographic location. In some cases, transgenic plants can be grown and selected under conditions which induce a desired phenotype or are otherwise necessary to produce a desired phenotype in a transgenic plant. In addition, selection and/or screening can be applied during a particular developmental stage in which the phenotype is expected to be exhibited by the plant. Selection and/or screening can be carried out to choose those transgenic plants having a statistically significant difference in SD+EODFR and/or low light tolerance level relative to a control plant that lacks the transgene. Selected or screened transgenic plants have an altered phenotype as compared to a corresponding control plant, as described in the "Transgenic Plant Phenotypes" section herein.

C. Plant Species

The polynucleotides and vectors described herein can be used to transform a number of monocotyledonous and dicotyledonous plants and plant cell systems, including species from one of the following families: Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, or Vitaceae.

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis,* and *Zea.*

Suitable species include *Panicum* spp. or hybrids thereof, *Sorghum* spp. or hybrids thereof, sudangrass, *Miscanthus* spp. or hybrids thereof, *Saccharum* spp. or hybrids thereof, *Erianthus* spp., *Populus* spp., *Andropogon gerardii* (big bluestem), *Pennisetum purpureum* (elephant grass) or hybrids thereof (e.g., *Pennisetum purpureum* x *Pennisetum typhoidum*), *Phalaris arundinacea* (reed canarygrass), *Cynodon dactylon* (bermudagrass), *Festuca arundinacea* (tall fescue), *Spartina pectinata* (prairie cord-grass), *Medicago sativa* (alfalfa), *Arundo donax* (giant reed) or hybrids thereof, *Secale cereale* (rye), *Salix* spp. (willow), *Eucalyptus* spp. (eucalyptus), Triticosecale (triticum—wheat X rye) and bamboo.

In some embodiments, a suitable species can be a wild, weedy, or cultivated sorghum species such as, but not limited to, *Sorghum almum, Sorghum amplum, Sorghum angustum, Sorghum arundinaceum, Sorghum bicolor* (such as bicolor, guinea, caudatum, kafir, and durra), *Sorghum brachypodum, Sorghum bulbosum, Sorghum burmahicum, Sorghum controversum, Sorghum drummondii, Sorghum ecarinatum, Sorghum exstans, Sorghum grande, Sorghum halepense, Sorghum interjectum, Sorghum intrans, Sorghum laxiflorum, Sorghum leiocladum, Sorghum macrospermum, Sorghum matarankense, Sorghum miliaceum, Sorghum* nigrum, *Sorghum nitidum, Sorghum plumosum, Sorghum propinquum, Sorghum purpureosericeum, Sorghum stipoideum, Sorghum sudanensese, Sorghum timorense, Sorghum trichocladum, Sorghum versicolor, Sorghum virgatum, Sorghum vulgare*, or hybrids such as *Sorghum* x *almum, Sorghum* x *sudangrass* or *Sorghum* x *drummondii*.

Suitable species also include *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea*.

Suitable species also include *Beta vulgaris* (sugarbeet), and *Manihot esculenta* (cassava).

Suitable species also include *Lycopersicon esculentum* (tomato), *Lactuca sativa* (lettuce), *Musa paradisiaca* (banana), *Solanum tuberosum* (potato), *Brassica oleracea* (broccoli, cauliflower, Brussels sprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum* annum (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), and *Solanum melongena* (eggplant).

Suitable species also include *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica, Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp *Erythroxylum coca, Galanthus wornorii, Scopolia* spp., *Lycopodium serratum* (=*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii*, and *Tanacetum parthenium*.

Suitable species also include *Parthenium argentatum* (guayule), *Hevea* spp. (rubber), *Mentha spicata* (mint), *Mentha piperita* (mint), *Bixa orellana*, and *Alstroemeria* spp.

Suitable species also include *Rosa* spp. (rose), *Dianthus caryophyllus* (carnation), *Petunia* spp. (*petunia*) and *Poinsettia pulcherrima* (poinsettia).

Suitable species also include *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple), *Hordeum vulgare* (barley), *Poa pratensis* (bluegrass), *Lolium* spp. (ryegrass) and *Phleum pratense* (timothy).

Thus, the methods and compositions can be used over a broad range of plant species, including species from the dicot genera *Brassica, Carthamus, Glycine, Gossypium, Helianthus, Jatropha, Parthenium, Populus*, and *Ricinus*; and the monocot genera *Elaeis, Festuca, Hordeum, Lolium, Oryza, Panicum, Pennisetum, Phleum, Poa, Saccharum, Secale, Sorghum, Triticosecale, Triticum*, and *Zea*. In some embodiments, a plant is a member of the species *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

In certain embodiments, the polynucleotides and vectors described herein can be used to transform a number of monocotyledonous and dicotyledenous plants and plant cell systems, wherein such plants are hybrids of different species or varieties of a specific species (e.g., *Saccharum* sp. X *Miscanthus* sp., *Panicum virgatum* x *Panicum amarum, Panicum virgatum* x *Panicum amarulum*, and *Pennisetum purpureum* x *Pennisetum typhoidum*).

D. Transgenic Plant Phenotypes

The light in shady environments is enriched in FR wavelengths relative to the light in non-shady environments. Red wavelengths typically range from a photon irradiance of about 630 nm to a photon irradiance of about 700 nm. Far-red wavelengths typically range from a photon irradiance of about 700 nm to a photon irradiance of about 750 nm.

In some embodiments, a plant in which expression of an SD+EODFR and/or low light-tolerance polypeptide is modulated can have increased SD+EODFR and/or low light tolerance. The phenotype of a transgenic plant in which expression of an SD+EODFR and/or low light-tolerance polypeptide is modulated and a corresponding control plant that either lacks the transgene or does not express the transgene can be evaluated under particular environmental conditions that are useful for simulating shade, i.e., Short Day plus End-of-Day Far-Red (SD+EODFR) conditions. SD+EODFR conditions consist of a light period followed by a pulse of far-red-enriched light conditions followed by a 14 hour dark period. The light period is from about 9.0 to about 9.6 hours with a red:far-red ratio of about 5.5, with the following fluence rates: $blue_{450}$=12 μmol/m²/s, $red_{633}$=22 μmol/m²/S, $far\text{-}red_{740}$=4 μmol/m²/s, $PPFD_{400\text{-}700}$=55 μmol/m²/s. The pulse of far-red-enriched light conditions is from about 0.4 to about 1.0 hours with a red:far-red ratio of about 0.14 with the following fluence rates: $blue_{450}$=0.004 μmol/m²/s, $red_{633}$=10 μmol/m²/s, $far\text{-}red_{740}$=70 μmol/m²/s, $PPFD_{400\text{-}700}$=8 μmol/m²/s. Sources of lighting equipment appropriate for producing and maintaining SD+EODFR conditions are known to those in art.

The phenotype of a transgenic plant in which expression of an SD+EODFR and/or low light-tolerance polypeptide is modulated and a corresponding control plant can also be evaluated under conditions of low light irradiance. Low light conditions are conditions under which a plant is exposed to an irradiance of about 0.01 μmol/m²/s of light to about 20 μmol/m²/s of light at room temperature and about 70% relative humidity. For example, conditions under which a plant is exposed to 0.01, 1, 5, 10, 15, or 20 μmol/m²/s of light are low light conditions. Sources of lighting and other equipment appropriate for controlling light conditions are known to those in art.

Low light conditions typically have light of a combination of wavelengths, such as white light. White light can be supplied, e.g., by 32 watt fluorescent bulbs (Sylvania, F032/841/ECO, Danvers, Mass.), providing a red:far-red ratio of 13:1. Red wavelengths typically range from a photon irradiance of about 630 to about 700 nm. Far-red wavelengths typically range from a photon irradiance of about 700 to about 750 nm.

In some embodiments, the phenotype of a transgenic plant is assayed under low light conditions in which there is continuous low light during the light period of a light/dark cycle. Continuous low light conditions can be, for example, 16 hours of irradiance with 0.01 to 20 μmol/m²/s of light alternating with 8 hours of darkness. The phenotype of a transgenic plant is assayed once the plant has been exposed to continuous low light conditions during the light period of the light/dark cycle for seven days.

In some embodiments, the phenotype of a transgenic plant is assayed under red light conditions in which there is continuous red light. Continuous red light conditions can be, for example, continuous irradiance with about ~15 μmol/m$^2$/s of light with a red light to far-red light ratio (R:FR) of about 80. Continuous red light can be supplied by a LED array that can be used to activate and deactivate the plant photoreceptor phytochrome (e.g., SNAP-LITE™ Quantum Devices, WI). The phenotype of a transgenic plant is assayed once the plant has been exposed to continuous red light conditions for about five days.

In some embodiments, the phenotype of a transgenic plant is assayed under far-red light conditions in which there is continuous far-red light. Continuous far-red light conditions can be, for example, continuous irradiance with about 5 μmol/m$^2$/s of light with a R:FR of about 0.10. Continuous far-red light can be supplied by a LED array that can be used to activate and deactivate the plant photoreceptor phytochrome (e.g., SNAP-LITE™ Quantum Devices, WI). The phenotype of a transgenic plant is assayed once the plant has been exposed to continuous far-red light conditions for about five days.

In some embodiments, the phenotype of a transgenic plant is assayed under natural daylight or other broad spectrum light conditions. Natural daylight conditions, can be, for example, full sun or other natural irradiation of green house or field grown transgenic plants. Broad spectrum conditions can be irradiation supplied by a fluorescent lamp with continuous fluence rates of about 12 μmol/m$^2$/s of blue$_{450}$ light, 22 μmol/m$^2$/s of red$_{633}$ light, 4 μmol/m$^2$/s far-red$_{740}$ light, and photosynthetically active radiation (PAR$_{400-700}$) of about 55 μmol/m$^2$/s, with a R:FR of about 5. Other broad spectrum conditions can be, for example, continuous broad-spectrum light during the light period of a light/dark photocycle. In some cases, continuous broad spectrum light can be 16 hours of irradiance of about 15 to 55 μmol/m$^2$/s PAR$_{400-700}$, alternating with 8 hours of darkness, with a dark period of 8 hours, for example. In some cases, continuous broad spectrum light can be 12 hours of irradiance of about 15 to 55 μmol/m$^2$/s PAR$_{400-700}$, alternating with 12 hours of darkness, for example. The phenotype of a transgenic plant is assayed during maturation and/or once the plant has reached maturity.

As compared to a control plant that does not express an SD+EODFR and/or low light-tolerance polypeptide grown under SD+EODFR conditions or low light conditions, a transgenic plant expressing an SD+EODFR and/or low light-tolerance polypeptide can exhibit one or more of the following phenotypes under SD+EODFR conditions or low light conditions: decreases in extension growth, acceleration in leaf development, decreased apical dominance, increased chloroplast development, alterations in flowering and seed/fruit production, and an increase in storage organ deposition.

As compared to a control plant that does not overexpress a red specific light response pathway polypeptide grown under continuous red light or far-red light conditions, a transgenic plant overexpressing a red light specific response pathway polypeptide can exhibit decreases in hypocotyl length under continuous red light or natural daylight conditions, but has similar hypocotyl length under continuous far-red light or dark conditions.

Typically, a difference (e.g., an increase or a decrease) in a morphological feature in a transgenic plant or cell relative to a control plant or cell is considered statistically significant at p<0.05 with an appropriate parametric or non-parametric statistic, e.g., Chi-square test, Student's t-test, Mann-Whitney test, or F-test. In some embodiments, a difference in the dimensions of any individual morphological feature is statistically significant at p<0.01, p<0.005, or p<0.001. A statistically significant difference in, for example, a morphological feature in a transgenic plant compared to the corresponding morphological feature a control plant indicates that expression of the recombinant nucleic acid present in the transgenic plant confers the alteration in the morphological feature.

Examples of a decrease in extension growth include, without limitation, decreased petiole length, decreased hypocotyl length, decreased internode spacing, and decreased leaf elongation in cereals, when comparing a transgenic plant expressing an SD+EODFR and/or low light-tolerance polypeptide grown under SD+EODFR conditions or low light conditions to a control plant that does not express an SD+EODFR and/or low light-tolerance polypeptide grown under SD+EODFR conditions or low light conditions. A decrease in extension growth can be a decrease of from about 0.25% to about 90%, e.g., from about 0.25% to about 15%, from about 5% to about 50%, from about 5% to about 10%, from about 25% to about 50%, from about 1% to about 30%, from about 50% to about 90%, from about 20% to about 40%, from about 1% to about 5%, from about 0.5% to about 2%, from about 15% to about 50%, about 20%, about 25%, about 30%, about 35%, about 40%, about 45%, about 50%, about 55%, about 60%, about 65%, about 70%, about 75%, or about 80%.

One suitable phenotype to measure is hypocotyl length. When wild-type seedlings are grown under SD+EODFR conditions or low light conditions, the hypocotyl length is typically significantly increased relative to the hypocotyl length found in wild-type seedlings grown under control light conditions. Thus, seedlings of a transgenic plant and seedlings of a corresponding control plant that either lacks the transgene or does not express the transgene can be grown under SD+EODFR conditions or low light conditions and at the appropriate time, hypocotyl lengths from seedlings of each group can be measured. Under SD+EODFR conditions or low light conditions, a seedling in which the expression of an SD+EODFR and/or low light-tolerance polypeptide is increased can have a statistically significantly shorter hypocotyl length than a seedling of a corresponding control plant that either lacks the transgene or does not express the transgene. The hypocotyl length can be shorter by at least 20 percent, e.g., 20, 25, 30, 35, 40, 45, 50, 55, 60, 65, 70, 75, or 80 percent, as compared to the hypocotyl length in a corresponding control plant that does not express the transgene.

When wild-type seedlings are grown under continuous red-light conditions, the hypocotyl length is typically significantly decreased relative to the hypocotyl length found in wild-type seedlings grown under continuous far-red light conditions. Thus, seedlings of a transgenic plant and seedlings of a corresponding control plant that either lacks the transgene or does not express the transgene can be grown under continuous red-light conditions or far-red light conditions and at the appropriate time, hypocotyl lengths from seedlings of each group can be measured. Under red light conditions, a seedling in which the expression of a red light specific response pathway polypeptide is increased can have a statistically significantly shorter hypocotyl length than a seedling of a corresponding control plant that either lacks the transgene or does not express the transgene. The hypocotyl length can be shorter by at least 20 percent, e.g., 20, 25, 30, 35, 40, 45, 50, 55, 60, 65, 70, 75, or 80 percent, as compared to the hypocotyl length in a corresponding control plant that does not express the transgene. Under far-red conditions, a seedling in which the expression of a red light specific response pathway polypeptide is increased can have a hypocotyl of similar length to a corresponding control plant that either lacks the transgene or does not express the transgene.

In contrast, a seedling in which the expression of a red light specific response pathway polypeptide is decreased can have a statistically significantly longer hypocotyl length than a seedling of a corresponding control plant that either lacks the transgene or does not express the transgene. The hypocotyl length can be longer by at least 20 percent, e.g., 20, 25, 30, 35, 40, 45, 50, 55, 60, 65, 70, 75, or 80 percent, as compared to the hypocotyl length in a corresponding control plant that does not express the transgene. Under far-red conditions, a seedling in which the expression of a red light specific response pathway polypeptide is decreased can have a hypocotyl of similar length to a corresponding control plant that either lacks the transgene or does not express the transgene.

Another suitable phenotype can be overall plant height of mature plants. When wild-type plants are grown under natural light or other broad spectrum light conditions, the plant height at maturity can be significantly decreased relative to the plant height found in wild-type plants grown under low light conditions. Thus, the transgenic plant and a corresponding control plant that either lacks the transgene or does not express the transgene can be grown under natural light conditions or low light conditions and at maturity, the height of the plants from each group can be measured. Under natural light or other broad spectrum light conditions, a mature plant in which the expression of a red light specific response pathway polypeptide is decreased can have a statistically significantly taller plant than a mature plant of a corresponding control plant that either lacks the transgene or does not express the transgene. The plant height can be taller by at least 20 percent, e.g., 20, 25, 30, 35, 40, 45, 50, 55, 60, 65, 70, or 75 percent, as compared to the height in a corresponding control plant that does not express the transgene.

Another suitable phenotype can be rate of plant growth. The rate of plant growth can be determined by measuring differences in fresh weight (T/acre), or differences in subapical cell expansion, over a period of time, for example. When wild-type plants are grown under natural light or other broad spectrum light conditions, the rate of plant growth can be significantly slower relative to the rate of plant growth found in wild-type plants grown under low light conditions. Thus, the transgenic plant and a corresponding control plant that either lacks the transgene or does not express the transgene can be grown under natural light conditions or low light conditions and during maturation, the rate of plant growth for plants from each group can be measured. Under natural light or other broad spectrum light conditions, a plant in which the expression of a red light specific response pathway polypeptide is decreased can have a statistically significantly increased rate of plant growth, than a plant of a corresponding control plant that either lacks the transgene or does not express the transgene. The rate of growth can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the growth rate in a corresponding control plant that does not express the transgene. Another suitable phenotype to measure can be dry matter yield of stem parts, or above ground parts, excluding inflorescence and seed parts of a plant. When wild-type plants are grown under natural light or other broad spectrum light conditions, the dry matter yield can be significantly decreased relative to the dry matter yield found in wild-type plants grown under low light conditions. Thus, the transgenic plant and a corresponding control plant that either lacks the transgene or does not express the transgene can be grown under natural light conditions or low light conditions and at harvest, the dry matter yield of the plants from each group can be measured. Under natural light or other broad spectrum light conditions, a mature plant in which the expression of a red light specific response pathway polypeptide is decreased can have a statistically significantly greater dry matter yield than a mature plant of a corresponding control plant that either lacks the transgene or does not express the transgene. Dry matter yield (DMY) yield is calculated using the fresh matter weight (FMW) and a measurement of weight percent moisture (M) in the following equation. $DMY=((100-M)/100)* FMW$. For example, the dry matter yield can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the dry matter yield level in a corresponding control plant that does not express the transgene.

Another suitable phenotype to measure is petiole length. When wild-type seedlings are grown under SD+EODFR conditions or low light conditions, the petiole length is typically significantly increased relative to the petiole length found in wild-type seedlings grown under control light conditions. Thus, seedlings of a transgenic plant and seedlings of a corresponding control plant that either lacks the transgene or does not express the transgene can be grown under SD+EODFR conditions or low light conditions and at the appropriate time, petiole lengths from seedlings of each group can be measured. Under SD+EODFR conditions or low light conditions, a seedling in which the expression of an SD+EODFR and/or low light-tolerance polypeptide is increased can have a statistically significantly shorter petiole length than a seedling of a corresponding control plant that either lacks the transgene or does not express the transgene. The petiole length can be shorter by at least 20 percent, e.g., 20, 25, 30, 35, 40, 45, 50, 55, 60, 65, 70, or 75 percent, as compared to the petiole length in a corresponding control plant that does not express the transgene.

Examples of acceleration in leaf development include, without limitation, increased leaf thickness and increased leaf area growth when comparing a transgenic plant expressing an SD+EODFR and/or low light-tolerance polypeptide grown under SD+EODFR conditions or low light conditions to a control plant that does not express an SD+EODFR and/or low light-tolerance polypeptide grown under SD+EODFR conditions or low light conditions. Leaf thickness or leaf area growth can be increased by about 0.25% to about 200% (e.g., about 0.25% to about 2%, about 0.5% to about 5%, about 0.5% to about 15%, about 2% to about 10%, about 5% to about 35%, about 10% to about 25%, about 20% to about 80%, about 50% to about 200%, about 100% to about 200%, about 100% to about 150%, about 5%, about 10%, about 20%, about 35%, about 50%, about 70%, about 90%, about 120%, about 180%, or about 200%) in a transgenic plant expressing an SD+EODFR and/or low light-tolerance polypeptide grown under SD+EODFR conditions or low light conditions as compared to a control plant that does not express an SD+EODFR and/or low light-tolerance polypeptide grown under SD+EODFR conditions or low light conditions.

Examples of decreased apical dominance include, without limitation, increased branching and increased tillering when comparing a transgenic plant expressing an SD+EODFR and/or low light-tolerance polypeptide grown under SD+EODFR conditions or low light conditions to a control plant that does not express an SD+EODFR and/or low light-tolerance polypeptide grown under SD+EODFR conditions or low light conditions. Branching and tillering can be increased by about 0.25% to about 200% (e.g., about 0.25% to about 2%, about 0.5% to about 5%, about 0.5% to about 15%, about 2% to about 10%, about 5% to about 35%, about 10% to about 25%, about 20% to about 80%, about 50% to about 200%, about 100% to about 200%, about 100% to about 150%, about 5%, about 10%, about 20%, about 35%, about 50%, about 70%, about 90%, about 120%, about 180%, or about 200%) in a transgenic plant expressing an SD+EODFR and/or low light-tolerance polypeptide grown under SD+EODFR conditions or low light conditions as compared to a control plant that does not express an SD+EODFR and/or low light-tolerance polypeptide grown under SD+EODFR conditions or low light conditions.

Examples of increased apical dominance include, without limitation, decreased branching and decreased tillering when comparing a transgenic plant in which a red light specific response pathway polypeptide is down-regulated to a control plant that either lacks the transgene or does not express the transgene grown natural light or other broad spectrum light conditions. Branching and tillering can be decreased by about 0.25% to about 200% (e.g., about 0.25% to about 2%, about 0.5% to about 5%, about 0.5% to about 15%, about 2% to about 10%, about 5% to about 35%, about 10% to about 25%, about 20% to about 80%, about 50% to about 200%, about 100% to about 200%, about 100% to about 150%, about 5%, about 10%, about 20%, about 35%, about 50%, about 70%, about 90%, about 120%, about 180%, or about 200%) in a transgenic plant in which a red light specific response pathway polypeptide is down-regulated grown under natural light or other broad spectrum light conditions as compared to a control plant that either lacks the transgene or does not express the transgene grown natural light or other broad spectrum light conditions.

Examples of increased chloroplast development include, without limitation, increased chlorophyll synthesis and a change in the chlorophyll a:b ratio when comparing a transgenic plant expressing an SD+EODFR and/or low light-tolerance polypeptide grown under SD+EODFR conditions or low light conditions to a control plant that does not express an SD+EODFR and/or low light-tolerance polypeptide grown under SD+EODFR conditions or low light conditions. Chlorophyll synthesis and/or the chlorophyll a:b ratio can be about 0.25% to about 200% (e.g., about 0.25% to about 2%, 0.25% to about 0.5%, about 0.25% to about 1.5%, about 0.5% to about 1%, about 0.5% to about 5%, about 0.5% to about 15%, about 2% to about 10%, about 5% to about 35%, about 10% to about 25%, about 20% to about 80%, about 50% to about 200%, about 100% to about 200%, about 100% to about 150%, about 5%, about 10%, about 20%, about 35%, about 50%, about 70%, about 90%, about 120%, about 180%, or about 200%) greater in a transgenic plant expressing an SD+EODFR and/or low light-tolerance polypeptide grown under SD+EODFR conditions or low light conditions as compared to a control plant that does not express an SD+EODFR and/or low light-tolerance polypeptide grown under SD+EODFR conditions or low light conditions.

Examples of alterations in flowering and seed/fruit production include, without limitation, a decreased rate of flowering, an increase in seed set, and an increase of fruit development when comparing a transgenic plant expressing an SD+EODFR and/or low light-tolerance polypeptide grown under SD+EODFR conditions or low light conditions to a control plant that does not express an SD+EODFR and/or low light-tolerance polypeptide grown under SD+EODFR conditions or low light conditions. The rate of flowering can be a decreased from about 0.25% to about 90% (e.g., from about 0.25% to about 15%, from about 5% to about 50%, from about 5% to about 10%, from about 25% to about 50%, from about 1% to about 30%, from about 50% to about 90%, from about 20% to about 40%, from about 1% to about 5%, from about 0.5% to about 2%, from about 15% to about 50%, about 20%, about 25%, about 30%, about 35%, about 40%, about 45%, about 50%, about 55%, about 60%, about 65%, about 70%, about 75%, or about 80%) in a transgenic plant expressing an SD+EODFR and/or low light-tolerance polypeptide grown under SD+EODFR conditions or low light conditions as compared to a control plant that does not express an SD+EODFR and/or low light-tolerance polypeptide grown under SD+EODFR conditions or low light conditions. Seed or fruit weight can be increased by about 0.25% to about 200% (e.g., about 0.25% to about 2%, about 0.5% to about 5%, about 0.5% to about 15%, about 2% to about 10%, about 5% to about 35%, about 10% to about 25%, about 20% to about 80%, about 50% to about 200%, about 100% to about 200%, about 100% to about 150%, about 5%, about 10%, about 20%, about 35%, about 50%, about 70%, about 90%, about 120%, about 180%, or about 200%) in a transgenic plant expressing an SD+EODFR and/or low light-tolerance polypeptide grown under SD+EODFR conditions or low light conditions as compared to a control plant that does not express an SD+EODFR and/or low light-tolerance polypeptide grown under SD+EODFR conditions or low light conditions.

The phenotype of a transgenic plant is evaluated relative to a control plant. A plant is said "not to express" a polypeptide when the plant exhibits less than 10%, e.g., less than 9%, 8%, 7%, 6%, 5%, 4%, 3%, 2%, 1%, 0.5%, 0.1%, 0.01%, or 0.001%, of the amount of polypeptide or mRNA encoding the polypeptide exhibited by the plant of interest. Expression can be evaluated using methods including, for example, RT-PCR, Northern blots, 51 RNase protection, primer extensions, Western blots, protein gel electrophoresis, immunoprecipitation, enzyme-linked immunoassays, chip assays, and mass spectrometry. It should be noted that if a polypeptide is expressed under the control of a tissue-preferential or broadly expressing promoter, expression can be evaluated in the entire plant or in a selected tissue. Similarly, if a polypeptide is expressed at a particular time, e.g., at a particular time in development or upon induction, expression can be evaluated selectively at a desired time period.

V. Plant Breeding

Genetic polymorphisms are discrete allelic sequence differences in a population. Typically, an allele that is present at 1% or greater is considered to be a genetic polymorphism. The discovery that polypeptides disclosed herein can modulate SD+EODFR and/or low light tolerance is useful in plant breeding, because genetic polymorphisms exhibiting a degree of linkage with loci for such polypeptides are more likely to be correlated with variation in SD+EODFR and/or low light tolerance. For example, genetic polymorphisms linked to the loci for such polypeptides are more likely to be useful in marker-assisted breeding programs to create lines having SD+EODFR and/or low light tolerance.

Thus, one aspect of the invention includes methods of identifying whether one or more genetic polymorphisms are associated with variation in SD+EODFR and/or low light tolerance. Such methods involve determining whether genetic polymorphisms in a given population exhibit linkage with the locus for one of the polypeptides depicted in FIGS. 1-24 and/or a functional homolog thereof. The correlation is measured between variation in SD+EODFR and/or low light tolerance in plants of the population and the presence of the genetic polymorphism(s) in plants of the population, thereby identifying whether or not the genetic polymorphism(s) are associated with variation for the trait. If the presence of a particular allele is statistically significantly correlated with a desired modulation in SD+EODFR and/or low light tolerance, the allele is associated with variation for the trait and is useful as a marker for the trait. If, on the other hand, the presence of a particular allele is not significantly correlated with the desired modulation, the allele is not associated with variation for the trait and is not useful as a marker.

Such methods are applicable to populations containing the naturally occurring endogenous polypeptide rather than an exogenous nucleic acid encoding the polypeptide, i.e., populations that are not transgenic for the exogenous nucleic acid. It will be appreciated, however, that populations suitable for use in the methods may contain a transgene for another, different trait, e.g., herbicide resistance.

Genetic polymorphisms that are useful in such methods include simple sequence repeats (SSRs, or microsatellites), rapid amplification of polymorphic DNA (RAPDs), single nucleotide polymorphisms (SNPs), amplified fragment length polymorphisms (AFLPs) and restriction fragment length polymorphisms (RFLPs). SSR polymorphisms can be identified, for example, by making sequence specific probes and amplifying template DNA from individuals in the population of interest by PCR. If the probes flank an SSR in the population, PCR products of different sizes will be produced. See, e.g., U.S. Pat. No. 5,766,847. Alternatively, SSR polymorphisms can be identified by using PCR product(s) as a probe against Southern blots from different individuals in the population. See, U. H. Refseth et al., (1997) Electrophoresis 18: 1519. The identification of RFLPs is discussed, for example, in Alonso-Blanco et al. (Methods in Molecular Biology, vol. 82, "*Arabidopsis* Protocols", pp. 137-146, J. M. Martinez-Zapater and J. Salinas, eds., c. 1998 by Humana Press, Totowa, N.J.); Burr ("Mapping Genes with Recombinant Inbreds", pp. 249-254, in Freeling, M. and V. Walbot (Ed.), The Maize Handbook, c. 1994 by Springer-Verlag New York, Inc.: New York, N.Y., USA; Berlin Germany; Burr et al. Genetics (1998) 118: 519; and Gardiner, J. et al., (1993) Genetics 134: 917). The identification of AFLPs is discussed, for example, in EP 0 534 858 and U.S. Pat. No. 5,878,215.

In some embodiments, the methods are directed to breeding a plant line. Such methods use genetic polymorphisms identified as described above in a marker assisted breeding program to facilitate the development of lines that have a desired alteration in SD+EODFR and/or low light tolerance. Once a suitable genetic polymorphism is identified as being associated with variation for the trait, one or more individual plants are identified that possess the polymorphic allele correlated with the desired variation. Those plants are then used in a breeding program to combine the polymorphic allele with a plurality of other alleles at other loci that are correlated with the desired variation. Techniques suitable for use in a plant breeding program are known in the art and include, without limitation, backcrossing, mass selection, pedigree breeding, bulk selection, crossing to another population and recurrent selection. These techniques can be used alone or in combination with one or more other techniques in a breeding program. Thus, each identified plants is selfed or crossed a different plant to produce seed which is then germinated to form progeny plants. At least one such progeny plant is then selfed or crossed with a different plant to form a subsequent progeny generation. The breeding program can repeat the steps of selfing or outcrossing for an additional 0 to 5 generations as appropriate in order to achieve the desired uniformity and stability in the resulting plant line, which retains the polymorphic allele. In most breeding programs, analysis for the particular polymorphic allele will be carried out in each generation, although analysis can be carried out in alternate generations if desired.

In some cases, selection for other useful traits is also carried out, e.g., selection for fungal resistance or bacterial resistance. Selection for such other traits can be carried out before, during or after identification of individual plants that possess the desired polymorphic allele.

VI. Articles of Manufacture

Transgenic plants provided herein have various uses in the agricultural and energy production industries. For example, transgenic plants described herein can be used to make animal feed and food products. Such plants, however, are often particularly useful as a feedstock for energy production.

Transgenic plants described herein often produce higher yields of grain and/or biomass per hectare, relative to control plants that lack the exogenous nucleic acid. In some embodiments, such transgenic plants provide equivalent or even increased yields of grain and/or biomass per hectare relative to control plants when grown under conditions of low light conditions and/or SD+EODFR conditions. Thus, such transgenic plants can be used to provide yield stability under environmentally stressful conditions such as low light conditions and/or SD+EODFR conditions. By providing higher yields under environmentally stressful conditions such as low light conditions and/or SD+EODFR conditions, the transgenic plants described herein improve profitability for farmers and processors as well as decrease costs to consumers.

Seeds from transgenic plants described herein can be conditioned and bagged in packaging material by means known in the art to form an article of manufacture. Packaging material such as paper and cloth are well known in the art. A package of seed can have a label, e.g., a tag or label secured to the packaging material, a label printed on the packaging material, or a label inserted within the package, that describes the nature of the seeds therein.

VII. Other Polypeptides, Nucleic Acids, Plant Cells, Plants, and Methods

In some cases, this document provides methods and materials involved in plant UV-B tolerance. For example, this document provides seeds and plants having cells comprising an exogenous nucleic acid encoding a polypeptide having UV-B tolerance activity as described in U.S. Patent Application Publication No. 2010-0192261 (U.S. patent application Ser. No. 12/373,134), which is incorporated by reference herein in its entirety. In some cases, a plant can include a polypeptide or nucleic acid or can be made to include a polypeptide or nucleic acid such that the sequence of such a polypeptide or nucleic acid is as set forth in one of the identified sequences of U.S. Patent Application Publication No. 2010-0192261 (U.S. patent application Ser. No. 12/373,134) (e.g., SEQ ID NOs:1-119 of U.S. Patent Application Publication No. 2010-0192261 (U.S. patent application Ser. No. 12/373,134)), or is a homolog or ortholog thereof as described in U.S. Patent Application Publication No. 2010-0192261 (U.S. patent application Ser. No. 12/373,134), or has at least 80% sequence identity (e.g., at least 80%, 85%, 90%, 95%, 97%, 98%, or 99% sequence identity) to an identified sequence of U.S. Patent Application Publication No. 2010-0192261 (U.S. patent application Ser. No. 12/373,134), as set forth in U.S. Patent Application Publication No. 2010-0192261 (U.S. patent application Ser. No. 12/373,134). SEQ ID NOs:1-119 of U.S. Patent Application Publication No. 2010-0192261 (U.S. patent application Ser. No. 12/373,134), together with the identified activities for each of SEQ ID NOs:1-119, the described homologs and orthologs of SEQ ID NOs:1-119 and their associated activities, the sequences having at least 80% sequence identity (e.g., at least 80%, 85%, 90%, 95%, 97%, 98%, or 99% sequence identity) to SEQ ID NOs:1-119 and their associated activities, the phenotypes of plants containing any one of SEQ ID NOs:1-119 or the described homologs of SEQ ID NOs:1-119 or the described orthologs of SEQ ID NOs:1-119 or the described sequences having at least 80% sequence identity to any one of SEQ ID NOs:1-119, and the working examples and data set forth in Examples 1-6 of U.S. Patent Application Publication No. 2010-0192261 (U.S. patent application Ser. No. 12/373,134) are incorporated by reference herein.

In some cases, this document provides methods and materials involved in tolerance of plants to low light conditions. For example, this document provides transgenic plants and seeds comprising nucleic acids encoding polypeptides that confer tolerance to conditions of low light irradiance as described in U.S. Patent Application Publication No. 2010-0205688 (U.S. patent application Ser. No. 14/513,086), which is incorporated by reference herein in its entirety. In some cases, a plant can include a polypeptide or nucleic acid or can be made to include a polypeptide or nucleic acid such that the sequence of such a polypeptide or nucleic acid is as set forth in one of the identified sequences of U.S. Patent Application Publication No. 2010-0205688 (U.S. patent application Ser. No. 14/513,086) (e.g., SEQ ID NOs:1-149 of U.S. Patent Application Publication No. 2010-0205688 (U.S. patent application Ser. No. 12/513,086)), or is a homolog or ortholog thereof as described in U.S. Patent Application Publication No. 2010-0205688 (U.S. patent application Ser. No. 12/513,086), or has at least 80% sequence identity (e.g., at least 80%, 85%, 90%, 95%, 97%, 98%, or 99% sequence identity) to an identified sequence of U.S. Patent Application Publication No. 2010-0205688 (U.S. patent application Ser. No. 12/513,086), as set forth in U.S. Patent Application Publication No. 2010-0205688 (U.S. patent application Ser. No. 12/513,086). SEQ ID NOs:1-149 of U.S. Patent Application Publication No. 2010-0205688 (U.S. patent application Ser. No. 12/513,086), together with the identified activities for each of SEQ ID NOs:1-149, the described homologs and orthologs of SEQ ID NOs:1-149 and their associated activities, the sequences having at least 80% sequence identity (e.g., at least 80%, 85%, 90%, 95%, 97%, 98%, or 99% sequence identity) to SEQ ID NOs:1-149 and their associated activities, the phenotypes of plants containing any one of SEQ ID NOs:1-149 or the described homologs of SEQ ID NOs:1-149 or the described orthologs of SEQ ID NOs:1-149 or the described sequences having at least 80% sequence identity to any one of SEQ ID NOs:1-149, and the working examples and data set forth in Examples 1-8 of U.S. Patent Application Publication No. 2010-0205688 (U.S. patent application Ser. No. 14/513,086) are incorporated by reference herein.

In some cases, this document provides methods and materials involved in shade tolerance in plants. For example, this document provides plants having increased shade tolerance as well as materials and methods for making plants having increased shade tolerance and plant products derived from plants having increased shade tolerance as described in U.S. Patent Application Publication No. 2010-0199378 (U.S. patent application Ser. No. 12/515,687), which is incorporated by reference herein in its entirety. In some cases, a plant can include a polypeptide or nucleic acid or can be made to include a polypeptide or nucleic acid such that the sequence of such a polypeptide or nucleic acid is as set forth in one of the identified sequences of U.S. Patent Application Publication No. 2010-0199378 (U.S. patent application Ser. No. 12/515,687) (e.g., SEQ ID NOs:1-171 of U.S. Patent Application Publication No. 2010-0199378 (U.S. patent application Ser. No. 14/515,687)), or is a homolog or ortholog thereof as described in U.S. Patent Application Publication No. 2010-0199378 (U.S. patent application Ser. No. 14/515,687), or has at least 80% sequence identity (e.g., at least 80%, 85%, 90%, 95%, 97%, 98%, or 99% sequence identity) to an identified sequence of U.S. Patent Application Publication No. 2010-0199378 (U.S. patent application Ser. No. 12/515,687), as set forth in U.S. Patent Application Publication No. 2010-0199378 (U.S. patent application Ser. No. 12/515,687). SEQ ID NOs:1-171 of U.S. Patent Application Publication No. 2010-0199378 (U.S. patent application Ser. No. 14/515,687), together with the identified activities for each of SEQ ID NOs:1-171, the described homologs and orthologs of SEQ ID NOs:1-171 and their associated activities, the sequences having at least 80% sequence identity (e.g., at least 80%, 85%, 90%, 95%, 97%, 98%, or 99% sequence identity) to SEQ ID NOs:1-171 and their associated activities, the phenotypes of plants containing any one of SEQ ID NOs:1-171 or the described homologs of SEQ ID NOs:1-171 or the described orthologs of SEQ ID NOs:1-171 or the described sequences having at least 80% sequence identity to any one of SEQ ID NOs:1-171, and the working examples and data set forth in Examples 1-11 of U.S. Patent Application Publication No. 2010-0199378 (U.S. patent application Ser. No. 14/515,687) are incorporated by reference herein.

In some cases, this document provides methods and materials involved in tolerance of plants to low light conditions. For example, this document provides transgenic plants and seeds comprising nucleic acids encoding polypeptides that confer tolerance to conditions of low light irradiance as described in U.S. Patent Application Publication No. 2010-0119688 (U.S. patent application Ser. No. 12/307,561), which is incorporated by reference herein in its entirety. In some cases, a plant can include a polypeptide or nucleic acid or can be made to include a polypeptide or nucleic acid such that the sequence of such a polypeptide or nucleic acid is as set forth in one of the identified sequences of U.S. Patent Application Publication No. 2010-0119688 (U.S. patent application Ser. No. 12/307,561) (e.g., SEQ ID NOs:1-146 of U.S. Patent Application Publication No. 2010-0119688 (U.S. patent application Ser. No. 12/307,561)), or is a homolog or ortholog thereof as described in U.S. Patent Application Publication No. 2010-0119688 (U.S. patent application Ser. No. 12/307,561), or has at least 80% sequence identity (e.g., at least 80%, 85%, 90%, 95%, 97%, 98%, or 99% sequence identity) to an identified sequence of U.S. Patent Application Publication No. 2010-0119688 (U.S. patent application Ser. No. 12/307,561), as set forth in U.S. Patent Application Publication No. 2010-0119688 (U.S. patent application Ser. No. 12/307,561). SEQ ID NOs:1-146 of U.S. Patent Application Publication No. 2010-0119688 (U.S. patent application Ser. No. 12/307,561), together with the identified activities for each of SEQ ID NOs:1-146, the described homologs and orthologs of SEQ ID NOs:1-146 and their associated activities, the sequences having at least 80% sequence identity (e.g., at least 80%, 85%, 90%, 95%, 97%, 98%, or 99% sequence identity) to SEQ ID NOs:1-146 and their associated activities, the phenotypes of plants containing any one of SEQ ID NOs: 1-146 or the described homologs of SEQ ID NOs:1-146 or the described orthologs of SEQ ID NOs:1-146 or the described sequences having at least 80% sequence identity to any one of SEQ ID NOs:1-146, and the working examples and data set forth in Examples 1-22 of U.S. Patent Application Publication No. 2010-0119688 (U.S. patent application Ser. No. 12/307,561) are incorporated by reference herein.

In some cases, this document provides methods and materials involved in modulating biomass levels in plants. For example, this document provides plants having increased biomass levels as well as materials and methods for making plants and plant products having increased biomass levels as described in International Patent Application Publication No. WO 2010/033564 and U.S. patent application Ser. No. 13/119,572, which are incorporated by reference herein in their entireties. In some cases, a plant can include a polypeptide or nucleic acid or can be made to include a polypeptide or nucleic acid such that the sequence of such a polypeptide or nucleic acid is as set forth in one of the identified sequences of International Patent Application Publication No. WO 2010/033564 and U.S. patent application Ser. No. 13/119,572 (e.g., SEQ ID NOs:1-638 of International Patent Application Publication No. WO 2010/033564 and U.S. patent application Ser. No. 13/119,572), or is a homolog or ortholog thereof as described in International Patent Application Publication No. WO 2010/033564 and U.S. patent application Ser. No. 13/119,572, or has at least 80% sequence identity (e.g., at least 80%, 85%, 90%, 95%, 97%, 98%, or 99% sequence identity) to an identified sequence of International Patent Application Publication No. WO 2010/033564 and U.S. patent application Ser. No. 13/119,572, as set forth in International Patent Application Publication No. WO 2010/033564 and U.S. patent application Ser. No. 13/119,572. SEQ ID NOs:1-638 of International Patent Application Publication No. WO 2010/033564 and U.S. patent application Ser. No. 13/119,572, together with the identified activities for each of SEQ ID NOs:1-638, the described homologs and orthologs of SEQ ID NOs:1-638 and their associated activities, the sequences having at least 80% sequence identity (e.g., at least 80%, 85%, 90%, 95%, 97%, 98%, or 99% sequence identity) to SEQ ID NOs:1-638 and their associated activities, the phenotypes of plants containing any one of SEQ ID NOs:1-638 or the described homologs of SEQ ID NOs:1-638 or the described orthologs of SEQ ID NOs:1-638 or the described sequences having at least 80% sequence identity to any one of SEQ ID NOs:1-638, and the working examples and data set forth in Examples 1-11 of International Patent Application Publication No. WO 2010/033564 and U.S. patent application Ser. No. 13/119,572 are incorporated by reference herein.

The invention will be further described in the following examples, which do not limit the scope of the invention described in the claims.

VIII. Examples

Example 1—Transgenic *Arabidopsis* Plants

The following symbols are used in the Examples with respect to *Arabidopsis* transformation: $T_1$: first generation transformant; $T_2$: second generation, progeny of self-pollinated $T_1$ plants; $T_3$: third generation, progeny of self-pollinated $T_2$ plants; $T_4$: fourth generation, progeny of self-pollinated $T_3$ plants. Independent transformations are referred to as events.

Nucleic acids were isolated from *Arabidopsis thaliana* plants, and cloned into a Ti plasmid vector, CRS338 or CRS 811, under the control of a 35S promoter. Each construct contained a phosphinothricin acetyltransferase gene which confers Finale™ resistance to transformed plants. Wild-type *Arabidopsis thaliana* ecotype Wassilewskija (Ws) plants were transformed separately with each construct. The transformations were performed essentially as described in Bechtold et al., *C.R. Acad. Sci. Paris*, 316:1194-1199 (1993).

Transgenic *Arabidopsis* lines containing SEQ ID NO:1, SEQ ID NO:69, SEQ ID NO:127, SEQ ID NO:315, SEQ ID NO:335, SEQ ID NO:454, SEQ ID NO:537, SEQ ID NO:568, SEQ ID NO:604, SEQ ID NO:632, SEQ ID NO:642, SEQ ID NO:848, SEQ ID NO:905, SEQ ID NO:951, SEQ ID NO:1023, SEQ ID NO:1045, SEQ ID NO:1150, SEQ ID NO:1276, SEQ ID NO:1345, SEQ ID NO:1456, SEQ ID NO:1496, SEQ ID NO:1539, SEQ ID NO:1586, SEQ ID NO:1629, or SEQ ID NO:1634 were designated, ME05268, ME06120, ME09503, ME10007, ME10852, ME11939, ME12006, ME12596, ME12899, ME13456, ME15935, ME16594, ME16597, ME16630, ME17128, ME17578, ME18158, ME18314, ME18408, ME19304, ME19738, ME19971, ME20871, ME21199, or ME21508, respectively. The presence of each vector containing a nucleic acid described above in the respective transgenic *Arabidopsis* line transformed with the vector was confirmed by Finale™ resistance, PCR amplification from green leaf tissue extract, and/or sequencing of PCR products.

Example 2—Identification of Transgenic Plants Tolerant to Low Light Conditions

Wild-type and transgenic seeds were sterilized, plated on solid 0.5×MS medium containing 5 g/L sucrose, and stratified at 4° C. in the dark for three days. After stratification, plates containing the seeds were allowed to reach room temperature. The plates were then transferred to a Conviron walk-in growth chamber (Controlled Environments Inc., Pambina, N. Dak.) at 22° C. and 70% humidity with a 16:8 hour light:dark cycle. Lighting was supplied by 32 watt fluorescent bulbs (Sylvania, F032/841/ECO, Danvers, Mass.), providing a red:far-red ratio of 13:1. The plates were covered with three layers of shade cloth (New York wire, charcoal fiberglass screen, 857650; Home Depot, Atlanta, Ga.) such that the irradiance was about 10 µmol/m²/s. The plates were rotated daily and monitored for changes in hypocotyl elongation. After 48 hours, the plates were scored for late germinators, which were eliminated from consideration as candidate plants having reduced hypocotyl elongation under low light conditions. Each seedling was transplanted to an 8×8 cm well of a flat containing a total of 18 wells (three wells by six wells) and measuring 24 cm by 48 cm in size.

Seedlings maintained under conditions of irradiance with about 10 µmol/m$^2$/s of light for seven days at 22° C. were analyzed for hypocotyl length. The hypocotyls of individual seedlings were determined to be "long" or "short" based on qualitative observation (see, for example, FIG. 28).

Example 3—Identification of Transgenic Plants Tolerant to Short Day Plus End-of-Day-Far-Red (SD+EODFR) Conditions A Short Day plus End-of-Day-Far-Red (SD+EODFR) assay was carried out on seedlings in order to evaluate the effect of SD+EODFR conditions on hypocotyl length. For the SD+EODFR assay, seeds were plated on 0.5% sucrose, 1×MS media (PhytoTech) agar plates, cold-treated for 3-4 days at 4° C., then germinated for 2 days under continuous white light at about 60 µmol/m$^2$/s in walk-in Conviron growth chambers. Seedlings were then exposed to SD+EODFR conditions for 4 days. SD+EODFR conditions were 9.5 hours light, followed by a 30 minute pulse of far-red light at the end of each light cycle, alternating with 14 hours of darkness. Two Gro-Lux (Sylvania, 24660) and two Cool White (Phillips) lights at about 60 µmol/m$^2$ PPFD, with a red:far-red ratio of about 5.5, were used for the light cycle; the fluence rates under these conditions were: blue$_{450}$=12 µmol/m$^2$/s, red$_{633}$=22 µmol/m$^2$/s, far-red$_{740}$=4 µmol/m$^2$/s, PPFD$_{400-700}$=55 µmol/m$^2$/s. The far-red pulse was generated by 3 SNAP-LITE Far-red light boxes (Quantum devices, SL1515-670-735) at about 8 µmol/m$^2$/s PPFD, with a red:far-red ratio of about 0.14; the fluence rates under these conditions were: blue$_{450}$=0.004 µmol/m$^2$/s, red$_{633}$=10 µmol/m$^2$/s, far-red$_{740}$=70 µmol/m$^2$/s, PPFD$_{400-700}$=8 µmol/m$^2$/s. Control seedlings were cultured exactly as above except that they did not receive the far-red pulse; that is, following germination, they were exposed for two days to a cycle of 10 hours of light alternating with 14 hours of darkness under 2 Gro-Lux and 2 Cool white lights at about 60 µmol/m$^2$/s PPFD, with a red:far-red ratio of about 5.5. Plates were rotated on the third day after plating and hypocotyl length was characterized on the fourth day after plating. The hypocotyls of individual seedlings were determined to be "long" or "short" based on qualitative observation (see, for example, FIG. 28).

Seedlings were then sprayed with sterile Finale® (concentration=0.63%), on two subsequent days, then allowed to grow for 24 hours before chlorophyll fluorescence imaging was done to determine the Finale® resistant:Finale® sensitive ratio. Finale® sensitivity was determined by placing plates of Finale® treated seedlings in a chlorophyll fluorescence imager (CF Imager, Technologica Limited, UK). Finale® resistant seedlings appeared red and Finale® sensitive seedlings appeared blue. Hypocotyl lengths from Finale® resistant seedlings and Finale® sensitive seedlings were then subjected to a Chi-squared analysis to determine statistical significance.

Example 4—Results for ME05268, ME06120, ME09503, ME10007, ME10852, ME11939, ME13456, ME15935, ME16594, ME16597, ME16630, ME17128, ME17578, ME18158, ME18314, ME19304, ME19738, ME20871, ME21199, and ME21508 Events T$_3$ and T$_4$ seed from event -03 of ME05268, T$_2$ and T$_3$ seed from event -04 of ME05268, T$_2$ and T$_3$ seed from events -11 and -12 of ME06120, T$_2$ and T$_3$ seed from events -03 and -07 of ME09503, T$_2$ and T$_3$ seed from events -02 and -05 of ME10007, T$_2$ and T$_3$ seed from events -03 and -04 of ME10852, T$_2$ and T$_3$ seed from events -01, -02, and -03 of ME11939, T$_2$ and T$_3$ seed from events -02 and -05 of ME13456, T$_2$ and T$_3$ seed from events -03 and -04 of ME15935, T$_3$ and T$_4$ seed from events -02 and -05 of ME16594, T$_2$ and T$_3$ seed from events -01, -04, and -06 of ME16597, T$_2$ and T$_3$ seed from events -01, -02, and -04 of ME16630, T$_2$ and T$_3$ seed from events -02, -03, and -03 of ME17128, T$_2$ and T$_3$ seed from events -01 and -03 of ME17578, T$_2$ and T$_3$ seed from events -01, -03, and -04 of ME18158, T$_2$ and T$_3$ seed from events -01, -02, -03, and -04 of ME18314, T$_2$ and T$_3$ seed from events -07 and -08 of ME19304, T$_2$ and T$_3$ seed from events -02 and -05 of ME19738, T$_2$ and T$_3$ seed from events -03, -05, and -10 of ME20871, T$_2$ and T$_3$ seed from events -01, -03 and -05 of ME21199, T$_2$ and T$_3$ seed from events -01 and -05 of ME21508 was grown under low light conditions and evaluated for hypocotyl length as described in Example 2.

A Chi-square test was performed to compare transgenic seedlings and corresponding non-transgenic segregants having a short or a long hypocotyl. A hypocotyl having a length similar to the hypocotyl length typically exhibited by wild-type *Arabidopsis* seedlings grown under normal light conditions (e.g., about 100 µmol/m$^2$/s of white light) was considered a short hypocotyl, whereas a hypocotyl having a length similar to that typically exhibited by wild-type *Arabidopsis* seedlings grown under low light conditions (e.g., about 10 µmol/m$^2$/s of white light) was considered a long hypocotyl. Wild-type *Arabidopsis* seeds grown for seven days at 22° C. under conditions of irradiance with about 100 µmol/m$^2$/s of white light and a 16:8 hour light:dark cycle typically form hypocotyls that are about 1-3 mm in length. Under conditions of irradiance with about 10 µmol/m$^2$/s of white light, the hypocotyls typically are about 5-7 mm in length.

Seedlings from event -03 of ME05268; event -04 of ME05268; events -11 and -12 of ME06120; events -03 and -07 of ME09503; events -02 and -05 of ME10007; events -03 and -04 of ME10852; events -01, -02, and -03 of ME11939; events -02 and -05 of ME13456; events -03 and -04 of ME15935; events -02 and -05 of ME16594; events -01, -04, and -06 of ME16597; events -01, -02, and -04 of ME16630; events -02, -03, and -03 of ME17128; events -01 and -03 of ME17578; events -01, -03, and -04 of ME18158; events -01, -02, -03, and -04 of ME18314; events -07 and -08 of ME19304; events -02 and -05 of ME19738; events -03, -05, and -10 of ME20871; events -01, -03 and -05 of ME21199; and events -01 and -05 of ME21508 displayed a short hypocotyl under low light conditions in both the T$_2$ and T$_3$ generations, and the transgene was linked to the short hypocotyl phenotype with a confidence level of $p<0.05$ (Tables 1-23).

T$_3$ or T$_4$ data designated with -99 are data obtained from seed pooled from multiple individual plants of the indicated generation and event.

TABLE 1

Hypocotyl length in seedlings from ME05268

| Plants | Short Hypo-cotyl | Long Hypo-cotyl | Chi-Square | p-value |
|---|---|---|---|---|
| T$_3$ seedlings from event -03-99 of ME05268 | 32 | 6 | 54.35 | 1.68E−13 |
| T$_3$ non-transgenic segregants of event -03-99 of ME05268 | 0 | 37 | | |
| T$_4$ seedlings from event -03-99-99 of ME05268 | 69 | 3 | 53.00 | 1.68E−13 |

TABLE 1-continued

Hypocotyl length in seedlings from ME05268

| Plants | Short Hypo-cotyl | Long Hypo-cotyl | Chi-Square | p-value |
|---|---|---|---|---|
| $T_4$ non-transgenic segregants of event -03-99-99 of ME05268 | 0 | 7 | | |
| $T_2$ seedlings from event -04 of ME05268 | 55 | 9 | 17.98 | 2.23E−05 |
| $T_2$ non-transgenic segregants of event -04 of ME05268 | 0 | 4 | | |
| $T_3$ seedlings from event -04-99 of ME05268 | 52 | 8 | 40.81 | 1.68E−10 |
| $T_3$ non-transgenic segregants of event -04-99 of ME05268 | 0 | 14 | | |

TABLE 2

Hypocotyl length in seedlings from ME06120

| Plants | Short Hypo-cotyl | Long Hypo-cotyl | Chi-Square | p-value |
|---|---|---|---|---|
| $T_2$ seedlings from event -11 of ME06120 | 26 | 4 | 16.89 | 3.96E−05 |
| $T_2$ non-transgenic segregants of event -11 of ME05268 | 1 | 7 | | |
| $T_3$ seedlings from event -11-99 of ME06120 | 52 | 3 | 37.89 | 7.48E−10 |
| $T_3$ non-transgenic segregants of event -11-99 of ME06120 | 4 | 13 | | |
| $T_2$ seedlings from event -12 of ME06120 | 27 | 2 | 14.43 | 1.45E−04 |
| $T_2$ non-transgenic segregants of event -12 of ME06120 | 0 | 2 | | |
| $T_3$ seedlings from event -12-99 of ME ME06120 | 46 | 0 | 39.93 | 2.63E−10 |
| $T_3$ non-transgenic segregants of event -12-99 of ME ME06120 | 1 | 4 | | |

TABLE 3

Hypocotyl length in seedlings from ME09503

| Plants | Short Hypo-cotyl | Long Hypo-cotyl | Chi-Square | p-value |
|---|---|---|---|---|
| $T_2$ seedlings from event -03 of ME09503 | 34 | 4 | 35.47 | 2.59E−09 |
| $T_2$ non-transgenic segregants of event -03 of ME09503 | 1 | 16 | | |
| $T_3$ seedlings from event -03-99 of ME09503 | 55 | 0 | 68.85 | 1.06E−16 |
| $T_3$ non-transgenic segregants of event -03-99 of ME09503 | 1 | 18 | | |
| $T_2$ seedlings from event -07 of ME09503 | 46 | 1 | 44.94 | 2.03E−11 |
| $T_2$ non-transgenic segregants of event -07 of ME09503 | 2 | 12 | | |
| $T_3$ seedlings from event -07-99 of ME09503 | 72 | 1 | 56.91 | 4.56E−14 |
| $T_3$ non-transgenic segregants of event -07-99 of ME09503 | 1 | 6 | | |

TABLE 4

Hypocotyl length in seedlings from ME10007

| Plants | Short Hypo-cotyl | Long Hypo-cotyl | Chi-Square | p-value |
|---|---|---|---|---|
| $T_2$ seedlings from event -02 of ME10007 | 57 | 3 | 42.15 | 8.45E−11 |
| $T_2$ non-transgenic segregants of event -02 of ME10007 | 5 | 15 | | |
| $T_3$ seedlings from event -02-99 of ME10007 | 50 | 8 | 40.30 | 2.18E−10 |
| $T_3$ non-transgenic segregants of event -02-99 of ME10007 | 2 | 19 | | |
| $T_2$ seedlings from event -05 of ME10007 | 58 | 0 | 37.14 | 1.10E−09 |
| $T_2$ non-transgenic segregants of event -05 of ME10007 | 9 | 11 | | |
| $T_3$ seedlings from event -05-99 of ME10007 | 49 | 6 | 39.36 | 3.53E−10 |
| $T_3$ non-transgenic segregants of event -05-99 of ME10007 | 3 | 18 | | |

TABLE 5

Hypocotyl length in seedlings from ME10852

| Plants | Short Hypo-cotyl | Long Hypo-cotyl | Chi-Square | p-value |
|---|---|---|---|---|
| $T_2$ seedlings from event -03 of ME10852 | 57 | 1 | 48.97 | 2.59E−12 |
| $T_2$ non-transgenic segregants of event -03 of ME10852 | 5 | 15 | | |
| $T_3$ seedlings from event -03-99 of ME10852 | 55 | 0 | 35.66 | 2.59E−09 |
| $T_3$ non-transgenic segregants of event -03-99 of ME10852 | 11 | 13 | | |
| $T_2$ seedlings from event -04 of ME10852 | 57 | 0 | 71.00 | 3.57E−17 |
| $T_2$ non-transgenic segregants of event -04 of ME10852 | 0 | 14 | | |
| $T_3$ seedlings from event -04-99 of ME10852 | 63 | 3 | 57.75 | 2.97E−14 |
| $T_3$ non-transgenic segregants of event -04-99 of ME10852 | 0 | 11 | | |

TABLE 6

Hypocotyl length in seedlings from ME11939

| Plants | Short Hypo-cotyl | Long Hypo-cotyl | Chi-Square | p-value |
|---|---|---|---|---|
| $T_2$ seedlings from event -01 of ME13 | 32 | 6 | 29.39 | 5.93E−08 |
| $T_2$ non-transgenic segregants of event -01 of ME11939 | 0 | 13 | | |
| $T_3$ seedlings from event -01-99 of ME11939 | 47 | 0 | 52.88 | 3.55E−13 |
| $T_3$ non-transgenic segregants of event -01-99 of ME11939 | 2 | 14 | | |
| $T_2$ seedlings from event -02 of ME11939 | 42 | 5 | 23.34 | 1.35E−06 |
| $T_2$ non-transgenic segregants of event -02 of ME11939 | 4 | 11 | | |
| $T_3$ seedlings from event -02-99 of ME11939 | 46 | 2 | 44.94 | 2.03E−11 |
| $T_3$ non-transgenic segregants of event -02-99 of ME11939 | 1 | 12 | | |
| $T_2$ seedlings from event -05 of ME11939 | 45 | 8 | 27.72 | 1.40E−07 |
| $T_2$ non-transgenic segregants of event -05 of ME11939 | 4 | 16 | | |

TABLE 6-continued

Hypocotyl length in seedlings from ME11939

| Plants | Short Hypocotyl | Long Hypocotyl | Chi-Square | p-value |
|---|---|---|---|---|
| $T_3$ seedlings from event -05-99 of ME11939 | 33 | 0 | 27.59 | 1.50E−07 |
| $T_3$ non-transgenic segregants of event -05-99 of ME11939 | 3 | 7 | | |

TABLE 7

Hypocotyl length in seedlings from ME13456

| Plants | Short Hypocotyl | Long Hypocotyl | Chi-Square | p-value |
|---|---|---|---|---|
| $T_2$ seedlings from event -02 of ME13456 | 18 | 1 | 12.28 | 4.58E−04 |
| $T_2$ non-transgenic segregants of event -02 of ME13456 | 3 | 6 | | |
| $T_3$ seedlings from event -02-99 of ME13456 | 47 | 3 | 34.55 | 4.16E−09 |
| $T_3$ non-transgenic segregants of event -02-99 of ME13456 | 1 | 8 | | |
| $T_2$ seedlings from event -05 of ME13456 | 14 | 2 | 13.13 | 2.91E−04 |
| $T_2$ non-transgenic segregants of event -05 of ME13456 | 0 | 5 | | |
| $T_3$ seedlings from event -05-99 of ME13456 | 21 | 3 | 23.42 | 1.30E−06 |
| $T_3$ non-transgenic segregants of event -05-99 of ME13456 | 1 | 13 | | |

TABLE 8

Hypocotyl length in seedlings from ME15935

| Plants | Short Hypocotyl | Long Hypocotyl | Chi-Square | p-value |
|---|---|---|---|---|
| $T_2$ seedlings from event -03 of ME15935 | 44 | 2 | 33.90 | 5.81E−09 |
| $T_2$ non-transgenic segregants of event -03 of ME15935 | 2 | 12 | | |
| $T_3$ seedlings from event -03-99 of ME15935 | 53 | 3 | 51.86 | 5.97E−13 |
| $T_3$ non-transgenic segregants of event -03-99 of ME15935 | 1 | 15 | | |
| $T_2$ seedlings from event -04 of ME15935 | 23 | 0 | 33.00 | 9.22E−09 |
| $T_2$ non-transgenic segregants of event -04 of ME15935 | 0 | 10 | | |
| $T_3$ seedlings from event -04-99 of ME15935 | 58 | 0 | 41.24 | 1.34E−10 |
| $T_3$ non-transgenic segregants of event -04-99 of ME15935 | 2 | 4 | | |

TABLE 9

Hypocotyl length in seedlings from ME16594

| Plants | Short Hypocotyl | Long Hypocotyl | Chi-Square | p-value |
|---|---|---|---|---|
| $T_2$ seedlings from event -02 of ME16594 | 16 | 0 | 37.14 | 1.10E−09 |
| $T_2$ non-transgenic segregants of event -02 of ME16594 | 12 | 52 | | |

TABLE 9-continued

Hypocotyl length in seedlings from ME16594

| Plants | Short Hypocotyl | Long Hypocotyl | Chi-Square | p-value |
|---|---|---|---|---|
| $T_3$ seedlings from event -02-99 of ME16594 | 46 | 10 | 10.18 | 1.42E−03 |
| $T_3$ non-transgenic segregants of event -02-99 of ME16594 | 4 | 7 | | |
| $T_2$ seedlings from event -05 of ME16594 | 35 | 2 | 52.10 | 5.28E−13 |
| $T_2$ non-transgenic segregants of event -05 of ME16594 | 4 | 33 | | |
| $T_3$ seedlings from event -05-99 of ME16594 | 41 | 11 | 5.14 | 2.34E−02 |
| $T_3$ non-transgenic segregants of event -05-99 of ME16594 | 5 | 6 | | |

TABLE 10

Hypocotyl length in seedlings from ME16597

| Plants | Short Hypocotyl | Long Hypocotyl | Chi-Square | p-value |
|---|---|---|---|---|
| $T_2$ seedlings from event -01 of ME16597 | 18 | 6 | 16.99 | 3.77E−05 |
| $T_2$ non-transgenic segregants of event -01 of ME16597 | 0 | 11 | | |
| $T_3$ seedlings from event -01-99 of ME16597 | 69 | 3 | 55.76 | 8.20E−04 |
| $T_3$ non-transgenic segregants of event -01-99 of ME16597 | 0 | 8 | | |
| $T_2$ seedlings from event -04 of ME16597 | 25 | 3 | 21.88 | 2.91E−06 |
| $T_2$ non-transgenic segregants of event -04 of ME16597 | 0 | 7 | | |
| $T_3$ seedlings from event -04-99 of ME16597 | 54 | 5 | 32.49 | 1.20E−08 |
| $T_3$ non-transgenic segregants of event -04-99 of ME16597 | 3 | 11 | | |
| $T_2$ seedlings from event -04 of ME16597 | 44 | 5 | 34.14 | 5.12E−09 |
| $T_2$ non-transgenic segregants of event -04 of ME16597 | 4 | 17 | | |
| $T_3$ seedlings from event -04-99 of ME16597 | 49 | 4 | 43.99 | 3.30E−11 |
| $T_3$ non-transgenic segregants of event -04-99 of ME16597 | 3 | 18 | | |

TABLE 11

Hypocotyl length in seedlings from ME16630

| Plants | Short Hypocotyl | Long Hypocotyl | Chi-Square | p-value |
|---|---|---|---|---|
| $T_2$ seedlings from event -01 of ME16630 | 49 | 7 | 49.26 | 2.24E−12 |
| $T_2$ non-transgenic segregants of event -01 of ME16630 | 0 | 20 | | |
| $T_3$ seedlings from event -01-99 of ME16630 | 59 | 1 | 55.63 | 8.75E−14 |
| $T_3$ non-transgenic segregants of event -01-99 of ME16630 | 0 | 6 | | |
| $T_2$ seedlings from event -02 of ME16630 | 32 | 9 | 25.13 | 5.36E−07 |
| $T_2$ non-transgenic segregants of event -02 of ME16630 | 4 | 22 | | |
| $T_3$ seedlings from event -02-99 of ME16630 | 43 | 6 | 33.59 | 6.79E−09 |

TABLE 11-continued

Hypocotyl length in seedlings from ME16630

| Plants | Short Hypo-cotyl | Long Hypo-cotyl | Chi-Square | p-value |
|---|---|---|---|---|
| T$_3$ non-transgenic segregants of event -02-99 of ME16630 | 2 | 15 | | |
| T$_2$ seedlings from event -04 of ME16630 | 60 | 9 | 19.53 | 9.89E−06 |
| T$_2$ non-transgenic segregants of event -04 of ME16630 | 0 | 4 | | |
| T$_3$ seedlings from event -04-99 of ME16630 | 65 | 9 | 12.14 | 4.94E−04 |
| T$_3$ non-transgenic segregants of event -04-99 of ME16630 | 0 | 2 | | |

TABLE 12

Hypocotyl length in seedlings from ME17128

| Plants | Short Hypo-cotyl | Long Hypo-cotyl | Chi-Square | p-value |
|---|---|---|---|---|
| T$_2$ seedlings from event -02 of ME17128 | 31 | 0 | 38.00 | 7.07E−10 |
| T$_2$ non-transgenic segregants of event -02 of ME17128 | 0 | 7 | | |
| T$_3$ seedlings from event -02-99 of ME17128 | 68 | 0 | 70.78 | 4.00E−17 |
| T$_3$ non-transgenic segregants of event -02-99 of ME17128 | 1 | 10 | | |
| T$_2$ seedlings from event -03 of ME17128 | 21 | 11 | 11.05 | 8.86E−04 |
| T$_2$ non-transgenic segregants of event -03 of ME17128 | 0 | 8 | | |
| T$_3$ seedlings from event -03-99 of ME17128 | 74 | 0 | 80.00 | 3.74E−19 |
| T$_3$ non-transgenic segregants of event -03-99 of ME17128 | 0 | 6 | | |
| T$_2$ seedlings from event -04 of ME17128 | 28 | 4 | 18.06 | 2.14E−05 |
| T$_2$ non-transgenic segregants of event -04 of ME17128 | 1 | 7 | | |
| T$_3$ seedlings from event -04-99 of ME17128 | 62 | 0 | 39.42 | 3.41E−10 |
| T$_3$ non-transgenic segregants of event -04-99 of ME17128 | 7 | 9 | | |

TABLE 13

Hypocotyl length in seedlings from ME17578

| Plants | Short Hypocotyl | Long Hypocotyl | Chi-Square | p-value |
|---|---|---|---|---|
| T$_2$ seedlings from event-01 of ME17578 | 32 | 1 | 32.42 | 1.24E−08 |
| T$_2$ non-transgenic segregants of event-01 of ME17578 | 0 | 6 | | |
| T$_3$ seedlings from event-01-99 of ME17578 | 63 | 0 | 69.06 | 9.56E−17 |
| T$_3$ non-transgenic segregants of event-01-99 of ME17578 | 1 | 12 | | |
| T$_2$ seedlings from event-03 of ME17578 | 20 | 0 | 30.00 | 4.32E−08 |
| T$_2$ non-transgenic segregants of event-03 of ME17578 | 0 | 10 | | |
| T$_3$ seedlings from event-03-99 of ME17578 | 29 | 4 | 19.26 | 1.14E−05 |
| T$_3$ non-transgenic segregants of event-03-99 of ME17578 | 14 | 24 | | |

TABLE 14

Hypocotyl length in seedlings from ME18158

| Plants | Short Hypocotyl | Long Hypocotyl | Chi-Square | p-value |
|---|---|---|---|---|
| T$_2$ seedlings from event-01 of ME18158 | 23 | 2 | 22.31 | 2.33E−06 |
| T$_2$ non-transgenic segregants of event-01 of ME18158 | 2 | 11 | | |
| T$_3$ seedlings from event-01-99 of ME18158 | 61 | 0 | 54.93 | 1.25E−13 |
| T$_3$ non-transgenic segregants of event-01-99 of ME18158 | 1 | 5 | | |
| T$_2$ seedlings from event-02 of ME18158 | 25 | 5 | 7.62 | 5.78E−03 |
| T$_2$ non-transgenic segregants of event-02 of ME18158 | 0 | 2 | | |
| T$_3$ seedlings from event-02-99 of ME18158 | 70 | 0 | 7.88 | 5.01E−03 |

TABLE 14-continued

Hypocotyl length in seedlings from ME18158

| Plants | Short Hypocotyl | Long Hypocotyl | Chi-Square | p-value |
|---|---|---|---|---|
| $T_3$ non-transgenic segregants of event-02-99 of ME18158 | 8 | 1 | | |
| $T_2$ seedlings from event-04 of ME18158 | 22 | 3 | 27.17 | 1.86E−07 |
| $T_2$ non-transgenic segregants of event-04 of ME18158 | 0 | 13 | | |
| $T_3$ seedlings from event-04-99 of ME18158 | 22 | 3 | 49.13 | 2.40E−12 |
| $T_3$ non-transgenic segregants of event-04-99 of ME18158 | 0 | 13 | | |

TABLE 15

Hypocotyl length in seedlings from ME18314

| Plants | Short Hypocotyl | Long Hypocotyl | Chi-Square | p-value |
|---|---|---|---|---|
| $T_2$ seedlings from event-01 of ME18314 | 13 | 14 | 5.72 | 1.67E−02 |
| $T_2$ non-transgenic segregants of event-01 of ME18314 | 1 | 11 | | |
| $T_3$ seedlings from event-01-99 of ME18314 | 62 | 0 | 47.75 | 4.85E−12 |
| $T_3$ non-transgenic segregants of event-01-99 of ME18314 | 2 | 5 | | |
| $T_2$ seedlings from event-02 of ME18314 | 16 | 9 | 4.48 | 3.43E−02 |
| $T_2$ non-transgenic segregants of event-02 of ME18314 | 0 | 3 | | |
| $T_3$ seedlings from event-02-99 of ME18314 | 56 | 0 | 46.67 | 8.41E−12 |
| $T_3$ non-transgenic segregants of event-02-99 of ME18314 | 4 | 10 | | |
| $T_2$ seedlings from event-03 of ME18314 | 18 | 6 | 4.78 | 2.88E−02 |
| $T_2$ non-transgenic segregants of event-03 of ME18314 | 6 | 9 | | |
| $T_3$ seedlings from event-03-99 of ME18314 | 37 | 0 | 42.00 | 9.13E−11 |
| $T_3$ non-transgenic segregants of event-03-99 of ME18314 | 0 | 5 | | |
| $T_2$ seedlings from event-04 of ME18314 | 24 | 3 | 20.84 | 4.99E−06 |
| $T_2$ non-transgenic segregants of event-04 of ME18314 | 2 | 11 | | |
| $T_3$ seedlings from event-04-99 of ME18314 | 67 | 0 | 79.00 | 6.21E−19 |
| $T_3$ non-transgenic segregants of event-04-99 of ME18314 | 0 | 12 | | |

TABLE 16

Hypocotyl length in seedlings from ME19304

| Plants | Short Hypocotyl | Long Hypocotyl | Chi-Square | p-value |
|---|---|---|---|---|
| $T_2$ seedlings from event-07 of ME19304 | 28 | 1 | 29.22 | 6.48E−08 |
| $T_2$ non-transgenic segregants of event-07 of ME19304 | 1 | 9 | | |
| $T_3$ seedlings from event-07-99 of ME19304 | 57 | 0 | 40.51 | 1.95E−10 |
| $T_3$ non-transgenic segregants of event-07-99 of ME19304 | 8 | 12 | | |
| $T_2$ seedlings from event-08 of ME19304 | 18 | 11 | 7.67 | 5.62E−03 |
| $T_2$ non-transgenic segregants of event-08 of ME19304 | 0 | 6 | | |

TABLE 16-continued

| | Hypocotyl length in seedlings from ME19304 | | | |
|---|---|---|---|---|
| Plants | Short Hypocotyl | Long Hypocotyl | Chi-Square | p-value |
| $T_3$ seedlings from event-08-99 of ME19304 | 69 | 0 | 63.61 | 1.52E−15 |
| $T_3$ non-transgenic segregants of event-08-99 of ME19304 | 2 | 9 | | |

TABLE 17

| | Hypocotyl length in seedlings from ME19738 | | | |
|---|---|---|---|---|
| Plants | Short Hypocotyl | Long Hypocotyl | Chi-Square | p-value |
| $T_2$ seedlings from event-02 of ME19738 | 32 | 0 | 20.84 | 4.99E−06 |
| $T_2$ non-transgenic segregants of event-02 of ME19738 | 0 | 7 | | |
| $T_3$ seedlings from event-02-99 of ME19738 | 68 | 0 | 80.00 | 3.74E−19 |
| $T_3$ non-transgenic segregants of event-02-99 of ME19738 | 0 | 12 | | |
| $T_2$ seedlings from event-05 of ME19738 | 22 | 6 | 15.76 | 7.20E−05 |
| $T_2$ non-transgenic segregants of event-05 of ME19738 | 1 | 10 | | |
| $T_3$ seedlings from event-05-99 of ME19738 | 65 | 1 | 66.48 | 3.54E−16 |
| $T_3$ non-transgenic segregants of event-05-99 of ME19738 | 0 | 9 | | |

TABLE 18

| | Hypocotyl length in seedlings from ME20871 | | | |
|---|---|---|---|---|
| Plants | Short Hypocotyl | Long Hypocotyl | Chi-Square | p-value |
| $T_2$ seedlings from event-03 of ME20871 | 27 | 8 | 10.03 | 1.54E−03 |
| $T_2$ non-transgenic segregants of event-03 of ME20871 | 0 | 4 | | |
| $T_3$ seedlings from event-03-99 of ME20871 | 51 | 10 | 12.35 | 4.41E−04 |
| $T_3$ non-transgenic segregants of event-03-99 of ME20871 | 0 | 3 | | |
| $T_2$ seedlings from event-05 of ME20871 | 32 | 0 | 40.00 | 2.54E−10 |
| $T_2$ non-transgenic segregants of event-05 of ME20871 | 0 | 8 | | |
| $T_3$ seedlings from event-05-99 of ME20871 | 61 | 0 | 68.52 | 1.26E−16 |
| $T_3$ non-transgenic segregants of event-05-99 of ME20871 | 1 | 13 | | |
| $T_2$ seedlings from event-10 of ME20871 | 26 | 0 | 27.24 | 1.80E−07 |
| $T_2$ non-transgenic segregants of event-10 of ME20871 | 1 | 6 | | |
| $T_3$ seedlings from event-10-99 of ME20871 | 52 | 1 | 48.91 | 2.68E−12 |
| $T_3$ non-transgenic segregants of event-10-99 of ME20871 | 1 | 9 | | |

TABLE 19

Hypocotyl length in seedlings from ME21199

| Plants | Short Hypocotyl | Long Hypocotyl | Chi-Square | p-value |
|---|---|---|---|---|
| $T_2$ seedlings from event-01 of ME21199 | 29 | 0 | 29.83 | 4.72E−08 |
| $T_2$ non-transgenic segregants of event-01 of ME21199 | 1 | 6 | | |
| $T_3$ seedlings from event-01-99 of ME21199 | 62 | 0 | 78.00 | 1.03E−18 |
| $T_3$ non-transgenic segregants of event-01-99 of ME21199 | 0 | 16 | | |
| $T_2$ seedlings from event-03 of ME21199 | 19 | 0 | 9.44 | 2.12E−03 |
| $T_2$ non-transgenic segregants of event-03 of ME21199 | 7 | 5 | | |
| $T_3$ seedlings from event-03-99 of ME21199 | 68 | 0 | 55.03 | 1.19E−13 |
| $T_3$ non-transgenic segregants of event-03-99 of ME21199 | 3 | 8 | | |
| $T_2$ seedlings from event-05 of ME21199 | 26 | 0 | 20.41 | 6.26E−06 |
| $T_2$ non-transgenic segregants of event-05 of ME21199 | 4 | 7 | | |
| $T_3$ seedlings from event-05-99 of ME21199 | 31 | 1 | 17.88 | 2.35E−05 |
| $T_3$ non-transgenic segregants of event-05-99 of ME21199 | 5 | 7 | | |

TABLE 20

Hypocotyl length in seedlings from ME21508

| Plants | Short Hypocotyl | Long Hypocotyl | Chi-Square | p-value |
|---|---|---|---|---|
| $T_2$ seedlings from event-01 of ME21508 | 20 | 5 | 15.76 | 7.19E−05 |
| $T_2$ non-transgenic segregants of event-01 of ME21508 | 2 | 12 | | |
| $T_3$ seedlings from event-01-99 of ME21508 | 74 | 0 | 80.00 | 3.74E−19 |
| $T_3$ non-transgenic segregants of event-01-99 of ME21508 | 0 | 6 | | |
| $T_2$ seedlings from event-05 of ME21508 | 23 | 8 | 15.71 | 7.85E−05 |
| $T_2$ non-transgenic segregants of event-05 of ME21508 | 0 | 9 | | |
| $T_3$ seedlings from event-05-99 of ME21508 | 65 | 0 | 78.00 | 1.03E−18 |
| $T_3$ non-transgenic segregants of event-05-99 of ME21508 | 0 | 13 | | |

There were no observable or statistically significant differences between $T_2$ ME05268, ME06120, ME09503, ME10007, ME10852, ME11939, ME13456, ME15935, ME16594, ME16597, ME16630, ME17128, ME17578, ME18158, ME18314, ME19304, ME19738, ME20871, ME21199, and ME21508 plants and control plants in germination, onset of flowering, rosette area, fertility, and general morphology/architecture.

Example 5—Results for ME12006, ME12596, and ME12899 Events $T_2$ and $T_3$ seed from events -03, -02, and -03 of ME12006, $T_2$ and $T_3$ seed from events -08 and -09 of ME12596, and $T_2$ and $T_3$ seed from events -05 and -06 of ME12899 was grown under SD+EODFR conditions and evaluated for hypocotyl length as described in Example 3.

Seedlings from events -03, -02, and -03 of ME12006; events -08 and -09 of ME12595; and events -05 and -06 of ME12899 displayed a short hypocotyl under SD+EODFR conditions in both the $T_2$ and $T_3$ generations, and the transgene was linked to the short hypocotyl phenotype with a confidence level of p<0.05 (Tables 21-23).

TABLE 21

Hypocotyl length in seedlings from ME12006

| Plants | Short Hypocotyl | Long Hypocotyl | Chi-Square | p-value |
|---|---|---|---|---|
| $T_2$ seedlings from event-01 of ME12006 | 22 | 2 | 8.89 | 2.87E−03 |
| $T_2$ non-transgenic segregants of event-01 of ME12006 | 8 | 8 | | |
| $T_3$ seedlings from event-01-03 of ME12006 | 27 | 3 | 7.50 | 6.17E−03 |
| $T_3$ non-transgenic segregants of event-01-03 of ME12006 | 5 | 5 | | |
| $T_2$ seedlings from event-02 of ME12006 | 20 | 20 | 12.23 | 4.70E−04 |
| $T_2$ non-transgenic segregants of event-02 of ME12006 | 6 | 10 | | |
| $T_3$ seedlings from event-02-01 of ME12006 | 23 | 4 | 12.61 | 3.84E−04 |
| $T_3$ non-transgenic segregants of event-02-01 of ME12006 | 2 | 7 | | |
| $T_2$ seedlings from event-03 of ME12006 | 24 | 4 | 7.94 | 4.83E−03 |
| $T_2$ non-transgenic segregants of event-03 of ME12006 | 4 | 6 | | |
| $T_3$ seedlings from event-03-04 of ME12006 | 19 | 2 | 8.82 | 2.99E−03 |
| $T_3$ non-transgenic segregants of event-03-04 of ME12006 | 2 | 4 | | |

TABLE 22

Hypocotyl length in seedlings from ME12596

| Plants | Short Hypocotyl | Long Hypocotyl | Chi-Square | p-value |
|---|---|---|---|---|
| $T_2$ seedlings from event-08 of ME12596 | 22 | 4 | 18.75 | 1.487E−05 |
| $T_2$ non-transgenic segregants of event-08 of ME12596 | 2 | 12 | | |
| $T_3$ seedlings from event-08-01 of ME12596 | 18 | 4 | 10.21 | 1.40E−04 |
| $T_3$ non-transgenic segregants of event-08-01 of ME12596 | 4 | 10 | | |
| $T_2$ seedlings from event-09 of ME12596 | 21 | 5 | 8.12 | 4.39E−03 |
| $T_2$ non-transgenic segregants of event-09 of ME12596 | 5 | 9 | | |
| $T_3$ seedlings from event-09-01 of ME12596 | 20 | 4 | 5.08 | 2.42E−02 |
| $T_3$ non-transgenic segregants of event-09-01 of ME12596 | 8 | 8 | | |

TABLE 23

Hypocotyl length in seedlings from ME12899

| Plants | Short Hypocotyl | Long Hypocotyl | Chi-Square | p-value |
|---|---|---|---|---|
| $T_2$ seedlings from event-05 of ME12899 | 24 | 4 | 10.98 | 9.23E−04 |
| $T_2$ non-transgenic segregants of event-05 of ME12899 | 4 | 8 | | |
| $T_3$ seedlings from event-05-99 of ME12899 | 27 | 3 | 7.5 | 6.17E−03 |
| $T_3$ non-transgenic segregants of event-05-99 of ME12899 | 5 | 5 | | |
| $T_2$ seedlings from event-06 of ME12899 | 26 | 2 | 23.22 | 1.445E−06 |
| $T_2$ non-transgenic segregants of event-06 of ME12899 | 2 | 10 | | |

TABLE 23-continued

Hypocotyl length in seedlings from ME12899

| Plants | Short Hypocotyl | Long Hypocotyl | Chi-Square | p-value |
|---|---|---|---|---|
| $T_3$ seedlings from event-06-99 of ME12899 | 21 | 3 | 6.77 | 9.264E−03 |
| $T_3$ non-transgenic segregants of event-06-99 of ME12899 | 8 | 8 | | |

There were no observable or statistically significant differences between $T_2$ ME12006, ME12596, and ME12899 plants and control plants in germination, onset of flowering, rosette area, fertility, and general morphology/architecture.

Example 6—Results for ME18408 and ME19971 Events $T_2$ and $T_3$ seed from events -01, -02, and -03 of ME18408, and $T_2$ and $T_3$ seed from events -01, -02, -03, and -05 of ME19971 was grown under low light conditions and SD+EODFR conditions as described in Examples 2 and 3, respectively, and evaluated for hypocotyl length.

Seedlings from events -01, -02, and -03 of ME18408, and events -01, -02, -03, and -05 of ME19971 displayed a short hypocotyl under SD+EODFR conditions in both the $T_2$ and $T_3$ generations, and the transgene was linked to the short hypocotyl phenotype with a confidence level of $p<0.05$ (Tables 24 and 26). Seedlings from events -01, and -02 of ME18408, and events -01, -02, -03, and -05 of ME19971 displayed a short hypocotyl under SD+EODFR conditions in both the $T_2$ and $T_3$ generations, and the transgene was linked to the short hypocotyl phenotype with a confidence level of $p<0.05$ (Tables 25 and 27).

TABLE 24

Hypocotyl length in seedlings from ME18408 grown under low light conditions

| Plants | Short Hypocotyl | Long Hypocotyl | Chi-Square | p-value |
|---|---|---|---|---|
| $T_2$ seedlings from event-01 of ME18408 | 63 | 2 | 44.58 | 2.44E−11 |
| $T_2$ non-transgenic segregants of event-01 of ME18408 | 0 | 4 | | |
| $T_3$ seedlings from event-01-99 of ME18408 | 40 | 6 | 35.90 | 2.08E−09 |
| $T_3$ non-transgenic segregants of event-01-99 of ME18408 | 1 | 16 | | |
| $T_2$ seedlings from event-02 of ME18408 | 38 | 7 | 28.67 | 8.58E−08 |
| $T_2$ non-transgenic segregants of event-02 of ME18408 | 3 | 17 | | |
| $T_3$ seedlings from event-02-99 of ME18408 | 39 | 17 | 10.98 | 9.20E−04 |
| $T_3$ non-transgenic segregants of event-02-99 of ME18408 | 5 | 14 | | |
| $T_2$ seedlings from event-03 of ME18408 | 30 | 1 | 25.76 | 3.86E−07 |
| $T_2$ non-transgenic segregants of event-03 of ME18408 | 7 | 15 | | |
| $T_3$ seedlings from event-03-99 of ME18408 | 23 | 5 | 21.74 | 3.12E−06 |
| $T_3$ non-transgenic segregants of event-03-99 of ME18408 | 11 | 32 | | |

TABLE 25

Hypocotyl length in seedlings from ME18408 grown under SD + EODFR conditions

| Plants | Short Hypocotyl | Long Hypocotyl | Chi-Square | p-value |
|---|---|---|---|---|
| $T_2$ seedlings from event-01 of ME18408 | 22 | 5 | 6.18 | 1.29E−02 |
| $T_2$ non-transgenic segregants of event-01 of ME18408 | 5 | 7 | | |
| $T_3$ seedlings from event-01-99 of ME18408 | 19 | 8 | 10.71 | 1.06E−03 |
| $T_3$ non-transgenic segregants of event-01-99 of ME18408 | 1 | 9 | | |

TABLE 25-continued

Hypocotyl length in seedlings from ME18408 grown under SD + EODFR conditions

| Plants | Short Hypocotyl | Long Hypocotyl | Chi-Square | p-value |
|---|---|---|---|---|
| $T_2$ seedlings from event-02 of ME18408 | 25 | 5 | 4.44 | 3.50E−02 |
| $T_2$ non-transgenic segregants of event-02 of ME18408 | 5 | 5 | | |
| $T_3$ seedlings from event-02-99 of ME18408 | 22 | 3 | 6.8 | 9.13E−03 |
| $T_3$ non-transgenic segregants of event-02-99 of ME18408 | 7 | 7 | | |

TABLE 26

Hypocotyl length in seedlings from ME19971 grown under low light conditions

| Plants | Short Hypocotyl | Long Hypocotyl | Chi-Square | p-value |
|---|---|---|---|---|
| $T_2$ seedlings from event-01 of ME19971 | 8 | 0 | 18.00 | 2.21E−05 |
| $T_2$ non-transgenic segregants of event-01 of ME19971 | 0 | 10 | | |
| $T_3$ seedlings from event-01-99 of ME19971 | 37 | 0 | 61.00 | 5.71E−15 |
| $T_3$ non-transgenic segregants of event-01-99 of ME19971 | 0 | 24 | | |
| $T_2$ seedlings from event-02 of ME19971 | 16 | 2 | 19.64 | 9.37E−06 |
| $T_2$ non-transgenic segregants of event-02 of ME19971 | 0 | 9 | | |
| $T_3$ seedlings from event-02-99 of ME19971 | 36 | 0 | 29.19 | 6.56E−08 |
| $T_3$ non-transgenic segregants of event-02-99 of ME19971 | 1 | 3 | | |
| $T_2$ seedlings from event-03 of ME19971 | 14 | 1 | 19.08 | 1.25E−05 |
| $T_2$ non-transgenic segregants of event-03 of ME19971 | 0 | 8 | | |
| $T_3$ seedlings from event-03-99 of ME19971 | 34 | 0 | 46.00 | 1.18E−11 |
| $T_3$ non-transgenic segregants of event-03-99 of ME19971 | 0 | 12 | | |
| $T_2$ seedlings from event-05 of ME19971 | 26 | 0 | 29.00 | 7.24E−08 |
| $T_2$ non-transgenic segregants of event-05 of ME19971 | 0 | 3 | | |
| $T_3$ seedlings from event-05-99 of ME19971 | 42 | 0 | 47.94 | 4.39E−12 |
| $T_3$ non-transgenic segregants of event-05-99 of ME19971 | 3 | 16 | | |

TABLE 27

Hypocotyl length in seedlings from ME19971 grown under SD + EODFR conditions

| Plants | Short Hypocotyl | Long Hypocotyl | Chi-Square | p-value |
|---|---|---|---|---|
| $T_2$ seedlings from event-01 of ME19971 | 30 | 2 | 30.00 | 4.32E−08 |
| $T_2$ non-transgenic segregants of event-01 of ME19971 | 0 | 8 | | |
| $T_3$ seedlings from event-01-04 of ME19971 | 22 | 0 | 32.00 | 1.542E−08 |
| $T_3$ non-transgenic segregants of event-01-04 of ME19971 | 0 | 10 | | |
| $T_2$ seedlings from event-02 of ME19971 | 24 | 4 | 17.60 | 2.721E−05 |
| $T_2$ non-transgenic segregants of event-02 of ME19971 | 2 | 10 | | |

TABLE 27-continued

Hypocotyl length in seedlings from ME19971 grown under SD + EODFR conditions

| Plants | Short Hypocotyl | Long Hypocotyl | Chi-Square | p-value |
|---|---|---|---|---|
| T$_3$ seedlings from event-02-04 of ME19971 | 22 | 6 | 16.16 | 5.811E−05 |
| T$_3$ non-transgenic segregants of event-02-04 of ME19971 | 0 | 8 | | |
| T$_2$ seedlings from event-03 of ME19971 | 28 | 0 | 40.00 | 2.54E−10 |
| T$_2$ non-transgenic segregants of event-03 of ME19971 | 0 | 12 | | |
| T$_3$ seedlings from event-03-06 of ME19971 | 24 | 0 | 17.49 | 2.895E−05 |
| T$_3$ non-transgenic segregants of event-03-06 of ME19971 | 4 | 6 | | |
| T$_2$ seedlings from event-05 of ME19971 | 24 | 2 | 24.35 | 8.034E−07 |
| T$_2$ non-transgenic segregants of event-05 of ME19971 | 2 | 12 | | |
| T$_3$ seedlings from event-05-02 of ME19971 | 25 | 4 | 6.13 | 1.33E−02 |
| T$_3$ non-transgenic segregants of event-05-02 of ME19971 | 3 | 4 | | |

There were no observable or statistically significant differences between T$_2$ ME18408 and ME19971 plants and control plants in germination, onset of flowering, rosette area, fertility, and general morphology/architecture.

Example 7—Determination of Functional Homologs by Reciprocal BLAST

A candidate sequence was considered a functional homolog of a reference sequence if the candidate and reference sequences encoded proteins having a similar function and/or activity. A process known as Reciprocal BLAST (Rivera et al., *Proc. Natl. Acad. Sci. USA*, 95:6239-6244 (1998)) was used to identify potential functional homolog sequences from databases consisting of all available public and proprietary peptide sequences, including NR from NCBI and peptide translations from Ceres clones.

Before starting a Reciprocal BLAST process, a specific reference polypeptide was searched against all peptides from its source species using BLAST in order to identify polypeptides having BLAST sequence identity of 80% or greater to the reference polypeptide and an alignment length of 85% or greater along the shorter sequence in the alignment. The reference polypeptide and any of the aforementioned identified polypeptides were designated as a cluster.

The BLASTP version 2.0 program from Washington University at Saint Louis, Mo., USA was used to determine BLAST sequence identity and E-value. The BLASTP version 2.0 program includes the following parameters: 1) an E-value cutoff of 1.0e-5; 2) a word size of 5; and 3) the -postsw option. The BLAST sequence identity was calculated based on the alignment of the first BLAST HSP (High-scoring Segment Pairs) of the identified potential functional homolog sequence with a specific reference polypeptide. The number of identically matched residues in the BLAST HSP alignment was divided by the HSP length, and then multiplied by 100 to get the BLAST sequence identity. The HSP length typically included gaps in the alignment, but in some cases gaps were excluded.

The main Reciprocal BLAST process consists of two rounds of BLAST searches; forward search and reverse search. In the forward search step, a reference polypeptide sequence, "polypeptide A," from source species SA was BLASTed against all protein sequences from a species of interest. Top hits were determined using an E-value cutoff of $10^{-5}$ and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original reference polypeptide was considered a potential functional homolog or ortholog as well. This process was repeated for all species of interest.

In the reverse search round, the top hits identified in the forward search from all species were BLASTed against all protein sequences from the source species SA. A top hit from the forward search that returned a polypeptide from the aforementioned cluster as its best hit was also considered as a potential functional homolog.

Functional homologs were identified by manual inspection of potential functional homolog sequences. Representative functional homologs for SEQ ID NO:3, SEQ ID NO:70, SEQ ID NO:129, SEQ ID NO:317, SEQ ID NO:337, SEQ ID NO:456, SEQ ID NO:538, SEQ ID NO:570, SEQ ID NO:606, SEQ ID NO:634, SEQ ID NO:644, SEQ ID NO:850, SEQ ID NO:907, SEQ ID NO:953, SEQ ID NO:1024, SEQ ID NO:1047, SEQ ID NO:1151, SEQ ID NO:1277, SEQ ID NO:1347, SEQ ID NO:1457, SEQ ID NO:1497, SEQ ID NO:1540, SEQ ID NO:1587, SEQ ID NO:1630, and SEQ ID NO:1635 are shown in FIGS. 1-24, respectively.

Example 8—Determination of Functional Homologs by Hidden Markov Models

Hidden Markov Models (HMMs) were generated by the program HMMER 2.3.2. To generate each HMM, the default HMMER 2.3.2 program parameters, configured for glocal alignments, were used.

An HMM was generated using the sequences shown in FIG. 1 as input. These sequences were fitted to the model and a representative HMM bit score for each sequence is shown in the Sequence Listing. Additional sequences were fitted to the model, and representative HMM bit scores for any such additional sequences are shown in the Sequence Listing. The results indicate that these additional sequences are functional homologs of SEQ ID NO:3.

The procedure above was repeated and an HMM was generated for each group of sequences shown in FIGS. 2-24, using the sequences shown in each Figure as input for that HMM. A representative bit score for each sequence is shown in the Sequence Listing. Additional sequences were fitted to certain HMMs, and representative HMM bit scores for such additional sequences are shown in the Sequence Listing. The results indicate that these additional sequences are functional homologs of the sequences used to generate that HMM.

Example 9—Identification of Transgenic Plants Exhibiting a Red Light-Specific Short Hypocotyl Phenotype Wild type and transgenic seeds were surface-sterilized, plated on solid 0.5×MS medium containing 5 g/L sucrose, 0.5 g/L MES, 7 g/L Agar (adjusted to pH 5.7), and stratified at 4° C. in the dark for three to four days. After stratification, plates were acclimated to room temperature, wrapped in micropore tape, and exposed to continuous white light having a fluence rate of ~60 µmol/m$^2$/s PAR, and a red:far-red ratio (R:FR) of ~5.3. After 24 hours, plates from wild type controls and transgenic lines were moved to one of three light conditions: (1) white light conditions at a lower fluence rate (~15 µmol/m$^2$/s PAR, R:FR=~5.0), (2) red-light conditions (SNAP-LITE™ Red/Far-Red light box (Quantum Devices), at ~15 µmol/m$^2$/s PAR, R:FR=~80), or (3) far-red conditions (SNAP-LITE™ Red/Far-red light box, at ~15 µmol/m$^2$/s PAR, R:FR=~0.10). Seedlings were maintained under continuous light conditions for five days. The hypocotyls of individual seedlings were determined to be "tall" or "short" based on qualitative observation.

A hypocotyl having a length similar to the hypocotyl length typically exhibited by wild-type *Arabidopsis* seedlings grown under the same light conditions was considered a tall hypocotyl. A hypocotyl having reduced length relative to the hypocotyl length typically exhibited by wild-type *Arabidopsis* seedlings grown under the same light conditions was considered a short hypocotyl. Transgenic seedlings from ten Ceres SEEDLINE ID nos. failed to germinate, or germinated poorly, under continuous red light (ME10007, ME10852, ME11961, ME15935, ME17128, ME18158, ME18314, ME19304, ME20871, and ME21508).

Transgenic seedlings from eight Ceres SEEDLINE ID nos. (ME11939, ME16630, ME19971, ME05268, ME13456, ME13629, ME16597, and ME17578) exhibited short hypocotyls when grown under continuous red light. Transgenic seedlings from three of these (ME11939, ME16630, and ME19971) exhibited tall hypocotyls under continuous far-red light exposure, indicating that the short hypocotyl phenotype was red-light specific in these three seed lines. In contrast, the other five seedlings (ME05268, ME13456, ME13629, ME16597, and ME17578) exhibited a short-hypocotyl phenotype when grown under far-red light, indicating that the short-hypocotyl phenotype exhibited by ME05268, ME13456, ME13629, ME16597, and ME17578 was not red-light specific (See, e.g., Parks and Spaulding, *Proc. Natl. Acad. Sci.*, 96: 14142-14146 (1999) describing different molecular mechanisms for suppression of hypocotyl elongation under continuous red and far-red light conditions).

A similar red light-dependent short hypocotyl phenotype has been observed in transgenic plants overexpressing the photochemically and biologically functional photoreceptor, Phytochrome B (Phy B) (Wagner et al., Plant Cell, 3: 1275-1288 (1991)). Phy B null mutants exhibit a long hypocotyl seedling phenotype and increased plant height (Kebrom and Brutnell, *J Exp. Bot.*, 58: 3079-3089 (2007)). These observations suggest that transgene modulation of light response pathways can produce plants exhibiting either increased grain yield, or increased biomass. See Pennell et al., U.S. Pat. App. Ser. No. 61/097,789, "Transgenic Plants Having Increased Biomass," filed Sep. 17, 2008, incorporated by reference herein. Thus, transgenic plants comprising nucleic acid sequences that down-regulate expression of a At5g14370 polypeptide (SEQ ID NO: 456) (FIG. 6), a At1g13360 polypeptide (SEQ ID NO: 953) (FIG. 11), a At2g35940 polypeptide (SEQ ID NO: 1540) (FIG. 21), and sequences identified as functional homologs of these sequences (see FIGS. 6, 11, 21 and sequence listing) are predicted to exhibit a tall hypocotyl phenotype under conditions of normal or low light.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

---

SEQUENCE LISTING (2381 sequences)

SEQ ID NO: 1 - DNA, 900 bp, Arabidopsis thaliana
  misc_feature: Ceres SEEDLINE ID no.ME05268
  misc_feature: Expected Sequence
  misc_feature: Encodes the peptide sequence at SEQ ID NO. 3
aaaattattatcaaaataagaaagagctcaacattgttctctgactctataaataactgttcttggaaattttccaagagaacaagaaacaaaaacaaaacgttgtttaagtgtggttctatagatttcttgtgaatgtcttctgaacaaggaaatggatcgaatccttccacgtcaccggaggtagaagggactaaaacaatcccctttcgccggagattgcaaagaggacaaagagttttcgctccaaagctgatggaggctctacgtcgatcaagggtaagctctgaagaagctccggtaaggcatcttagtcgtagatggagagccacaacggcgcagaaggtatattccctaaagctctacgacgctcttcaacgatcgcggcggagcgcaacagtccgggacacggccgacaaagtccttgcgacgaccgctcgtggtgcaactcggtggagccgagccattttggttagtcgattcggaacgagtctgaggcggcgtaggaataccaaaccggcgtcggcattagctgcggcgatcaggggaagtggtggaagtgggaggaggaggaagttatcggcggtgggaaatcgggtccgggttttgggtgggttggtgccgggttgccggagaacggcgttaccggagcttttggacgagacagcagattacatagcggctttggaaatgcaagtccgagccatgacagctctatcaaagattctgtcggagcttcagccgtctactaatctcggctcggctttatagccgagtgtataagccgatgaatttgtttcaattaattcttttacgattttatcgtgggaatgtcttattgtttttaatgatttgtttgccctggaaaaaaaaaattgtcaaaatcatcacgagttggac

SEQ ID NO: 2 - DNA, 917 bp, Arabidopsis thaliana
  misc_feature: Ceres SEEDLINE ID no.ME05268
  misc_feature: Inplanta Sequence
  misc_feature: Encodes the peptide sequence at SEQ ID NO. 3
aaaaattattatcaaaataagaaagagctcaacattgttctctgactctataaataactgttcttggaaattttccaagagaacaagaaacaaaaacaaaacgttgtttaagtgtggttctatagatttcttgtgaatgtcttctgaacaaggaaatggatcgaatccttccacgtcaccggaggtagaagggactaaaacaatcccctttcgccggagattgcaaagaggacaaagagttttcgctccaaagctgatggaggctctacgtcgatcaagggtaagctctgaagaagctccggtaaggcatcttagtcgtagatggagagccacaacggcgcagaaggtatattccctaaagctctacgacgctcttcaacgatcgcggcggagcgcaacagtccgggacacggccgacaaagtccttgcgacgaccgctcgtggtgcaactcggtggagccgagccattttggttagtcgattcggaacgagtctgaggcggcgtaggaataccaaaccggcgtcggcattagctgcggcgatcaggggaagtggtggaagtgggaggaggaggaagttatcggcggtgggaaatcgggtccgggttttgggtgggttggtgccgggttgccggagaacggcgttaccggagcttttggacgagacagcagattacatagcggctttggaaatgcaagtccgagccatgacagctctatcaaagattctgtcggagcttcagccgtctactaatctcggctcggctttatagccgagtgtataagccgatgaatttgtttcaattaattcttttacgattttatcgtgggaatgtcttattgtttttaatgatttgtttgccctggaaaaaaaaaaatgtcaaaatcatcacgagttggacaaaaaaaaaaaaaaaa

SEQ ID NO: 3 - protein, 211 aa, Arabidopsis thaliana
  misc_feature: Ceres SEEDLINE ID no.ME05268
  misc_feature: Bit score of 398.2 for HMM based on sequences of FIGURE 1.
MSSEQGNGSNPSTSPEVEGTKTIPFRRRLQRGQRVFAPKLMEALRRSRVSSEEAPVRHLSRRWRATTAQKVYSLKLYDALQRSRRSATVRDTADKVLATTARGATRWSRAILVSRFGTSLRRRRNTKPASALAAAIRGSGGSGRRRKLSAVGNRVRVLGGLVPGCRRTALPELLDETADYIAALEMQVRAMTALSKILSELQPSTNLGSAL

SEQ ID NO: 4 - DNA, 853 bp, Gossypium hirsutum
  misc_feature: Ceres CLONE ID no.1793691
  misc_feature: Encodes the peptide sequence at SEQ ID NO. 5
atcagccaccaaaccaagaaaattagtattgaaagttctttctttcttttctcccattcccttttctgcaattactttgcttctttgataccaaacctcgaacccaagccctgtgtttaaacggaggaaaacggaaggagacccagtttctgtccatcgaatccaatccaaccaaacaatgaagcgatggacaacaaaacgagagcatcagatctactcctccaagctcttccaagctctctgtcgttctcgtcggacctcttcatccacttccgcgaaggaactccatcaaacggccgacagagttcttgccataacagccaagggaaccacgcgttggagcagagcgattctcgccgctccactcactgctggtaccaatatgaagaaacataagaaagccaaggtggtccatacaaggttgaggaagccggtggttaacagagagaagagaaaactgccggtcgttgagaggaagttgagggctttgagacgtcttgttccaggttgccggaaactatcttgcaacaaccttctagaagaaacgagcgattacatagcggctttagagatgcaagttcgagccatgacggctatcaccgagtttctctcccgcggtgaggctcaggtgccaactgatcgactcggctctattggtaacatgtgaaaaggtgtttattacaacgactctattatgatttttagtggtgtaattttcttccttttattttgcttttgtcaagcatcatttatttaattgattaaatcaattaattaaatatatgtaacaaaattataacaagtatttttatatcacattacaattgaaattcaaaaaaaaaaaaaaaaaaaa

SEQ ID NO: 5 - protein, 162 aa, Gossypium hirsutum
  misc_feature: Ceres CLONE ID no.1793691
  misc_feature: Bit score of 181.0 for HMM based on sequences of FIGURE 1.
  misc_feature: Functional Homolog Of Ceres SEEDLINE ID no. ME05268 at SEQ ID NO. 3
MKRWTTKREHQIYSSKLFQALCRSRRTSSSTSAKELHQTADRVLAITAKGTTRWSRAILAAPLTAGTNMKKHKKAKVVHTRLRKPVVNREKRKLPVVERKLRALRRLVPGCRKLSCNNLLEETSDYIAALEMQVRAMTAITEFLSRGEAQVPTDRLGSIGNM

SEQ ID NO: 6 - DNA, 697 bp, Gossypium hirsutum
  misc_feature: Ceres CLONE ID no.1844057
  misc_feature: Encodes the peptide sequence at SEQ ID NO. 7
actcatatcccaaaccattaacataacctatatcttactttccaacctctttcttccatctccatctccatctccatctcctttctgcaattattcccaactttccatggcttccttcacacccaatctagaacctgcccctgacacctctcttcagttcaagcccaagaaacccaggataacccttcaaaccccttcctcttgtcctcccaatcaacgcatccaaagaattaagcgatggcggacccaacgagaccaacacatctactcctccaagctcttccaggctctccgtcgttctcgtcgtacctccgcctccagggaagtccacgaaacggctgacagggttctcgccgttttggccaagggcaccactcgttggggcagagccattctcaccgctcgcaaggtgaccaaacataagaaagccaagctccctactaataacaggttgaggaagcccgatatttacagagagaggaggaaaacgccggctgttgagcggaagttgaaggttttgggacgtctcgtccccggttgccggaaactatccttctccaaccttatagaagaaactagcgattacatagcggctctagagatgcaagttcgagccatgacggctattaccgagtttctctgcggcggaactggcggtggaccgcagccgccggctgatcgccttccctctaatgtc

SEQ ID NO: 7 - protein, 197 aa, Gossypium hirsutum
  misc_feature: Ceres CLONE ID no.1844057
  misc_feature: Bit score of 414.3 for HMM based on sequences of FIGURE 1.
  misc_feature: Functional Homolog Of Ceres SEEDLINE ID no. ME05268 at SEQ ID NO. 3
MASFTPNLEPAPDTSLQFKPKKPRITLQTPSSCPPNQRIQRIKRWRTQRDQHIYSSKLFQALRRSRRTSASREVHETADRVLAVLAKGTTRWGRAILTARKVTKHKKAKLPTNNRLRKPDIYRERRKTPAVERKLKVLGRLVPGCRKLSFSNLIEETSDYIAALEMQVRAMTAITEFLCGGTGGGPQPPADRLPSNV

SEQ ID NO: 8 - DNA, 1117 bp, Gossypium hirsutum
  misc_feature: Ceres CLONE ID no.1933784
  misc_feature: Encodes the peptide sequence at SEQ ID NO. 9
ataaaatgtaaaatgacgcctgctctcttttcattcccattcctttattatattttaactttctccctctcctctctccatctcttcctcaatccaacacacctcctcaactccgttccgttcatttaccctttctccgttttcttcctttttttttcttttctctcgattccaccctctgagttcatcaaatcgacgcttctgttaacattcaccgaatcgtacggtgtagagagggagagagagagagagaatattagaggattttgatccggtgagatggcgtccatggtaacgaatcctgtgacgaacgcaaattctgatcgcagcaaaaggaaaaagaagaaatcaatgatcatggaagacaatcaccagagttacgccagatggaaatcggaggcgcagcagcaaatctattcctccaagcttcttcaggctttgagccaggtcagcctcaacacttcttcctcttcggctccgcgcggtggccgagccgtccgtgaagccgctgatagagctttggccgttgctgctaaagggaggactaggtggagccgggccattttgacaagccggcttaaactgaaattcagaaagcagaagaggcagaggggagccgccgtggctgccgtcaccgggagtagccgctcgaagaaaccgagatttagcgtttccaaactgaaatcgaaaagcttaccggctgttcaaagaaaagtcaaggttcttggacggttggttcctggttgcaggaagcaaccgttgcctattattcttgaagaagcgactgattacatagctgcgcttgaaatgcaggttcgagccatgaccactctcgccgagctgctatctggctccggtgtcgccagctctggctcagctcttccgccccagtcgccgccgcctagtcagtaacacctttaatttgcttagttgccaagtcatcctcatcttcctttttttattttttattttcttgcctcctcactctctaagtaatgttaaatacatgttttctttgtttttcgttttccttctcaagcaagtttatcttatattttcattttattcaaaaaaaaatatgaagaaaggttgggatttaagattttccttcattatt

SEQ ID NO: 9 - protein, 210 aa, Gossypium hirsutum
  misc_feature: Ceres CLONE ID no.1933784
  misc_feature: Bit score of 335.1 for HMM based on sequences of FIGURE 1.
  misc_feature: Functional Homolog Of Ceres SEEDLINE ID no. ME05268 at SEQ ID NO. 3
MASMVTNPVTNANSDRSKRKKKKSMIMEDNHQSYARWKSEAQQQIYSSKLLQALSQVSLNTSSSSAPRGGRAVREAADRALAVAAKGRTRWSRAILTSRLKLKFRKQKRQRGAAVAAVTGSSRSKKPRFSVSKLKSKSLPAVQRKVKVLGRLVPGCRKQPLPIILEEATDYIAALEMQVRAMTTLAELLSGSGVASSGSALPPQSPPPSQ

SEQ ID NO: 10 - protein, 205 aa, Gossypium hirsutum
  misc_feature: Ceres CLONE ID no.100030408
  misc_feature: Bit score of 316.4 for HMM based on sequences of FIGURE 1.
  misc_feature: Functional Homolog Of Ceres SEEDLINE ID no. ME05268 at SEQ ID NO. 3
MVTNPVTNANSDRTKRKKKKSMIMEDNHQSHARWKSEAQQQIYSSKLLQALSQVSLNTPSSSAPRGGRAVREAADRALAVAAKGRTRWSRAILTSRLKLKFRKQKRQRGAAVAAVTGSSRSKKPRFSVSKLKSKSLPAVQRKVKVLGRLVPGCRKQPLPIILEEATDYIAALEMQVRAMTTLAELLSGLRCRQLWLSSSAPVAAA

SEQ ID NO: 11 - DNA, 969 bp, Gossypium hirsutum
  misc_feature: Ceres CLONE ID no.1837059
  misc_feature: Encodes the peptide sequence at SEQ ID NO. 12
atcctctattctttccctcttaaccctgttgatttcaataacttcttttgattccactgagcttcaacaaatcttcagaatttcgaattgaatccttttttttcttttataattcaccgaatcgtacggtgaaaaggagagaatatctgcgaaatggaatccactgtaacgaatccattgccgaactcgaattccgaccctgtcagaaggaagaagaaaaagaaaacatcagcagcggcggcgacggcgacgttgaagacgaatcagcagcggcagaaccaaaaccagagctacaatcacaccagatggaaatccgaggcgcagcaacaaatctattcttcgaagctgattcaagctttgagtcaagtcaatctcaacggtaaccattcttctccttcggctccgcgtcgtggacgagccgttcgtgaagctgctgatagagctttggctgtagcggctaaagggaggacgaggtggagccgtgctattttgacgagccgtgttaagctgaagtttaggaaggagaagggacagagaagtggatctgtttctgctgcgacggtgattggcgttaccggtagaaaccggtcgaggaaacagagatttagtgttttgaaattgaaagcgaaatctgttcaaaggaaagtcaaggttattggtcggttggttcccggttgccggaaacaaccgttagcggttattctcgaagaagcaactgattatattgccgcgcttgagatgcaggttcgcgccatgagcgctcttgctgatttgctttctggttccagctccgccacctctagctcaccgccgaccagccagtgaaacctttttttttgcttaatttccaagtatcatcctctttatttttaatttttcttttctttatctccaagtaatcgtcatctctccttgttaatatacatccaagtacttttcatttttcatcaaaaaaaaaaaaaaaaaaaa

SEQ ID NO: 12 - protein, 223 aa, Gossypium hirsutum
  misc_feature: Ceres CLONE ID no.1837059
  misc_feature: Bit score of 286.2 for HMM based on sequences of FIGURE 1.
  misc_feature: Functional Homolog Of Ceres SEEDLINE ID no. ME05268 at SEQ ID NO. 3
MESTVTNPLPNSNSDPVRRKKKKKTSAAAATATLKTNQQRQNQNQSYNHTRWKSEAQQQIYSSKLIQALSQVNLNGNHSSPSAPRRGRAVREAADRALAVAAKGRTRWSRAILTSRVKLKFRKEKGQRSGSVSAATVIGVTGRNRSRKQRFSVLKLKAKSVQRKVKVIGRLVPGCRKQPLAVILEEATDYIAALEMQVRAMSALADLLSGSSSATSSSPPTSQ

SEQ ID NO: 13 - DNA, 1365 bp, Gossypium hirsutum
  misc_feature: Ceres CLONE ID no.1793801
  misc_feature: Encodes the peptide sequence at SEQ ID NO. 14
attcccattccttcattatattataactctctccctctcctctctcctctctcctctctccatctcttcctcaatccaacacacctcctcaaccccgttccgttcatttaccctttctccgttttcttccttttttttcttcttcttttccctcgattccaccctctgagttcatcaaatcggtaataattttttgttcctttttgtggaattgtaatttgaatctctgttttgtctcaaaatctgaatctagattcctttcttcttttgttgcagacgcttctgttatcattcaccgaatcatacggtgtagagagagagagagagagagagagagagagaatattagaggattttgatccggtgagatggcgtccatggtaacgaatccagtgacgaacgcaaattctgatcgcaccaaaaggaaaaagaagaaatcaatgatcatggaagacaatcaccagagtcacgccagatggaaatcggaggcgcagcagcaaatctattcctccaagcttcttcaggctttgagccaggtcagtctcaacactccttcctcttcggctcctcgcggtggccgagccgtccgtgaagctgctgatagagctttggccgttgctgctaaagggaggaccaggtggagccgggccattttgacaagccggcttaaactgaaattcagaaagcagaagaggcagaggggagccgccgtggctgccgtcacggggagtagccgctcgaagaaaccgagatttagcgtttccaaactgaaatcgaaaagcttaccggctgttcaaagaaaagtcaaggttcttggacggttggttcccggttgcaggaagcaaccgttgcctattattcttgaagaagcgactgattacatagctgcgcttgaaatgcaggttcgagccatgaccactctcgccgagctgctatctggctccggtgccccagctctggctcagctcttccgccccagtcgccgccgcctagtcagtaacacctttttttaatttgcttagttgccaagtcatcctcatcctcatcttccttttttattttttattttattgcctcctcactctctaagtaatgttaaatacatgttttctttgtttttccttttccttctcaggtaagtttatctcatattttcattttattcaaaaaaaaaaaaagaagagaggttcgcatttaagattttccttcattattaggccattgttcctctgaaatatactgcaataaaaaaaattgtaaatgcttgacttttgtagagttgttactcaatgatttcaggcttgaaatcaagaaattcaaggtttatttgtttatttatttattcaaaaaaaaaaaaaaaaaaaa

SEQ ID NO: 14 - protein, 214 aa, Gossypium hirsutum
  misc_feature: Ceres CLONE ID no.1793801
  misc_feature: Bit score of 328.7 for HMM based on sequences of FIGURE 1.
  misc_feature: Functional Homolog Of Ceres SEEDLINE ID no. ME05268 at SEQ ID NO. 3
MASMVTNPVTNANSDRTKRKKKKSMIMEDNHQSHARWKSEAQQQIYSSKLLQALSQVSLNTPSSSAPRGGRAVREAADRALAVAAKGRTRWSRAILTSRLKLKFRKQKRQRGAAVAAVTGSSRSKKPRFSVSKLKSKSLPAVQRKVKVLGRLVPGCRKQPLPIILEEATDYIAALEMQVRAMTTLAELLSGSGAPALAQLFRPSRRRLVSNTFF

SEQ ID NO: 15 - DNA, 1363 bp, Gossypium hirsutum
  misc_feature: Ceres CLONE ID no.1855480
  misc_feature: Encodes the peptide sequence at SEQ ID NO. 16
ctgcctctcctctctctttaaaaacaacaaattatcgattccgttcttctctgaccatctttcttctctcaattttcaccgcctcttcatcacatcgttttagttataattcaccgaatcgtacggtgagagagagaataataaggcgttttgtccggtgagatggcatcgttgataacgaatccagtgacgaacacaaattctgatcgtagcaaaaggaaaaagaagaagaattctatggtgaaacagaatcttcaacggagccaaaaggaagatcatgccagatggaagtcagaggcgcagcagcaaatctattcctcaaaacttcttcaagctttgagtcaggtcagtctcggtactccctctccttcggctccacgcggtggtcgagctgtccgtgaagccgctgatagagtgttggcggttgctgctaaagggagaaccaggtggagccgggccattttgacgagccggcttaaactgaaatttagaaagcagaagagatcacagagaggatccgctgctgccgttgctgccgcaacaaggactagccggtcgaagaaaccgagagttagcgttttgaaattgaaagcgaaaagtgtaccgaatgttcaaagaaaagtaaaggtcctcggcagattggttcccggttgccggaagcaaccgttaccggtaattcttgaagaagcaactgattacatagcggcacttgagatgcaggttcgagccatgagcgctctcgcagatctgttatctggctccggagccgcaagctctagctcggctcctccgcctgagtggccaatgccgccgaccagccaatgacgcttttttattcccttaattgacaaatgccaagtgtcatcctcatctttttccctttttttaattcttattattattattatctcctcttttgcccttctctctctttcctcatcaatcacctcttctgttaaatacattattcttccctttcatttcacaaaaataatttaaatatctcacatttcatttcaatttactacatgaaaaaagaaaaaagaaaaaaggagggatcgtcccccttactatgcatacaaacaactcttctggaaatatattggaataagcaaaatgttttatgattattttgtagggtttgattttgacgataagaaaaaagagaggaagctgggtccaaactagggtaggtgaacaatgcacttgatgctgcacccatttggctgctaaagttaattttttttcttattctttttcatttttcagaatatgataattgtatttacttctaatttaatttgaaattgaattgagttagataaataaaagagatataactcaaaaaaaaaaaaaaaaaaaa

SEQ ID NO: 16 - protein, 220 aa, Gossypium hirsutum
  misc_feature: Ceres CLONE ID no.1855480
  misc_feature: Bit score of 304.8 for HMM based on sequences of FIGURE 1.
  misc_feature: Functional Homolog Of Ceres SEEDLINE ID no. ME05268 at SEQ ID NO. 3
MASLITNPVTNTNSDRSKRKKKKNSMVKQNLQRSQKEDHARWKSEAQQQIYSSKLLQALSQVSLGTPSPSAPRGGRAVREAADRVLAVAAKGRTRWSRAILTSRLKLKFRKQKRSQRGSAAAVAAATRTSRSKKPRVSVLKLKAKSVPNVQRKVKVLGRLVPGCRKQPLPVILEEATDYIAALEMQVRAMSALADLLSGSGAASSSSAPPPEWPMPPTSQ

SEQ ID NO: 17 - DNA, 674 bp, Gossypium hirsutum
  misc_feature: Ceres CLONE ID no.1915644
  misc_feature: Encodes the peptide sequence at SEQ ID NO. 18
actctttcagctcattctttctacttcgtttctgcaattacccccaacattttgaactttctatggcttctttcatacaaaacctccattccagccctcaaacctcttcacagttcactaaactgaagaaaacaagggcaacgccgtcaccttcttttcatccaagccaatgggcaacacagcaccagcaacagatctacgcctccaagctcttccaagctctccgtcattctcctccgaccttctcttccttcgatgccaaacaagtccgcgaaacggcggacagagtgctggccgtcgccgctaagggaacaatgcattggagcagagccattctaagtgctgccggcgccaagatcaggaagaaacataagaaagcgaaggtcatcgccgatcgaaggttgaggagatcatcggagattaacaaagggaagaagaaatcgacggtcgttgaaaggaagctgaaggttttgagacggcttgttcccggttgccgtaagctatcttcttactcgaacgttctagatgaagctagagattacatagcggctttagagatgcaagttcgatccatgacggctgttgccgagtttctcggtggtggcggtatcgttcgagcgccgccgccggcttatcggcttggttctaatgtcgactcttaaaaaaagtgagaa

SEQ ID NO: 18 - protein, 199 aa, Gossypium hirsutum
  misc_feature: Ceres CLONE ID no.1915644
  misc_feature: Bit score of 210.2 for HMM based on sequences of FIGURE 1.
  misc_feature: Functional Homolog Of Ceres SEEDLINE ID no. ME05268 at SEQ ID NO. 3
MASFIQNLHSSPQTSSQFTKLKKTRATPSPSFHPSQWATQHQQQIYASKLFQALRHSPPTFSSFDAKQVRETADRVLAVAAKGTMHWSRAILSAAGAKIRKKHKKAKVIADRRLRRSSEINKGKKKSTVVERKLKVLRRLVPGCRKLSSYSNVLDEARDYIAALEMQVRSMTAVAEFLGGGGIVRAPPPAYRLGSNVDS

SEQ ID NO: 19 - DNA, 809 bp, Gossypium hirsutum
  misc_feature: Ceres CLONE ID no.1898104
  misc_feature: Encodes the peptide sequence at SEQ ID NO. 20
gcacactctttcagctcattctttctacttcgtttctgcaattaccccgaacattttgaactatctatggcttctttcatacaaaacctccattccagccctcaaccctcgtcacagttcactaaactgaagaaaacaacggcaacgccgtcaccttcctttcatccaagccaatgggcaacacagcaccagcaacagatctacgcctccaagctcttccgagctctccgtcattctcctccgacctcctcttccttcgatgccaaacaagtccgcgaaacggcaaacagagtgctggccgtcgccgctaagggaacaatgcattggagcagagccattctaagtgctgccggcgccaagatcaggaagaaacataagaaagcaaaggtcgtcgtcgatcgaaggttaaggagatcatcggagattaacaaagggaagaagaaatcgacggtcgttgaaaggaagctgaaggttttgagacggcttgtccccggttgccgtaagctatcttcttactcgaacgttctagatgaagctagagattacatagcggctttagagatgcaagttcgatccatgacggctgttgccgagtttctcggtggtggcggtatcgttcgagcgccgccgccggcttatcggctcggttccaacgtcgactcgtaaaaaaaaaagtgagaaggaagttatattagtatttacaaattacagtccttaaatgtaattagcaatttaaatataaaaaagttaatttaagaaatatgtaataatttattttaattcgtatacaaaaaaaaaaaaaaaaaaaa

SEQ ID NO: 20 - protein, 199 aa, Gossypium hirsutum
  misc_feature: Ceres CLONE ID no.1898104
  misc_feature: Bit score of 195.1 for HMM based on sequences of FIGURE 1.
  misc_feature: Functional Homolog Of Ceres SEEDLINE ID no. ME05268 at SEQ ID NO. 3
MASFIQNLHSSPQPSSQFTKLKKTTATPSPSFHPSQWATQHQQQIYASKLFRALRHSPPTSSSFDAKQVRETANRVLAVAAKGTMHWSRAILSAAGAKIRKKHKKAKVVVDRRLRRSSEINKGKKKSTVVERKLKVLRRLVPGCRKLSSYSNVLDEARDYIAALEMQVRSMTAVAEFLGGGGIVRAPPPAYRLGSNVDS

SEQ ID NO: 21 - DNA, 615 bp, Populus balsamifera subsp. trichocarpa
  misc_feature: Ceres ANNOT ID no.1469148
  misc_feature: Encodes the peptide sequence at SEQ ID NO. 22
atggcaagcaaccaatcaaactgtgacgtgtcatcgcaacaagaaccaaaccagcaaagaaagaaacgcagaaaactgactcatgaaacgacagagagtcaccttcaaaacgacggcactggcgagaccaaaaaccagcctacagtgaggtggcgaactgacacagcgaggcggatctattcgtcgaagcttctagaggctctgcgtcgatcatgccggataacttctcatcggggtgagaagactcgagaagtccgggaaaccgctgacagagtcctcgcggtggccgcgcgaggaaaaacacggtggagccgcgcgattctagcgaaacgcgcgcggttgttgagagtgaagaaggtgaagaaacagagggtggctcgtgatcgcaagtcaccggggagcgagaagaggaggaagttaccaccggtggagaagaaggtaaaggttttgagccggttagtccctggttgcaggaaagtctcgtttgtgaatcttttagaggaagcgagtgattatattgcggctttggagatgcaaattaaggttatgaccaatcttagtgaaattctcaccgtcgctggcggcggaggaggcggtggcggctcgtcaagttga

SEQ ID NO: 22 - protein, 204 aa, Populus balsamifera subsp. trichocarpa
  misc_feature: Ceres ANNOT ID no.1469148
  misc_feature: Bit score of 426.7 for HMM based on sequences of FIGURE 1.
  misc_feature: Functional Homolog Of Ceres SEEDLINE ID no. ME05268 at SEQ ID NO. 3
MASNQSNCDVSSQQEPNQQRKKRRKLTHETTESHLQNDGTGETKNQPTVRWRTDTARRIYSSKLLEALRRSCRITSHRGEKTREVRETADRVLAVAARGKTRWSRAILAKRARLLRVKKVKKQRVARDRKSPGSEKRRKLPPVEKKVKVLSRLVPGCRKVSFVNLLEEASDYIAALEMQIKVMTNLSEILTVAGGGGGGGGSSS

SEQ ID NO: 23 - DNA, 690 bp, Populus balsamifera subsp. trichocarpa
  misc_feature: Ceres ANNOT ID no.1464241
  misc_feature: Encodes the peptide sequence at SEQ ID NO. 24
atggaaccatcgtcgtcgtcagcagtagcagcagcaatagtgagtactaacgccaacatcaacacggatcgaacaagaaggaaaaagaagaagaaatcagtgttgcagcaacaccaatcaaaacagaaccaaaactcacagagccacgccaaatggaaaacagaagcacaacaacaagtctactcatccaaactcatccaagccttaagccaagtcaatctcaacccttcaacttcatcagccccgcgtcaaggtcgagccgttagagaagttgctgatcgggctttagctttcgctgctaaaggtaaaaccaggtggagccgagccattttaactagccgcatcaaactcaaatttcggaaacaacaacataagagacagagacttgcgtcgtcgtcttcttcttctccaggatccactaccgggagtagcagccggtcgtcgaggaagcataaagtgagtgttttgaggttgaaagcgaagggtttgccggctgttcaaaggaaagttcgtgttcttggccggttagttcctggttgcctgaaacaaccattgcctgttattttggaagaagctacagattatattgctgctttggagatgcaagttaaaaccatgactgctatagctgagcttctttctcgctctacctccgaagccagctctacttctgagccgatgacctcctaa

SEQ ID NO: 24 - protein, 229 aa, Populus balsamifera subsp. trichocarpa
  misc_feature: Ceres ANNOT ID no.1464241
  misc_feature: Bit score of 283.4 for HMM based on sequences of FIGURE 1.
  misc_feature: Functional Homolog Of Ceres SEEDLINE ID no. ME05268 at SEQ ID NO. 3
MEPSSSSAVAAAIVSTNANINTDRTRRKKKKKSVLQQHQSKQNQNSQSHAKWKTEAQQQVYSSKLIQALSQVNLNPSTSSAPRQGRAVREVADRALAFAAKGKTRWSRAILTSRIKLKFRKQQHKRQRLASSSSSSPGSTTGSSSRSSRKHKVSVLRLKAKGLPAVQRKVRVLGRLVPGCLKQPLPVILEEATDYIAALEMQVKTMTAIAELLSRSTSEASSTSEPMTS

SEQ ID NO: 25 - protein, 207 aa, Arabidopsis thaliana
  misc_feature: Public GI ID no.18390998
  misc_feature: Bit score of 407.7 for HMM based on sequences of FIGURE 1.
  misc_feature: Functional Homolog Of Ceres SEEDLINE ID no. ME05268 at SEQ ID NO. 3
MVESLFPSIENTGESSRRKKPRISETAEAEIEARRVNEESLKRWKTNRVQQIYACKLVEALRRVRQRSSTTSNNETDKLVSGAAREIRDTADRVLAASARGTTRWSRAILASRVRAKLKKHRKAKKSTGNCKSRKGLTETNRIKLPAVERKLKILGRLVPGCRKVSVPNLLDEATDYIAALEMQVRAMEALAELLTAAAPRTTLTGT

SEQ ID NO: 26 - protein, 221 aa, Arabidopsis thaliana
  misc_feature: Public GI ID no.18397627
  misc_feature: Bit score of 325.1 for HMM based on sequences of FIGURE 1.
  misc_feature: Functional Homolog Of Ceres SEEDLINE ID no. ME05268 at SEQ ID NO. 3
MASLISDIEPPTSTTSDLVRRKKRSSASSAASSRSSASSVSGEIHARWRSEKQQRIYSAKLFQALQQVRLNSSASTSSSPTAQKRGKAVREAADRALAVSARGRTLWSRAILANRIKLKFRKQRRPRATMAIPAMTTVVSSSSNRSRKRRVSVLRLNKKSIPDVNRKVRVLGRLVPGCGKQSVPVILEEATDYIQALEMQVRAMNSLVQLLSSYGSAPPPI

SEQ ID NO: 27 - DNA, 911 bp, Arabidopsis thaliana
  misc_feature: Ceres CLONE ID no.9391
  misc_feature: Encodes the peptide sequence at SEQ ID NO. 28
attctccacaatttcataactttcttccgctcaacttcagataaattcggattctgtagctctttcaatacgactgcggagatcagagccaattatttggttatggcgtctctgatctcagatattgaaccgccgacgagtactacttcagatctcgttcggagaaagaagagatcctctgcttcatccgccgcatcgtctcgttcaagcgcatcttccgtctccggtgagattcacgcgcgatggcgatcggagaagcaacaacggatctactcagccaaactgttccaagcgctccaacaagtccgcctcaactcttccgcctcaacatcatcatctccaacggctcagaaacgaggaaaggccgtccgtgaagccgccgaccgagctctcgccgtttccgctcgcggaagaacactctggagcagagcgatcttagctaatcggatcaaactgaaatttcgtaaacagagacgtcctagagctacggtggcggttccggccatgactacggtggttagtagcagcagcaacagatcgagaaaacggagagtgtcggtgttgagattgaataagaagagtataccggatgttaaccggaaagtacgtgttctaggccggttagttcccggttgcggtaaacaatccgtaccggtgattctagaagaagcaactgattatattcaggctctggagatgcaagtgagagccatgaactctttagttcagcttctctcctcctacggctcagctcctccaccgatttgatgaggttaaactcgtctttttaattctaccatctctcgatctttcacagcttatgtgtatatagaagattcggtttgattataatctgtaactactcttcccaaccgctgattcttctctgctataagtaaaagtaaattttg

SEQ ID NO: 28 - protein, 221 aa, Arabidopsis thaliana
  misc_feature: Ceres CLONE ID no.9391
  misc_feature: Bit score of 324.4 for HMM based on sequences of FIGURE 1.
  misc_feature: Functional Homolog Of Ceres SEEDLINE ID no. ME05268 at SEQ ID NO. 3
MASLISDIEPPTSTTSDLVRRKKRSSASSAASSRSSASSVSGEIHARWRSEKQQRIYSAKLFQALQQVRLNSSASTSSSPTAQKRGKAVREAADRALAVSARGRTLWSRAILANRIKLKFRKQRRPRATVAVPAMTTVVSSSSNRSRKRRVSVLRLNKKSIPDVNRKVRVLGRLVPGCGKQSVPVILEEATDYIQALEMQVRAMNSLVQLLSSYGSAPPPI

SEQ ID NO: 29 - DNA, 1049 bp, Arabidopsis thaliana
  misc_feature: Ceres CLONE ID no.111154
  misc_feature: Encodes the peptide sequence at SEQ ID NO. 30
gttaaaataaaatagaataaaaataaaggaagaagaagaagaagaagaagaagaaaggattcgtcttccttcttccacaccctttctgacacctcatctcccctcccaccttctccgtcccgttccgtttctccatcagatcctcgattccgatccaacagttcgaattcagtttccgattctgatctgatcgaaccaatactcactgagatttgatcggcgattatggagtctatatctccggtatcgaatcagcttcttcagccgacgacgacgagctctaattccgatcgctctcgtcgtaagcgtaagaagaaatcatcgccatcatcggttgagaaatctccatctccgtcaatatcgttggagaaatggagatcggagaagcagcaacagatctactcaacgaagctagttcatgctttaagagagctacgaatcagccaacaaccatcttcatcatcatcttcttcgattccacgtggaggtagagccgtacgtgaagtcgccgatagagctttagcagttgcggcgagaggtaaaacgttatggagtcgagcgatactttcaaaagctgtaaaactcaaattcaggaaacacaaacgccagagaatctctaatccgacgacgacgacgttaaccaccgggagtatcaggtcaaagaaacagagagcgacggttttgaggcttaaggctaaaggtttgccagctgtacagaggaaagtgaaagtactgagccggttagttcccggttgccgtaaacaatcattaccggtggttttagaagaaaccactgattatatagctgccatggagatgcagattcgtactatgactgcgattctctccgccgttagttcttctcctccgccgccaacgccaggtcacgaagggggacaaacacacatgcttggttagttggccaaactgtccttttatttttttccaattttaaaaaccaaaaaaaaaactgttttttttatcatattattattcttctcactgtattgtttgttgtttgaatattttactattcaactttatttatc

SEQ ID NO: 30 - protein, 230 aa, Arabidopsis thaliana
  misc_feature: Ceres CLONE ID no.111154
  misc_feature: Bit score of 251.9 for HMM based on sequences of FIGURE 1.
  misc_feature: Functional Homolog Of Ceres SEEDLINE ID no. ME05268 at SEQ ID NO. 3
MESISPVSNQLLQPTTTSSNSDRSRRKRKKKSSPSSVEKSPSPSISLEKWRSEKQQQIYSTKLVHALRELRISQQPSSSSSSSIPRGGRAVREVADRALAVAARGKTLWSRAILSKAVKLKFRKHKRQRISNPTTTTLTTGSIRSKKQRATVLRLKAKGLPAVQRKVKVLSRLVPGCRKQSLPVVLEETTDYIAAMEMQIRTMTAILSAVSSSPPPPTPGHEGGQTHMLG

SEQ ID NO: 31 - DNA, 792 bp, Brassica napus
  misc_feature: Ceres CLONE ID no.1065656
  misc_feature: Encodes the peptide sequence at SEQ ID NO. 32
aaatcctctggttatggcgtctccgacttctctaaactcaacccctacagatctcgttcgaagaaagaagagacaatccgcttcctcctccgccgcatcgcctcggagaaacaacgcagcttccgcaaccgccggagacggcgagagccacgcgcgatggagatcggagaagcagcagcgtaactactccgcaaagctggtccaggcgctgcaacaggtccgcctcagctcctccgccgccgaaacaccatctccgacggcgaagaagcgagggaaagccgtccgggaagccgccgaccgcgctctcgccgtctccgctcgcgggaggacgctctggagcagagcgatcctcgctaaccggatcaagctcaaattccggaaacagaaacggccgcgaccggcggcgatcccggccgtgatcacgacgggaagtagcagcagcagcaatagcggaagatggaagaaacggagagtgacggttgtgaaactgaataagaagagtataccgacggttaaccggaaagtacgtgtactcggccggttagttccgggttgcaagaaagaatcagtaccggttattytagaagaagcgaccgattacatccaggctttggagatgcaagtcagagccatgaagtctctagctgagcttctctccggctcaaactcagctcctccgccgatttgatgaggttaaaatcgtcattttaagttctgccaatctctgtgtctctctgtgtacaccaaaacacttttcatattaatatatgtaaacataatacgtttgagtgt

SEQ ID NO: 32 - protein, 224 aa, Brassica napus
  misc_feature: Ceres CLONE ID no.1065656
  misc_feature: Bit score of 436.0 for HMM based on sequences of FIGURE 1.
  misc_feature: Functional Homolog Of Ceres SEEDLINE ID no. ME05268 at SEQ ID NO. 3
  misc_feature (190)..(190): Xaa is any aa, unknown, or other
MASPTSLNSTPTDLVRRKKRQSASSSAASPRRNNAASATAGDGESHARWRSEKQQRNYSAKLVQALQQVRLSSSAAETPSPTAKKRGKAVREAADRALAVSARGRTLWSRAILANRIKLKFRKQKRPRPAAIPAVITTGSSSSSNSGRWKKRRVTVVKLNKKSIPTVNRKVRVLGRLVPGCKKESVPVIXEEATDYIQALEMQVRAMKSLAELLSGSNSAPPPI

SEQ ID NO: 33 - DNA, 852 bp, Brassica napus
  misc_feature: Ceres CLONE ID no.973975
  misc_feature: Encodes the peptide sequence at SEQ ID NO. 34
catcatcagaatcaaaactctggtcactcatggcgtctctgacctccgataacgaacaaccgccgacgaattcaaactcaagttctacagatcatgttagaaagaagaagagcttatttgcttcctccccctcctcgtctcgtggaaacgcagcttccgtaccaaccagagacggtgacagccacccgcgatggagatcggagaagcaacagcgtatctactccgccaagctgatccaggcgctgagacaggtccgcctcagctcttcctcctccgcgacgacatcatctccaacggctcagaagcgagggaaagcagtccgcgaagccgcggaccgcgccctcgccgtttccgcccgcgggaggacgctctggagcagagcgattcttgctaaccggatcaaactgaagttccggaagcagaaacggccgaggcagacggttataccggccgtgaccacggtggtcacgacgggagctactagcagcagagggaggaaacggagagtgtcggtggtgggactgaataagaagagtttaccgacggttaaccggaaagttcgttctctcggccggttagttccgggttgcaaaaaagaatcagtaccggttattytagaagaagcaaccgattacatacaagcactggagatgcaagttagagccatgaactctctagtggagcttctctccggctactcaacccccggctcagactcagctcctccgcctattagatgaggttaaaatcgtcattttgccagtattcgactttttaaattctgccatctctgtgtgtacacgaaaacttattcatataaatttgagaaatataatacacataataatatgt

SEQ ID NO: 34 - protein, 236 aa, Brassica napus
  misc_feature: Ceres CLONE ID no.973975
  misc_feature: Bit score of 339.7 for HMM based on sequences of FIGURE 1.
  misc_feature: Functional Homolog Of Ceres SEEDLINE ID no. ME05268 at SEQ ID NO. 3
  misc_feature (196)..(196): Xaa is any aa, unknown, or other
MASLTSDNEQPPTNSNSSSTDHVRKKKSLFASSPSSSRGNAASVPTRDGDSHPRWRSEKQQRIYSAKLIQALRQVRLSSSSSATTSSPTAQKRGKAVREAADRALAVSARGRTLWSRAILANRIKLKFRKQKRPRQTVIPAVTTVVTTGATSSRGRKRRVSVVGLNKKSLPTVNRKVRSLGRLVPGCKKESVPVIXEEATDYIQALEMQVRAMNSLVELLSGYSTPGSDSAPPPIR

SEQ ID NO: 35 - DNA, 950 bp, Glycine max
  misc_feature: Ceres CLONE ID no.1652677
  misc_feature: Encodes the peptide sequence at SEQ ID NO. 36
acttggcttcaaacaccatcaacttcttctttcgttcttcattgttcattcaatttcttctctcttcatctcaccgaacaaatcattcaattgcaatcatctatggcgtctttcgacccgagcgtagattctagtaattccgacacgttgcgagaatccaatcacaagaagcgcagaaaaatcggagaccacgccgccgccgatcaaaattcggctgccgcctccccgtggagatccgaagaggagcagcggatctactcccgccgcctcgtggaggctctccgccgcactgcgtcatcggcggccaagcctagagccgccggccaggtccgcgagaccgccgaccgcgtcctcgccgccaccgccagaggccgaacacggtggagccgcgcgattctcagccgctggaggaagctccgcacgcagcacaagaaggcgaagaagaaggaggcatcgtccattaactgtttgaagagaacgaggattggcaacggagagaggaggaaccggttaccggctgtgcagaagaaagcgcgcgtcctcagccggttggttcccggttgccggaaggtctcgtttccaaaccttctggaagaagccacggactatatctccgccttggagatgcaagtgcgagccatgacggctctcgccgaactactcgccgtcgccgcgccggcaagtctcgccggcggcacgttgagttgacccccgcgcctaggctatattgcgccaggtgtttttcttattttattttttaattattatatcgtttttattggttttcagattcatgtattttatcgtgtacactgtacatgccatttgcttattcctccttcttttgagttccactatcatcacctccaccttcttttttcttttcttttttatcctttcatatttaattgaatgtgaacatgcatacctaaaaaaaaaaaaaaaaaaaa

SEQ ID NO: 36 - protein, 201 aa, Glycine max
  misc_feature: Ceres CLONE ID no.1652677
  misc_feature: Bit score of 418.7 for HMM based on sequences of FIGURE 1.
  misc_feature: Functional Homolog Of Ceres SEEDLINE ID no. ME05268 at SEQ ID NO. 3
MASFDPSVDSSNSDTLRESNHKKRRKIGDHAAADQNSAAASPWRSEEEQRIYSRRLVEALRRTASSAAKPRAAGQVRETADRVLAATARGRTRWSRAILSRWRKLRTQHKKAKKKEASSINCLKRTRIGNGERRNRLPAVQKKARVLSRLVPGCRKVSFPNLLEEATDYISALEMQVRAMTALAELLAVAAPASLAGGTLS

SEQ ID NO: 37 - DNA, 858 bp, Glycine max
  misc_feature: Ceres CLONE ID no.676695
  misc_feature: Encodes the peptide sequence at SEQ ID NO. 38
  misc_feature (542)..(542): n is a, c, t, g, unknown, or other
  misc_feature (590)..(590): n is a, c, t, g, unknown, or other
  misc_feature (602)..(602): n is a, c, t, g, unknown, or other
  misc_feature (613)..(613): n is a, c, t, g, unknown, or other
  misc_feature (650)..(650): n is a, c, t, g, unknown, or other
  misc_feature (808)..(808): n is a, c, t, g, unknown, or other
aacttcttcttcttcttcttcttcttcttcttgcgttttttattgttcattcaatttctttttcttctctcatcatctcaaccaacaaatcatttaattgcaatcatctatggcgtctttcgacccgaacgtagattcaagtaattccgacacgttgcgagaatccaatcacaagaagcgcagaaaaatcggagaccacgccgccggcgatctcgatttcgccgccgccgtcccttggagatccgacgtggagcagcggatctactcccgccgcctcgtggaggctctccgccgcactccgtcatcggcgaccaagcctagagccgccggccaggtccgcgagaccgccgaccgcgtcctcgccgccaccgccagaggccgaacgaggtggagccgcgcgattctcaagcgctggaggaagctccgcatgcagcacaagaaggcgaaggcggcatcgtccaacaacggtttgaagagaacgaggattggaaacggagagaggaggaaccggttaccggctgttcagaagaaagcgcgcgttntcagccggttggttcccggttgccggaaggtttcgttcccgaaccttntggaagaagccncggactatatntccgccttggagatgcaagtgcgagccatgacggctntggccgaactactcgccggcgccgcgccggcaaatctcgccggctccgcgttgagttgacccgcgcgcctaggctatattgcgccaggtgttttttattttttatttttaattattatatcgttttttttttcagattcatgtattttatcgtgtacnctgtacatgccatttgcttattcctccttcctttgagttccactatcacc

SEQ ID NO: 38 - protein, 199 aa, Glycine max
  misc_feature: Ceres CLONE ID no.676695
  misc_feature: Bit score of 345.9 for HMM based on sequences of FIGURE 1.
  misc_feature: Functional Homolog Of Ceres SEEDLINE ID no. ME05268 at SEQ ID NO. 3
  misc_feature (145)..(145): Xaa is any aa, unknown, or other
  misc_feature (161)..(161): Xaa is any aa, unknown, or other
  misc_feature (165)..(165): Xaa is any aa, unknown, or other
  misc_feature (168)..(168): Xaa is any aa, unknown, or other
  misc_feature (181)..(181): Xaa is any aa, unknown, or other
MASFDPNVDSSNSDTLRESNHKKRRKIGDHAAGDLDFAAAVPWRSDVEQRIYSRRLVEALRRTPSSATKPRAAGQVRETADRVLAATARGRTRWSRAILKRWRKLRMQHKKAKAASSNNGLKRTRIGNGERRNRLPAVQKKARVXSRLVPGCRKVSFPNLXEEAXDYXSALEMQVRAMTAXAELLAGAAPANLAGSALS

SEQ ID NO: 39 - DNA, 931 bp, Glycine max
  misc_feature: Ceres CLONE ID no.680331
  misc_feature: Encodes the peptide sequence at SEQ ID NO. 40
attcttcattcctcatactacccatttgcgatcaatcaatcttctctgttttcaaaaacattccaataatggagtctttgtctttttctttgcactcaaacctccattcccttactttgctgcaacattccaatcaaaacaagaagcgccgcaaaatcacacaccaaaactccttagctctcactccctggacttcccatacccaacaccgcctctactcttccaacctcctcctcgcgctccgccgcaacagcaaccctaccgcctccctccaagtccgcgccgccgcagaccgcgtcctcgccgccactgccaaaggccgaactcgctggagccgcgccattctcgcaaatccgttcggccggtggaggaagcagaggcagaggcaccacaagaaggtcaagaactgctccgccaacaaatgtatgaagaagaccacgccggatattcggagaaggttaccggcggtgcagaagaaggcgcgcgttctcggaaagttaatccctggttgccggaaggtgtcgttcccgaagcttctagaagaagccggtgactatatttcagcgttggagatgcaagtgcgagccatgaaggctctcgcagaccttctccccaccggtgctccgccgccagatccgatcggtttaagttgacccaagttgttcatttttaggtgtttcttggtatatcgttaatattggttttcagatttcagttccatcttcgccactttttttttttttttctctcctcattttttattatttcagttaaaaaagttataatagacaataatatatgttctatattgttatacatatgatatgatatggtctataattagtttacacatataattgtaccgttaatatttttcatgatgaataaagcttgttattatcagatttgacaccgaaaaaaaaaaaaaaaa

SEQ ID NO: 40 - protein, 194 aa, Glycine max
  misc_feature: Ceres CLONE ID no.680331
  misc_feature: Bit score of 227.9 for HMM based on sequences of FIGURE 1.
  misc_feature: Functional Homolog Of Ceres SEEDLINE ID no. ME05268 at SEQ ID NO. 3
MESLSFSLHSNLHSLTLLQHSNQNKKRRKITHQNSLALTPWTSHTQHRLYSSNLLLALRRNSNPTASLQVRAAADRVLAATAKGRTRWSRAILANPFGRWRKQRQRHHKKVKNCSANKCMKKTTPDIRRRLPAVQKKARVLGKLIPGCRKVSFPKLLEEAGDYISALEMQVRAMKALADLLPTGAPPPDPIGLS

SEQ ID NO: 41 - DNA, 1109 bp, Glycine max
  misc_feature: Ceres CLONE ID no.654515
  misc_feature: Encodes the peptide sequence at SEQ ID NO. 42
ccccttcaactcaacctccttgtgaagttgaagggacacctcacccacccgaaacaccatccattctcagccaccaccctctctctcaaacccttagtttccattctcaagagtgaagctcttccaactatatatacatacacatatctcttcagaacccactccctcacttctggaatctagccataaaaatcataaatttccctctttcacccgaatctctataccgtatccatctgaatccaacaaattttcccacaaatagaaagttagaagccccccaaaaacacaaacccccttttaagttttaatttccccaacgttgttgtaccatgtcgtcatctctgatcgcgaatccaactgcggatcggtcgcgtgactctcaccgcacaaagaagaagaagaaatcccttaagcaacaccaactacagcatgagcagagccacgccaaatggaaatcccacgcgcaacaacagctatactcctccaagctccaccatgctctggcgcgtgtcaacatctccggcgacgcgccgcgccgcggcagggcggtgcgcgaggcggccgacagggttctcgccgtcgccgcgaaggggagaacgcggtggagccgcgccatcctgactaaccggctcaagctgaagttcaggaagccgattcacaagaggcagaaggttgttgttgggccgggccggcccaagaaggcccggttcagcgttctccggctcaaggggaaaaccctgcccgcggtccagaggaaggttagggttctgggccggttggttcccggttgcagaaaagaaccgcttcccgtgattctcgaagaggccatcgattacatacccgcgctcgagatgcaggttcgcgccatgcaagctctcgctgacttactcttaggctcttcctccgcctcaacctccgccgccgcgccgccaagttgatctcactttccggcgaatatgccacgtgtcatatattttttttcctcttcttgatttttgttattatttgcctcgttttcactttcgtttatgttaattgtccagtacatacatattatatcttcttctatttcctcttcttttttttaaacaaaaaaaaaaaaaaaa

SEQ ID NO: 42 - protein, 202 aa, Glycine max
  misc_feature: Ceres CLONE ID no.654515
  misc_feature: Bit score of 291.2 for HMM based on sequences of FIGURE 1.
  misc_feature: Functional Homolog Of Ceres SEEDLINE ID no. ME05268 at SEQ ID NO. 3
MSSSLIANPTADRSRDSHRTKKKKKSLKQHQLQHEQSHAKWKSHAQQQLYSSKLHHALARVNISGDAPRRGRAVREAADRVLAVAAKGRTRWSRAILTNRLKLKFRKPIHKRQKVVVGPGRPKKARFSVLRLKGKTLPAVQRKVRVLGRLVPGCRKEPLPVILEEAIDYIPALEMQVRAMQALADLLLGSSSASTSAAAPPS

SEQ ID NO: 43 - DNA, 1203 bp, Glycine max
  misc_feature: Ceres CLONE ID no.626154
  misc_feature: Encodes the peptide sequence at SEQ ID NO. 44
ctctctcccttaaactcaacctcctagtgaagttgaagggacacctcaaccacccacccaacaccattcattcttatttctttcattcataaaaatcattcattcccagccgccaccaccaccaccaccctctctctctctctcaaatccttaatttccattcataagtatattagattacttcagaagctccttcaactatatatacacatatatctcttcaaaccctattccctcacctctggaatctaaccataaaaatcataaattttccctctttcacccgaatctgaatccaacaatttgttcccacaaatagaaacccacgaaaaccacaaaaccccttttaggttttaatttccccaacgttgttgtaccatgtcgtcatctctgatcgcgaatccaaccgcggatcgctcgcgtgactctcaccgcacaaagaagaagaagaaatctattaagcaacaccaacagcagcatgacgcgaaatggaaaacccacgcgcagcagcagctatactcctccaagctccaccaggccctcgcgcgtgtcaacatctccggcgacgcgccacgccgcggcagggcggtgcgcgatgccgccgacagggtgctcgccgtggccgccaaggggaggacgcggtggagccgcgccatcttaacgaaccggctgaaggtcaagttcaggaagccggttcacaagaggcagaaggttgttgttgttgggccgggccggccaaagaaaaaggcccggttcagcgttctccggctcagggggaaaaccttacccgcggttcagaggaaagttagggttctgggccggttggttcccggttgcagaaaagaaccgcttccggtgattctcgaagaggccatcgattacatacccgcgctcgagatgcaggttcgcgccatgcaagctctcgctgacttactcttaggctcttcctccgcctccacctccgccaccgccgcgccgcctagttgatctcactttccggcgattatgccacgtttcatatattttttttccttacttttgttattatttgcctcgttttcaccctcactctactcggcttatgttaattgccaagtacatacatattatatcttcttctattttctctttttttttttttcttcttcaaatttaccttttgagcaaaacaatctcataattaattagcttggagcatttatc

SEQ ID NO: 44 - protein, 202 aa, Glycine max
  misc_feature: Ceres CLONE ID no.626154
  misc_feature: Bit score of 279.9 for HMM based on sequences of FIGURE 1.
  misc_feature: Functional Homolog Of Ceres SEEDLINE ID no. ME05268 at SEQ ID NO. 3
MSSSLIANPTADRSRDSHRTKKKKKSIKQHQQQHDAKWKTHAQQQLYSSKLHQALARVNISGDAPRRGRAVRDAADRVLAVAAKGRTRWSRAILTNRLKVKFRKPVHKRQKVVVVGPGRPKKKARFSVLRLRGKTLPAVQRKVRVLGRLVPGCRKEPLPVILEEAIDYIPALEMQVRAMQALADLLLGSSSASTSATAAPPS

SEQ ID NO: 45 - DNA, 982 bp, Glycine max
  misc_feature: Ceres CLONE ID no.710603
  misc_feature: Encodes the peptide sequence at SEQ ID NO. 46
gagttcaattcaagtgcagtgcagggacacctcacccacccctccttcccttccgttccgttcaccaccacctttctctcctttttcccgttccattacctctcaaacctttctcctccactcaactacacatctctctctctctctctcttgggagtatctgcaattcgtaatcctatccacttgttgaatctgaatatttccaattcaacattttccaaatggcatcctcgtcctctatgatctcaaacccggttccgaacacggaccggtcacgtgacgcgaaacggaggaagaagaaagcgcagctgaggcagcagcaacaacggcaagaggatcagagcaatcccaagtggaaatcccaagcgcagcaacaaatctactcctccaagctgcgccaagccttagccagagtgaatctcgggttggcgccgccgccgcgccgaggcaaagccgtgcgcgacgccgccgacagagtcctagccgtgacagccaaggggatgacgcgctggagccgagccatcctcaccaaccggctcaagctcaagttcaccaaacacaagcggcagagacttacaacgcccccaacccggtcaaagaaaccccgggtcagcgtttaccggctgaaggggaagggttcaccgggcgtgcagagaaaagtgaggttcctcgcacgcttggttcccggttgccgtaaagaaccgttaccggttattttggaagaagccattgattacatacccgcgcttgagatgcaggttcgagccatgagcgctctctttaaccttctctctggttcttcttcttcttccggcgccgccgcctccccttccgcgccacctagctcgtcatagaagacacttttggctctaggcctttatgtatgtatgccatgccatgtcatgtgtctgtcaatttttttaatttttatcatcatcatcatcattatttggctcgttttctttcaaaaaaaaaaaaaaaa

SEQ ID NO: 46 - protein, 210 aa, Glycine max
  misc_feature: Ceres CLONE ID no.710603
  misc_feature: Bit score of 321.1 for HMM based on sequences of FIGURE 1.
  misc_feature: Functional Homolog Of Ceres SEEDLINE ID no. ME05268 at SEQ ID NO. 3
MASSSSMISNPVPNTDRSRDAKRRKKKAQLRQQQQRQEDQSNPKWKSQAQQQIYSSKLRQALARVNLGLAPPPRRGKAVRDAADRVLAVTAKGMTRWSRAILTNRLKLKFTKHKRQRLTTPPTRSKKPRVSVYRLKGKGSPGVQRKVRFLARLVPGCRKEPLPVILEEAIDYIPALEMQVRAMSALFNLLSGSSSSSGAAASPSAPPSSS

SEQ ID NO: 47 - DNA, 691 bp, Glycine max
  misc_feature: Ceres CLONE ID no.648076
  misc_feature: Encodes the peptide sequence at SEQ ID NO. 48
atcctcgtggagtagtattttcgatcaatcaatcttctctgtttccaaaacattccaattatttcccttcattcacacatcatggactctttgtctttgcactcaaacctccattccgttaacaataagcgccgccaaatcacacaccaaaactccttcgctctcactccctcctggacttccctaaccgaacagcgcctctactcctccaagctcctccactcgstccgccgcaacagcaaccctaccgccgccctcgaagtccgcgcctccgctgaccgcgtcctcgccgccactgccaaaggccgaactcgctggagccgcgccattctctcaaatccgatctgccgctggaagcagagacaccacaagaaggtcaagaagtactccgccaacaaattcatgaagaagacgacgcctgagattcggagaagcttgccggctgtgcagaagaaagcgcgcgttctcggaaagttaattcctggttgccggaaggtgtcgttcccgaagcttytagaagaagccggtgactatatttcggcgttggagatgcaagtgcgagccatgaaggctctygccgacctcctcgccaccggtgstccgccgccagctccgatcggtttgagttgaccgaagttgttaattyttactattaggtgtttyttcatatatcgtttatattagtttttag

SEQ ID NO: 48 - protein, 182 aa, Glycine max
  misc_feature: Ceres CLONE ID no.648076
  misc_feature: Bit score of 192.3 for HMM based on sequences of FIGURE 1.
  misc_feature: Functional Homolog Of Ceres SEEDLINE ID no. ME05268 at SEQ ID NO. 3
  misc_feature (49)..(49): Xaa is any aa, unknown, or other
  misc_feature (145)..(145): Xaa is any aa, unknown, or other
  misc_feature (165)..(165): Xaa is any aa, unknown, or other
  misc_feature (173)..(173): Xaa is any aa, unknown, or other
MDSLSLHSNLHSVNNKRRQITHQNSFALTPSWTSLTEQRLYSSKLLHSXRRNSNPTAALEVRASADRVLAATAKGRTRWSRAILSNPICRWKQRHHKKVKKYSANKFMKKTTPEIRRSLPAVQKKARVLGKLIPGCRKVSFPKLXEEAGDYISALEMQVRAMKAXADLLATGXPPPAPIGLS

SEQ ID NO: 49 - protein, 201 aa, Medicago truncatula
  misc_feature: Public GI ID no.92874556
  misc_feature: Bit score of 402.8 for HMM based on sequences of FIGURE 1.
  misc_feature: Functional Homolog Of Ceres SEEDLINE ID no. ME05268 at SEQ ID NO. 3
MTSPSTTIPNIVTNTDISRDTRRKKRKNKTQKHHQQDQIQINPKWKSQEQQQIYSTKLRQAITRVNSSSTPRRGKAVREAADRALAVTARGRTRWSRTILMTRLKIKFRKKKPNRVTALPSTRSKKSRVNVFRLKGKVVPSMQRKVRFLGGLVPGCKKEPLPVILEEAIDYIPALEMQVRAMSALFNLLSASTSGAGVSSG

SEQ ID NO: 50 - DNA, 1193 bp, Triticum aestivum
  misc_feature: Ceres CLONE ID no.749439
  misc_feature: Encodes the peptide sequence at SEQ ID NO. 51
atactcccaccatctccaccaccaccaccaccatcctctttctcccacccacctttaagccgccccatcccccgctgcgctgagtcacttcctcacgccacccgccgactgattgctcgatcgaggtgcggtgcgcggccatgatctctataggcgggtcctcctcgtcctcctcctccgccgccgcagcgggggtccggatgggcggggccaagcggcgggggaaaccgggcggggccgccgcgccgggggccgcgggcccgccgcagaccaggtggcggagcggcacgcaggagcggatctacggccggcgcctgctggacgcgctccgggccacgcggtcgggcgccgcctcgtccccgcagccgcgcgccgtcaaggccgccgccgactcggcgctggcgctcacggcgcgcgggcagtcgcgctggagccgcgccatcctgctggccggcgccgcgtcctgccgccgccgcgtgctcgtcaaggccggcgggaagatccgccgccaccgccgcccgcaggcgcgcgccgccgccgcggcgtccaaggccgcggccgccgcttccgccagcgaaccgccgttgctcaaggagaagaaggtgaaggaccggctccgcgtgctgggccggctcgtccccgggtgccggaagctgcaggcccccgacctgctcgaggagacggccgactacgtggccgcgctggagatgcaggtcaaggccatgcgcgcgctcgccgacgcgctcgcggcggcccagctgtcctcgcctcccccgccggccgccgccgccgccgacgaggccgagatggagaggtgagggtctgagcctcgcctcgcctccgagagggagattgatgacacgatggctcggggaaataaggcgattgattactggatggatggacggatggattgttaccgcgagagggggtcctgggattccaggagggtattgtgattccgatgatgatgattgctgctgctgctgctgctgctgatttgtaaattcttgatgctactacttgtataagtaatgctgctctgctcctctcctgtgttcttgaaatgttcttcctcctcctgaaacaagacggggggattcctgtgcctgtctgtctcctgcggattggattggattggaattggattatgcttttgtttggctgtgccacggtgaaaaaaaaaaaaaaaa

SEQ ID NO: 51 - protein, 225 aa, Triticum aestivum
  misc_feature: Ceres CLONE ID no.749439
  misc_feature: Bit score of 336.8 for HMM based on sequences of FIGURE 1.
  misc_feature: Functional Homolog Of Ceres SEEDLINE ID no. ME05268 at SEQ ID NO. 3
MISIGGSSSSSSSAAAAGVRMGGAKRRGKPGGAAAPGAAGPPQTRWRSGTQERIYGRRLLDALRATRSGAASSPQPRAVKAAADSALALTARGQSRWSRAILLAGAASCRRRVLVKAGGKIRRHRRPQARAAAAASKAAAAASASEPPLLKEKKVKDRLRVLGRLVPGCRKLQAPDLLEETADYVAALEMQVKAMRALADALAAAQLSSPPPPAAAAADEAEMER

SEQ ID NO: 52 - DNA, 1066 bp, Triticum aestivum
  misc_feature: Ceres CLONE ID no.1329161
  misc_feature: Encodes the peptide sequence at SEQ ID NO. 53
atctctcctccccctttcttcttcatactcccaccatctccaccaccaccaccaccaccaccatcttctcctttctcccacccacctttaagccgccccatcccccgctgcgctgactcacttcctcacgccacccgccgattgattgctcgatcgagctgcgcggccatgatctctataggcgggtcctcctcgtcgtcgtcgtccgccgcggcgggggtcaggatgggcggggccaagcggcgggggaaaccgggcggggccgccgcgccgggggccgcggggacgccgcagaccaggtggcgaagcggcacgcaggagcggatctacggccggcgcctgctggacgcgctgcgggccacgcggtcgggcgccgcctcgtccgcgcagccgccgcagccgcgcgccgtcaaggccgccgccgactcggcgctggcgctcacggcgcgcgggcagtcccgctggagccgcgccatcctgctggccggcgccgcgtcctgccgacgccgcgtgctcgtcaaggccggtggcaagatccgacgccaccgccgcccgccggcgcgcgcggccgccgcggcgtccgccggcgagccgccgttgctgaaggagcggaaggtgaaggaccggctccgcgtgctgggccggctcgtcccggggtgccggaagctgcaggcgcccgacctgctcgaggagacggccgactacgtggccgcgctggagatgcaggtcaaggccatgcgcgcgctcgccgatgcgctcgcggcggcccagctatcgtcgcctcccccgccggccgccgccggcgacgacgaggccgagatggagaggtgagggtctgagcctcgcctctgatgggggagattgatgatgacatgatggcgttgggctcggggaaataagggcgattaattactggatggatggatggattgttaccgcgagagtgggttctgggattccaggagggtattgtgattccgatgatgatgattgctgctgctgccgccgctgctgatttgtaaattcttgatgctactacttgtataagtaatgctgctctgctccg

SEQ ID NO: 53 - protein, 220 aa, Triticum aestivum
  misc_feature: Ceres CLONE ID no.1329161
  misc_feature: Bit score of 374.0 for HMM based on sequences of FIGURE 1.
  misc_feature: Functional Homolog Of Ceres SEEDLINE ID no. ME05268 at SEQ ID NO. 3
MISIGGSSSSSSSAAAGVRMGGAKRRGKPGGAAAPGAAGTPQTRWRSGTQERIYGRRLLDALRATRSGAASSAQPPQPRAVKAAADSALALTARGQSRWSRAILLAGAASCRRRVLVKAGGKIRRHRRPPARAAAAASAGEPPLLKERKVKDRLRVLGRLVPGCRKLQAPDLLEETADYVAALEMQVKAMRALADALAAAQLSSPPPPAAAGDDEAEMER

SEQ ID NO: 54 - DNA, 1154 bp, Triticum aestivum
  misc_feature: Ceres CLONE ID no.1030378
  misc_feature: Encodes the peptide sequence at SEQ ID NO. 55
tcatcccacccagcccctgcatgtgactcgcgaaaccgtcgtccatccagacgggagcgccagcgcgcgcgcaacaacagagccaactctcctctcagctcgcgctcccccggcaagccacgatggcgccctcctccaccacggcgtcggcggcggcggacgagagggaccgcaagcgcaagcgcggggccggcggcgaggcggggacggaggccgacgcggagagggcgcccaagtggcggacgcggcgggagcacgagatctactccaccaggctgctcgacgcgctgcgcctcgtgcgcgccggggctggcgtcgccccgtccccgtccccggcgcgccaggtgcgcgaggcggccgaccgcgcgctcgccgtcgccgcccgcggccgctcccgctggagccgcgccatcctcgcctctcgccgcgctcaccgcgtgcaccgagtgcgcctccacgctccggcccctgcgccggcgcctgctctaacacggcccgcttcacccggcgcgtcctcctccggctcgacctcggcacaggcacagacgctggcgaggaaggcgaagacgctggggcggctggtgccggggtgcaggaagctgccgttcccggcgctgctgtccgaggcgtccgactacatcgccgcgctggagatgcaggtgcgcgccatggccgcgctcgcgcaggcgctctccgccgtcgccccgccgccgtgatccatccatccggccgccacaaccccaagatcccccgcgaattgcctcgcctcagcgacgcgcgtcggcgcatgtacattttcctccccgtgccgtgccgctccagtgtgtgacgacgaatcgacgacacgccacgccacgccggcgattgtcaacccggccggccgcgtgcatgctaggaagaagaagaagaagaagaaacagtagccgttcatttgtagattcttgttagcgttttggttttggtttgggtgtgtgtccgctaagctaaatccgtaaatgcacgagagagatttccagtacaatctttcggagtgatgtgttctcatcagcaagcacgtacgagatcgccgttttctttgacaatgttggtgccagtgctttggtttgacaagcaaagtgcaatgttaatttatttattcaaaaaaaaaaaaaaaa

SEQ ID NO: 55 - protein, 197 aa, Triticum aestivum
  misc_feature: Ceres CLONE ID no.1030378
  misc_feature: Bit score of 369.1 for HMM based on sequences of FIGURE 1.
  misc_feature: Functional Homolog Of Ceres SEEDLINE ID no. ME05268 at SEQ ID NO. 3
MAPSSTTASAAADERDRKRKRGAGGEAGTEADAERAPKWRTRREHEIYSTRLLDALRLVRAGAGVAPSPSPARQVREAADRALAVAARGRSRWSRAILASRRAHRVHRVRLHAPAPAPAPALTRPASPGASSSGSTSAQAQTLARKAKTLGRLVPGCRKLPFPALLSEASDYIAALEMQVRAMAALAQALSAVAPPP

SEQ ID NO: 56 - DNA, 1148 bp, Zea mays
  misc_feature: Ceres CLONE ID no.1413787
  misc_feature: Encodes the peptide sequence at SEQ ID NO. 57
ctatttcccatcccaccacccaccctgccccgaccccgagcgcaaagccagcgcagcgcccatctccttcttcctcctcgttggatcgcagctccttgttcctcgcgtccgatacgccattttttccttctgcgagcaacaattcttggcgcgcgcgcgcactcgcaatggcgtccacgtccagctcgacgccagcggcggaggtggaggagaggggccggaagcggaagcgcgcggccggggcggcgccgacgcagccgtccgagtggcggacgcggcgcgagcacgagatctactcgtccaggctcctcgaggcgatccgcctcgtgcgcgcggggccctcctccgccgccgccgccaaggcggccccgacgcgcagcagggccgtgcgcgaggcggccgaccgcgcgctcgcggtcgcggcgcgcgggcgcacgcactggagccgcgccatcctcgcgtcccaccgccgccgcctccaggccgcgcaccgcgcgcgccttcgcgcccccgcgtccccgcctccgcgccacggcgcctccgcggcgaagggcaccgccgcgctgcctccggtggcgaggaaggccatggtgctgggccggctggtgcccggctgccggaagctgtcgtttccgacgctcctcgccgagaccacggactacatcgcggcgctccagatgcaggtccgcgccatgacggccctcgccgaggcgctgtccgccgtctcctcatcatcttccggcgccggctcttccccttcctcctcgccggcgtgaccaacattcgtggattcgttgtaaattttttttccgtctattttttccctcgccccgaatttttcctcgggattagttaaccgctagctttccctctttctagtttcctttgtcgtcttgtttctcccagttcggtgagcggttagtgttatgatgaagacgacgacgacgacgatggcgtcccagcgattaacccgtgctgtaatatgtgatagaagaagccgtagcccacagtggttttgctgtctctatcctctcctccctccggctcaggattcttttgtagcctggtttgttctcacctgcttcgattcgctctccgatgaatgcagcttgaaatgttggttcagatctaaaaaaaaaaaaaaaaaa

SEQ ID NO: 57 - protein, 202 aa, Zea mays
  misc_feature: Ceres CLONE ID no.1413787
  misc_feature: Bit score of 387.1 for HMM based on sequences of FIGURE 1.
  misc_feature: Functional Homolog Of Ceres SEEDLINE ID no. ME05268 at SEQ ID NO. 3
MASTSSSTPAAEVEERGRKRKRAAGAAPTQPSEWRTRREHEIYSSRLLEAIRLVRAGPSSAAAAKAAPTRSRAVREAADRALAVAARGRTHWSRAILASHRRRLQAAHRARLRAPASPPPRHGASAAKGTAALPPVARKAMVLGRLVPGCRKLSFPTLLAETTDYIAALQMQVRAMTALAEALSAVSSSSSGAGSSPSSSPA

SEQ ID NO: 58 - DNA, 972 bp, Zea mays
  misc_feature: Ceres CLONE ID no.295936
  misc_feature: Encodes the peptide sequence at SEQ ID NO. 59
acgtccaaaaaccaaccaaagcacacacactctgccggccaccatgccctcctctgcctccgctgacgccgagggcgcccgcagcaaacgcaaaagaggctcgtcggccgcatgcgcatccgacggcagcgaccagcagggcccgtcgtcccactggctgacgccgcgcgcgcagcaggcatactcctccaagctcctccaggcgctgcgcctcgtgcgcggcggcactggcacacccacctgccccgcctccgccccggcggtgcgcgacgcggcctaccgcgcgctggccgtggcggcgcggggccggtcgcgctggagccgcgccatcctggcacgcagccgccggcgccgggcgctcctccgcgcgcgccgacctccgcccccgacgccaaggcaccgtcagcggcggcatcagcagcagcaggacgagcggccggcgggagggctggctggcagggccaaggtgctggcgcggttggtgccagggtgccggagcctgtcgctgcccgcgctcctggccgaggtgtccgactacgtcgccgcactggagatgcaggtgcgcgccatgggccagctcacgcacgacctcgcgtcctcgtcttccgcgccgacgacggcgtcaacgatgattgctccgccatagctcggctcaggcgctcagctccttctcttggaatggatttggatggcaatggaaatgggatatgcctgtacatttcaactagctgttagagttgatcgatcgattttgcttggctttttttggattggttttggacaatatttgatttgatctgtctcttgctttgcttaaactgtaaggtctcctttggtcttgttatcatttgctaagactggcgctaaagaagtcgtgtaagctgaatgtgaagtcgtgtaagctgaatgtgaaatgatgcttcacaagtgtaaacgtgtgcgatgtttgaatgcaaaagcaagcaagtaacc

SEQ ID NO: 59 - protein, 200 aa, Zea mays
  misc_feature: Ceres CLONE ID no.295936
  misc_feature: Bit score of 175.1 for HMM based on sequences of FIGURE 1.
  misc_feature: Functional Homolog Of Ceres SEEDLINE ID no. ME05268 at SEQ ID NO. 3
MPSSASADAEGARSKRKRGSSAACASDGSDQQGPSSHWLTPRAQQAYSSKLLQALRLVRGGTGTPTCPASAPAVRDAAYRALAVAARGRSRWSRAILARSRRRRALLRARRPPPPTPRHRQRRHQQQQDERPAGGLAGRAKVLARLVPGCRSLSLPALLAEVSDYVAALEMQVRAMGQLTHDLASSSSAPTTASTMIAPP

SEQ ID NO: 60 - protein, 205 aa, Oryza sativa subsp. indica
  misc_feature: Public GI ID no.125543598
  misc_feature: Bit score of 410.9 for HMM based on sequences of FIGURE 1.
  misc_feature: Functional Homolog Of Ceres SEEDLINE ID no. ME05268 at SEQ ID NO. 3
MASTSGSAAAVEERGNSERKRKRGATGESEGSEAQPSKWRTRRAHEIYSSKLLDAIRLVRSGSPSSSAEAPPRSRAVRESADRALAVSARGRTRWSRAILASHRRRIQAARRARLREAISPPSRHPSSSSGKGPKAPALARKAKVLGRLVPGCRKLPFPALLAEASDYIAALEMQVRAMTALAEVLSTVSGSGSASSSGGSSSPA

SEQ ID NO: 61 - protein, 217 aa, Oryza sativa subsp. indica
  misc_feature: Public GI ID no.125525139
  misc_feature: Bit score of 216.0 for HMM based on sequences of FIGURE 1.
  misc_feature: Functional Homolog Of Ceres SEEDLINE ID no. ME05268 at SEQ ID NO. 3
MAKVRGKAGAGAGAAAAAATRTKWRSGAQERIYGRRLLDALRATRDGAAGGGGGAPPQPRAVKAAADSALALTARGQSRWSRAILLAGAASSRRRVLVKAGGKIRRGGGGNSCRRPQARAAAAAAAKAAAAASSAGEPPMLKERKVKERLRVLGRLVPGCRKLPAPALLEETADYVAALEMQVKAMRALADALAAAQLSSSTPQQAEAAADETEMER

SEQ ID NO: 62 - protein, 205 aa, Oryza sativa subsp. japonica
  misc_feature: Public GI ID no.115452643
  misc_feature: Bit score of 412.7 for HMM based on sequences of FIGURE 1.
  misc_feature: Functional Homolog Of Ceres SEEDLINE ID no. ME05268 at SEQ ID NO. 3
MASTSGSAAAVEERGNSERKRKRGATGESEGSEAQPSKWRTRRAHEIYSSKLLDAIRLVRSGSPSSSAAAPPRSRAVREAADRALAVSARGRTRWSRAILASHRRRIQAARRARLREAISPPSRHPSSSSGKGPKAPALARKAKVLGRLVPGCRKLPFPALLAEASDYIAALEMQVRAMTALAEVLSTVSGSGSASSSGGSSSPA

SEQ ID NO: 63 - protein, 177 aa, Oryza sativa subsp. japonica
  misc_feature: Public GI ID no.24059889
  misc_feature: Bit score of 224.8 for HMM based on sequences of FIGURE 1.
  misc_feature: Functional Homolog Of Ceres SEEDLINE ID no. ME05268 at SEQ ID NO. 3
MASSPTSTAPHDRKLDPAASPAARWRTRREQESYSSKLLDALRLVRAASGRPSPASSREVRHAADRALAVAARGRSRWSRAILASRARACALRRVRLGAPPPPPAARPAPRSRPPLASKAKVLGRLVPGCRKLAFPALLAEASDYIAALEMQVRAMAALAQALQSVAPAPPPPPSSS

SEQ ID NO: 64 - DNA, 612 bp, Sorghum bicolor
  misc_feature: Ceres ANNOT ID no.6012747
  misc_feature: Encodes the peptide sequence at SEQ ID NO. 65
atgatcacctctccgtctccctcgccgtcgccgtcgtcgtcgcggacgcccaacaagggcgggggcggctccgctacgccgccgccgccgcggagtctgcaggccagcaagtggcgcagcggcgcggtgcgcggggtgtacgggcggcgcctgctggacgcgctccgcgccacgggcgggggccagccgcgcgccgtgaaggcggcggcggactcggcgctggcgctgacggcgcgcggccagacgcggtggagccgcgctatcctgctggccggcgcggcctgcagccgccgccgcgtgctcgtcaaggcgggcggcaaggtccggaggcgccgccgcccgcctccgccggtgcaggccagagacaacgcggcgttgctcaagggcaagggcaagggcaaggagaagggcaaggtgcaggagcggctccgcgtgctgggccgcctcgtcccggggtgccggaagctccccgcgcctactctgctggaggaggccgccgactacgttgccgcgctgcagatgcaggtcagcgccatgcgcgcgctcgccgacgcgctggcggccgcgcagctgtcgtcgccgtcggacgcggacgcggaggcggggaggtga

SEQ ID NO: 65 - protein, 203 aa, Sorghum bicolor
  misc_feature: Ceres ANNOT ID no.6012747
  misc_feature: Bit score of 213.9 for HMM based on sequences of FIGURE 1.
  misc_feature: Functional Homolog Of Ceres SEEDLINE ID no. ME05268 at SEQ ID NO. 3
MITSPSPSPSPSSSRTPNKGGGGSATPPPPRSLQASKWRSGAVRGVYGRRLLDALRATGGGQPRAVKAAADSALALTARGQTRWSRAILLAGAACSRRRVLVKAGGKVRRRRRPPPPVQARDNAALLKGKGKGKEKGKVQERLRVLGRLVPGCRKLPAPTLLEEAADYVAALQMQVSAMRALADALAAAQLSSPSDADAEAGR

SEQ ID NO: 66 - DNA, 609 bp, Sorghum bicolor
  misc_feature: Ceres ANNOT ID no.6027628
  misc_feature: Encodes the peptide sequence at SEQ ID NO. 67
atgccctcctcctccgctgacgacgagggagcccgcggcaaacgcaagaggggatcgtcgggcgcatgcgcatccgacggcggcgaccaccagcagggcccgtcgttcatgtggcggacgccgcgcgcgcagcaggcctactcctccaagctcctccaggcgctgcgcctcgtgcgcggcggcggcaccggcacacccagcacctgctccgcctccgccccggcggtgcgcgacgcggcctaccgcgcgctggccgtggcggcgcggggccgctcgcgctggagccgcaccatcctggcacgcagccggcggtgccgggcgctccagtgcctccgcgcgcgccgaccgccgccgccgaggccccgtcggcggcagcagcagggtggcgacagcgagcagcgggcgccgggtgggctggctggcagggcgaaggtgctggggcggctggtgcccgggtgtcagagcctgtcgttgcccgcgctcctggccgaggtgtccgactacatcgccgcgctggagatgcaggtgcgcgccatgggccagctaacgcaggacctcgcctcgtcgtcttcggctccgacggcggcgccatggattgctccgccctag

SEQ ID NO: 67 - protein, 202 aa, Sorghum bicolor
  misc_feature: Ceres ANNOT ID no.6027628
  misc_feature: Bit score of 176.8 for HMM based on sequences of FIGURE 1.
  misc_feature: Functional Homolog Of Ceres SEEDLINE ID no. ME05268 at SEQ ID NO. 3
MPSSSADDEGARGKRKRGSSGACASDGGDHQQGPSFMWRTPRAQQAYSSKLLQALRLVRGGGTGTPSTCSASAPAVRDAAYRALAVAARGRSRWSRTILARSRRCRALQCLRARRPPPPRPRRRQQQGGDSEQRAPGGLAGRAKVLGRLVPGCQSLSLPALLAEVSDYIAALEMQVRAMGQLTQDLASSSSAPTAAPWIAPP

SEQ ID NO: 68 - DNA, 870 bp, Arabidopsis thaliana
  misc_feature: Ceres SEEDLINE ID no.ME06120
  misc_feature: Predicted Sequence
  misc_feature: Expected Sequence
  misc_feature: Encodes the peptide sequence at SEQ ID NO. 70
atggggaaatacataagaaagagcaaaatcgacggagctggagctggagctggtggtggaggtggaggcggaggtggaggtgaatcctctattgctttaatggatgttgtttcaccttcttcctcttcttcacttggtgttttaactcgagctaaatctctagctcttcaacaacaacaacaacgctgtcttcttcaaaaaccctcttctccttcttcgttaccaccgacttctgcttctcctaatccaccgtcaaagcagaagatgaagaagaagcagcagcagatgaacgattgtggttcgtatcttcagctacggagtcgtcggcttcagaagaaaccaccaattgttgtgattcgttctactaaacggaggaaacagcaacggaggaatgagacatgcggaagaaaccctaaccctaggagtaatttggattcgattcgtggtgatgggtctaggtctgattctgtttctgaaagtgttgtctttggtaaagacaaggatttgatttctgaaatcaataaagatccaacctttggccaaaatttcttcgaccttgaagaagaacacactcaaagcttcaacaggaccacaagggaatccacaccatgcagtttgataagaaggcctgaaatcatgacaaccccgggatcgtctacaaagcttaacatttgtgtaagtgaaagcaaccagagagaagacagtttgtcacgcagccatcgtcgccgaccaactacacctgaaatggacgagtttttctcgggtgctgaagaagaacaacagaagcaattcattgagaagtacaactttgatcctgtgaacgaacaaccactaccaggacggtttgaatggacgaaggtagatgattag

SEQ ID NO: 69 - DNA, 1855 bp, Arabidopsis thaliana
  misc_feature: Ceres SEEDLINE ID no.ME06120
  misc_feature: Genomic Sequence
  misc_feature: Expected Sequence
  misc_feature: Encodes the peptide sequence at SEQ ID NO. 70
atggggaaatacataagaaagagcaaaatcgacggagctggagctggagctggtggtggaggtggaggcggaggtggaggtgaatcctctattgctttaatggatgttgtttcaccttcttcctcttcttcacttggtgttttaactcgagctaaatctctagctcttcaacaacaacaacaacgctgtcttcttcaaaaaccctcttctccttcttcgttaccaccgacttctgcttctcctaatccaccgtcaaagcagaagatgaagaagaagcagcagcagatgaacgattgtggttcgtatcttcagctacggagtcgtcggcttcagaagaaaccaccaattgttgtgattcgttctactaaacggaggaaacagcaacggaggaatgagacatgcggaagaaaccctaaccctaggagtaatttggattcgattcgtggtgatgggtctaggtctgattctgtttctgaaagtgttgtctttggtaaagacaaggatttgatttctgaaatcaataaagatccaacctttggccaaaatttcttcgaccttgaagaagaacacactcaaaggtatcatctttcttcatcaatttcaacctaattttttgggggatttcttatttttatgaatctgtgtgaatttgttctgtttcttgagaaaactttggtattggatttgaaaatttccgttgttaatttgaaaaaaggatcaattttttgtcttgtatttggttaaaattgaaactggcgttttcgattttgaaatttaatgatatttttaccatgtgtatgatatgatgccatcttttctttatctgacaacaccagactcttctctctgtttccgggaaagaaaatatatataattaatcaaaaatgtgtttcttttttcttgagaaagtttttattttttcttcaattactttgaagaaggtgatagtgactattgttttttcttcagactttttatctgctttcatgtaaagaatgttggatttgtgtttgaaatgtctctgtaagtaactctttaaagtttggttcgtttttgggattctgcaaagtatatgatgtgtctctgtaacatcttaagttctagtttctctgtcttttaatttttcttgctgtttggttgttttttgatgttatgatttcagtctaaagtcgtgatcttgttgaacattgtatgagtcattaacttttcaagcattgctgaagtaatcttcattggaagtttcttctttggttttatgctttgtgaactttgaaccacaaatcaacaaggagtttctccttgtccttttttcagttaaacatgacttgcttagttttagttatctatatgcaataaagtttgcttgcttttgctgctaattaaggaaacacggttatgtgctttttccttgagagcattgtatgaaagtaacatattacttactctcagcttcaacaggaccacaagggaatccacaccatgcagtttgataagaaggcctgaaatcatgacaaccccgggatcgtctacaaagcttaacatttgtgtaagtgaaagcaaccagagagaagacagtttgtcacgcagccatcgtcgccgaccaactacacctgaaatggacgagtttttctcgggtgctgaagaagaacaacagaagcaattcattgagaagtatgtgtttcctcgtttcatctgttctgttcttttggttatgagtttccagtttgttctgttcttctcttttggtcttgtgtctctaatggtttctgtcaactctttcttcaggtacaactttgatcctgtgaacgaacaaccactaccaggacggtttgaatggacgaaggtagatgattag

SEQ ID NO: 70 - protein, 289 aa, Arabidopsis thaliana
  misc_feature: Ceres SEEDLINE ID no.ME06120
  misc_feature: Bit score of 470.8 for HMM based on sequences of FIGURE 2.
  misc_feature (239)..(288): Pfam Name: CDI Pfam Description: Cyclin-dependent kinase inhibitor
MGKYIRKSKIDGAGAGAGGGGGGGGGGESSIALMDVVSPSSSSSLGVLTRAKSLALQQQQQRCLLQKPSSPSSLPPTSASPNPPSKQKMKKKQQQMNDCGSYLQLRSRRLQKKPPIVVIRSTKRRKQQRRNETCGRNPNPRSNLDSIRGDGSRSDSVSESVVFGKDKDLISEINKDPTFGQNFFDLEEEHTQSFNRTTRESTPCSLIRRPEIMTTPGSSTKLNICVSESNQREDSLSRSHRRRPTTPEMDEFFSGAEEEQQKQFIEKYNFDPVNEQPLPGRFEWTKVDD

SEQ ID NO: 71 - DNA, 1252 bp, Gossypium hirsutum
  misc_feature: Ceres CLONE ID no.1975934
  misc_feature: Encodes the peptide sequence at SEQ ID NO. 72
agctttaagcttctttcttcgaaaaccaaaacccaaaacccttgaaacaaaatttcaaaccccaaaaatcccaaatgggtaagtacattaggaaggccaaaacggcaggggaggttgccgtaatggaactttcccaggcttctctcggggttcggacaagggccaaaaccctcgcccttcaacgcctacagaaatcctccacttcttctccgcctacggttgtttcggctccggctacaggagacggctcgtttctccagctgcggagtcgacggttagagaaaccgccgcttgtggtgcaccatcatgtttcgaagaggcacaagcagcagcaacaggggagtaagaaggatagctgtgtgcagaatcctaaccctaattcgtattctagggttcgaccgtgtggcggttcgaattcggaaaagaaaaaaggtgaagacattgtgcaagaagataatggaaatgataatattattaactacagcaatcttaacaataatcataatgaaagcaatgattttggtggtgttgaagcttcttttggagaaaatattttggacatggaagctagagagaggggcactagggaatcaactccttgcagcttgataagggactcggagagtataagaaccccaggttctgctactaggcctaccaactcagcagatactaaccagagagtacagaattcaacgcagcgacatacaccaacatcacatgaaatggatgagttcttttctctcacagaagaagaccagcaaagacaattcattgagaagtacaacttcgatccagtgaaagataagccacttcccgggcgttatcaatgggagaaaatggacccctaaacgaccattaacattccatcaggacccatatttcctgctagaatctcagttgatcttaaaattaggtattttcagctagcaggatttagtactagttgtaaagttgtaaaggctgacggtgttagttccatgttccatctcccttattttacttgtaaaaaaaagtaggaccgttgaagaaatgtgtcgactaactgtttgtaacagaacaacggtaacgatttacacatacacaaaaaaatacgaatcgaatcctttgtttaacagatcatctgagaagggaagggaatgagggtgtaagttggagtttaggaattgttagagtttcgtccttgtttgtttatacttgtactgatggaactttgaaacactctttggactaaaaaaaaaaaaaaaaaaaa

SEQ ID NO: 72 - protein, 258 aa, Gossypium hirsutum
  misc_feature: Ceres CLONE ID no.1975934
  misc_feature: Bit score of 508.7 for HMM based on sequences of FIGURE 2.
  misc_feature (208)..(257): Pfam Name: CDI Pfam Description: Cyclin-dependent kinase inhibitor
  misc_feature: Functional Homolog Of Ceres SEEDLINE ID no. ME06120 at SEQ ID NO. 70
MGKYIRKAKTAGEVAVMELSQASLGVRTRAKTLALQRLQKSSTSSPPTVVSAPATGDGSFLQLRSRRLEKPPLVVHHHVSKRHKQQQQGSKKDSCVQNPNPNSYSRVRPCGGSNSEKKKGEDIVQEDNGNDNIINYSNLNNNHNESNDFGGVEASFGENILDMEARERGTRESTPCSLIRDSESIRTPGSATRPTNSADTNQRVQNSTQRHTPTSHEMDEFFSLTEEDQQRQFIEKYNFDPVKDKPLPGRYQWEKMDP

SEQ ID NO: 73 - DNA, 1186 bp, Gossypium hirsutum
  misc_feature: Ceres CLONE ID no.1835084
  misc_feature: Encodes the peptide sequence at SEQ ID NO. 74
atttatttcttctctctctcatatgagagcttgagccttgagccttgagccttaagctttaagcttctttcttcgaaaaccaaaacccaaaacccttgaaacaaaatttcaaaccccaaaatcccaaatgggtaagtacattaggaaggccagaacggcaggggaggttgccgtaatggaactctcccaggcttctctcggggttcggaccagagccaaaaccctcgcccttcaacgcctacagcaatcctccacttcttctccgcctacggttgtttcgtctccggctacaggagacggctcgtttctccagctgcggagtcgacggttagagaaaccgccgcttgtggtgcaccaccatgtttcgaagaggcacaagcagcagcaacaggggagtaagaaggatagctgtgtgcagaatcctaaccctaattcgtattctagggttcgaccgtgtggcggctcgaattcggaaaagaaaaaaggtgaagacattgtacaagaagataatggaaatgataatattattaactacagcaatcttaacaacaatcataatgaaagcaatgattttgatggtgttgaagcttcttttggggaaaatattttggacatggaagctagagagaggggcactagggaatcaactccttgcagcttgataagggacttggagagtataagaaccccaggttctgctactaggcctcccaactcagcagatactaaccagagagtacagaattcaacgcggcgatatacaccaacatcacatgaaatggatgagttcttttctctcacagaagaagaccagcaaagacaattcattgagaagtacaactttgatccagtgaaagataagccacttcccgggcgttatcaatgggagaaaatggacccctaaacgaccattaacattccatcaggacccatatttcctgctagaatctcagttgatcttaaaattaggtattttcagctagcaggatttagtactagttgtaaagttgtaaaggctgacggtgttagttccatgttccatcttccttattttacttgtaaaaaaaagtaggacctttgaagaaatgtgtcgactaactgtttgtaacaaaacaacggtaacgatttacatatacacaaaaaaatacgaatcgaatcctttgtttaaaaaaaaaaaaaaaaaaaa

SEQ ID NO: 74 - protein, 258 aa, Gossypium hirsutum
  misc_feature: Ceres CLONE ID no.1835084
  misc_feature: Bit score of 495.7 for HMM based on sequences of FIGURE 2.
  misc_feature (208)..(257): Pfam Name: CDI Pfam Description: Cyclin-dependent kinase inhibitor
  misc_feature: Functional Homolog Of Ceres SEEDLINE ID no. ME06120 at SEQ ID NO. 70
MGKYIRKARTAGEVAVMELSQASLGVRTRAKTLALQRLQQSSTSSPPTVVSSPATGDGSFLQLRSRRLEKPPLVVHHHVSKRHKQQQQGSKKDSCVQNPNPNSYSRVRPCGGSNSEKKKGEDIVQEDNGNDNIINYSNLNNNHNESNDFDGVEASFGENILDMEARERGTRESTPCSLIRDLESIRTPGSATRPPNSADTNQRVQNSTRRYTPTSHEMDEFFSLTEEDQQRQFIEKYNFDPVKDKPLPGRYQWEKMDP

SEQ ID NO: 75 - DNA, 1071 bp, Gossypium hirsutum
  misc_feature: Ceres CLONE ID no.1846153
  misc_feature: Encodes the peptide sequence at SEQ ID NO. 76
aacaaaaacaaattctctctctctctctctctctcaaagaaagggaaaaaaaaaaagagagatcaagagtttctattttcctattttaattatgaggagaaagtgtagaacaattggagaaattgcagttatggaactagctgacgtcagagatcaaacgcgagccgtggcaacaaccggaagtgttcagaagaaacgcagaagattaaacgacggcaacgaagaagaggaatgtagaaaagtaacttcttctacgacctcaactacatcttatatccagttaagaagtcggacaattctggcggatcgccatcgtcgtgacggcaatcggtgtttgagccttaactcggatcatgatgatgacgtgtcgtgttgttcaagcaatattgaatcgagtgataaaaggattatggaattgccagatctggaggatgagagtattgaagttgaaacgtccacgcatttcagcagcagcgaaagagaaacgacaccgttgaatgagctccgagctgaaccagaagacctggattcaacgtcgaggccatcagagacgaattctcgccataggtcaacggtggagaaaatgccaaccgaagctgaactcgaagaattctttgctcctgccgaggaaaaacttcagaaacagtttgcagataagtataacttcgatattgtcaaagatgaaccgttggaaggacgttacgagtggattcgattaaagccatgaataaaatgtcaaccaattactaatttatttagacgaggcgatttgtcttaggtactgttactaatttaaaattttaggttctttttacatttctagggtttcttcttactacagaatgacgaagaagaagaaaatgaagcttctttccgataaaagaaaattgtaggaaatcccctaaaattcgtgtctgtttcttctgctaaattctgctgtttctctcttcattctttctctggtacggcgccactgctttcgtcagttgtagaaattcttatgttttgtagttatttttatgcattaatttaatttaataaaatttataacaaaaaaaaaaaaaaaaaaaa

SEQ ID NO: 76 - protein, 211 aa, Gossypium hirsutum
  misc_feature: Ceres CLONE ID no.1846153
  misc_feature: Bit score of 95.6 for HMM based on sequences of FIGURE 2.
  misc_feature (161)..(210): Pfam Name: CDI Pfam Description: Cyclin-dependent kinase inhibitor
  misc_feature: Functional Homolog Of Ceres SEEDLINE ID no. ME06120 at SEQ ID NO. 70
MRRKCRTIGEIAVMELADVRDQTRAVATTGSVQKKRRRLNDGNEEEECRKVTSSTTSTTSYIQLRSRTILADRHRRDGNRCLSLNSDHDDDVSCCSSNIESSDKRIMELPDLEDESIEVETSTHFSSSERETTPLNELRAEPEDLDSTSRPSETNSRHRSTVEKMPTEAELEEFFAPAEEKLQKQFADKYNFDIVKDEPLEGRYEWIRLKP

SEQ ID NO: 77 - DNA, 1058 bp, Gossypium hirsutum
  misc_feature: Ceres CLONE ID no.1930884
  misc_feature: Encodes the peptide sequence at SEQ ID NO. 78
aaaaatcctaaatattttctctctctctctctctctctctctctctctctctctctccttcttccccctttcactgtcagactacaaaaatttggcccctccattttccctcctctgtttaaagaagaaagcaccccttttgctaacaatcataaactgtttttttttctcactgaaaacagggccaaaaaaacacaaaagtttttttttgggggggggggtgtaaagtttcaatgaagaagtctaagataacaggagacgtagcagtaatggaagtttctcatcgttcaacaatggggtctcgaaccagagctgctaaaactctagctttacaaaggctttcaaaaacaactcaagtcacccaaattgttggttcgaaccaagatgtttcttccttgtcttatcttcaactgaggaaccgtaggttggaaaagctggcttcccctgtttccagtaaaacgaaacagagacaagaagagaaagaaagtgggttcagggaagaagaggaaggaaagaatggtggaaagaaaaataaagggtgttttgggaatagggaaattgttcttgaagtagggatttgttgtggaacagaacaagctatggattttgaactcagagacaggagcactagagaaagcacaccatgtagcttaacaaaggacttgaaaacaatcccatccccggggctggtgaacgatgtgctacagtctgtcccgtcaacgcaagaaatggaggagttcttcgtctacgcggaacaacaacaacatcgacggttcatcgagaagtataactttgatattgtgaatgatttgccacttcaaggacgttatgactgggtgaaaataatcccataatcctccattaatgtaaaaaaagattgatttgagccttgactaagatttgtgtaattttaaaaaattacacttaacctcatttacatacctcaaaacatgatagcctggtaggaatttgctgttttttttagtttcatcattgtaatgttaggacagcatcaatgaatcaatgttttctgggtttaaaaaaaaaaaaaaaaaaaa

SEQ ID NO: 78 - protein, 206 aa, Gossypium hirsutum
  misc_feature: Ceres CLONE ID no.1930884
  misc_feature: Bit score of 199.0 for HMM based on sequences of FIGURE 2.
  misc_feature (158)..(205): Pfam Name: CDI Pfam Description: Cyclin-dependent kinase inhibitor
  misc_feature: Functional Homolog Of Ceres SEEDLINE ID no. ME06120 at SEQ ID NO. 70
MKKSKITGDVAVMEVSHRSTMGSRTRAAKTLALQRLSKTTQVTQIVGSNQDVSSLSYLQLRNRRLEKLASPVSSKTKQRQEEKESGFREEEEGKNGGKKNKGCFGNREIVLEVGICCGTEQAMDFELRDRSTRESTPCSLTKDLKTIPSPGLVNDVLQSVPSTQEMEEFFVYAEQQQHRRFIEKYNFDIVNDLPLQGRYDWVKIIP

SEQ ID NO: 79 - DNA, 723 bp, Populus balsamifera subsp. trichocarpa
  misc_feature: Ceres ANNOT ID no.1529913
  misc_feature: Encodes the peptide sequence at SEQ ID NO. 80
atgaggaaggctaaaacgacaaatgatttaaccgtggtcgacttgagttgtggtgtccgtacccgagccaaaaccctagctctcaagaaacaacaagccctcagattgcatgcttcctctgcctctcctcctcccccctcgtctcccgccggctacctccagcttcgcagccgccgtcttgagaagaaaccacctccagttccatcattgcatcatggctccccgcgaaggcagcagcagagactgggtggtcagaacaataacaaattggggcagcaagaaagccctagccctattttgaaaccgagttcgcgggtggataaagattccgggtcgagtcaagagagagaagggggggagagtaaagaggttgaagagaataataacagcaatagtaaagacttgggttcttttggagataatgttttggacattgaaagtagagataggagcactagggaatccactccttgcaatttaacaagaggcacagaagacacaagaacccctggttctactactaagcctgctagcccaactgaaagtagccggagattacagaactcaatgcaaagacgcatcccaacaacccgtgaaatggatgagttctttggcccagctgaagaagagcagctaaggcaattcactgagaagtataactttgaccctgttagtgacaagccgctccctggacgttatgaatgggagaaattggatccctag

SEQ ID NO: 80 - protein, 240 aa, Populus balsamifera subsp. trichocarpa
  misc_feature: Ceres ANNOT ID no.1529913
  misc_feature: Bit score of 421.8 for HMM based on sequences of FIGURE 2.
  misc_feature (190)..(239): Pfam Name: CDI Pfam Description: Cyclin-dependent kinase inhibitor
  misc_feature: Functional Homolog Of Ceres SEEDLINE ID no. ME06120 at SEQ ID NO. 70
MRKAKTTNDLTVVDLSCGVRTRAKTLALKKQQALRLHASSASPPPPSSPAGYLQLRSRRLEKKPPPVPSLHHGSPRRQQQRLGGQNNNKLGQQESPSPILKPSSRVDKDSGSSQEREGGESKEVEENNNSNSKDLGSFGDNVLDIESRDRSTRESTPCNLTRGTEDTRTPGSTTKPASPTESSRRLQNSMQRRIPTTREMDEFFGPAEEEQLRQFTEKYNFDPVSDKPLPGRYEWEKLDP

SEQ ID NO: 81 - DNA, 1005 bp, Populus balsamifera subsp. trichocarpa
  misc_feature: Ceres ANNOT ID no.1493858
  misc_feature: Encodes the peptide sequence at SEQ ID NO. 82
atgggcaagtacatgaggaaagctaaaaccacaagcgatgtagccgtcatggacttgactcacggtgtccgtacacgagccagaaccctagctctcaagaaacaacaaggggtcaaagcatctcctccatcgtctcctgctggttacctccagcttcgcagccgccgtctcgagaagaaaccgcccccaattccgtcattgcatcatgattctcccagaaggagcactagggaatcgactccttgcaatttaacaagaggcacagaagacgcaagaacccctggttctactactaagcctgcaaacccaactgaaagtagcaggaggttacataactcaactcgaagacacatcccaacggcccatgaaatggatgagttctttggcccggctgaagaagagcagctaaggcaatttactgagaagtataactttgaccccgttagtgacaagcctctccatggacgttatgaatgggagaaattggatcaagtagcaggaattagtagtggtgttcaaacggtggtggtggtgttatttccattttccatcgcctgttcttttagttgtaaagaaagtagggggctatggggggttactcaacaaaatacaaaccaaagtcctatgtctaacagatcatctgagaggggaagtgaaaaagatgtagatggtgtagcccaatttggaagaatcttgccttctcatcgagctccacttttcacttccatgtctgcaactttcatactttactgtgcaaatttgtgcaggctgaagttggtgaagctaccgttgctagcaagcaagccgcccttctcagccctcgcaactctcacactctctgactctcaggctccccaacgccacacccagatcagaactaacaaaaaatatcaatcttcactcctgctgatcttcagttttgtgtttaaagataacttaaaagattcattgccagaaacaaatgtgaatttgtgtttaaaagagggaaagagaacagaagcttag

SEQ ID NO: 82 - protein, 334 aa, Populus balsamifera subsp. trichocarpa
  misc_feature: Ceres ANNOT ID no.1493858
  misc_feature: Bit score of 286.4 for HMM based on sequences of FIGURE 2.
  misc_feature (114)..(163): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKAKTTSDVAVMDLTHGVRTRARTLALKKQQGVKASPPSSPAGYLQLRSRRLEKKPPPIPSLHHDSPRRSTRESTPCNLTRGTEDARTPGSTTKPANPTESSRRLHNSTRRHIPTAHEMDEFFGPAEEEQLRQFTEKYNFDPVSDKPLHGRYEWEKLDQVAGISSGVQTVVVVLFPFSIACSFSCKESRGLWGVTQQNTNQSPMSNRSSERGSEKDVDGVAQFGRILPSHRAPLFTSMSATFILYCANLCRLKLVKLPLLASKPPFSALATLTLSDSQAPQRHTQIRTNKKYQSSLLLIFSFVFKDNLKDSLPETNVNLCLKEGKRTEA

SEQ ID NO: 83 - DNA, 1125 bp, Populus balsamifera subsp. trichocarpa
  misc_feature: Ceres ANNOT ID no.1498646
  misc_feature: Encodes the peptide sequence at SEQ ID NO. 84
atgggcaagtacatgaagaaatccaaaatcacaagcgatgttgttgctgtcatggaagtaacctctggtgtccgtacaagagccaaaacccatgctttacagctactccagtctcctgtttcttctaacccagatgctacttccacctgttacctccagctaaggagccgccgcctggaaaaaccaccgccactcttcaatgctgaaaccaaaaggaaccccgccaaggagaaggacagtttcagctgtaaaggggcttctaggctgagagtgaattcttccagcactactggtgattgcgatgaaaagggcactggaaagtcgggtttcaaatgtgaaacagaggattctggaagtttaaaagaggcttcttctggagacaactgtttctatttcgaaaggtgcaccagggaaagcacaccatgtagcttgataagggactcagaaaccatagcaaccccgggttcaaccacaagacagagaagctcaactgcgggcagccagagacttttgaacacgcagagaaatatcccgacaacatgtgaaatggatgagttttttgctggtgtagaacagcaacagcagagactatttattgagaagtatgctggctttaactcttctattcaagagtacaactttgatatcgtgaatgatctgccgctatctgggcgctacgaatgggtccgagattctgaaagaagtgacttgcatcttcttgctttatataatctcatcatctatctcccttgcaagctcatgctaagtgaatggaagccatggaagatgttcaactcgaagatctgtaacacaacagagctggttctgatggggatgtctcgcctctctaaatctaaagataagattgtttgtaccctacttgccttggccgcatacgagatgtgctcatggtggtggtggtggtgctgctgctgcttagaggtgatgatggtgatagtagttacctggtcccactgtgtttggacatttgggtttaaaatcaacagtgatgttgataaggtaggaccagaccagaccagaccggaggttgtggcctgcaagaagatgctcttgcttcgacaagaggaaatgcctcccaagactggccctttttcacatcattaa

SEQ ID NO: 84 - protein, 357 aa, Populus balsamifera subsp. trichocarpa
  misc_feature: Ceres ANNOT ID no.1498646
  misc_feature: Bit score of 205.2 for HMM based on sequences of FIGURE 2.
  misc_feature (156)..(215): Pfam Name: CDI Pfam Description: Cyclin-dependent kinase inhibitor
  misc_feature: Functional Homolog Of Ceres SEEDLINE ID no. ME06120 at SEQ ID NO. 70
MEVTSGVRTRAKTHALQLLQSPVSSNPDATSTCYLQLRSRRLEKPPPLFNAETKRNPAKEKDSFSCKGASRLRVNSSSTTGDCDEKGTGKSGFKCETEDSGSLKEASSGDNCFYFERCTRESTPCSLIRDSETIATPGSTTRQRSSTAGSQRLLNTQRNIPTTCEMDEFFAGVEQQQQRLFIEKYAGFNSSIQEYNFDIVNDLPLSGRYEWVRDSERSDLHLLALYNLIIYLPCKLMLSEWKPWKMFNSKICNTTELVLMGMSRLSKSKDKIVCTLLALAAYEMCSWWWWWCCCCLEVMMVIVVTWSHCVWTFGFKINSDVDKVGPDQTRPEVVACKKMLLLRQEEMPPKTGPFSHH

SEQ ID NO: 85 - DNA, 1587 bp, Populus balsamifera subsp. trichocarpa
  misc_feature: Ceres ANNOT ID no.1440974
  misc_feature: Encodes the peptide sequence at SEQ ID NO. 86
atgggcaagtacatgaggaaagctaaaaccacaagcgatgtagccgtcatggacttgactcacggtgtccgtacacgagccagaaccctagctctcaagaaacaacaaggggtcaaagcatctcctccatcgtctcctgctggttacctccagcttcgcagccgccgtctcgagaagaaaccgcccccaattccgtcattgcatcatgattctcccagaaggcagcatcataggcagggtggtcagaatagtagtaaattgggtcagcagcagcagcaagaagaagtagaaatccctagccctaatctgaaatcgagttccgggtcgggtcaagaaaaagaaaggggagagagtaaagtggacagtagagaagttgaagagaataataacagcaacagtaaagacttgggttcttttggagataatgttttggatattgaagttaaaaatgggttgttgctttctgtggaagtgttttcaactagttatatctatgattgggaggttcctgtcatctttgcagaatttacgtggcctaagctgcctggaaaattgagcggcaatgtctttaatggcttggaaaaattcaagagcactagggaatcgactccttgcaatttaacaagaggcacagaagacgcaagaacccctggttctactactaagcctgcaaacccaactgaaagtagcaggaggttacataactcaactcgaagacacatcccaacggcccatgaaatggatgagttctttggcccggctgaagaagagcagctaaggcaatttactgagaagtataactttgaccccgttagtgacaagcctctccatggacgttatgaatgggagaaattggatcaagtagcaggaattagtagtggtgttcaaacggtggtggtggtgttatttccattttccatcgcctgttcttttagttgtaaagaaagtagggggctatggggggttactcaacaaaatacaaaccaaagtcctatgtctaacagatcatctgagaggggaagtgaaaaagatgtagatggtgtagcccaatttggaagaatcttgccttctcatcgagctccacttttcacttccatgtctgcaactttcatactttactgtgcaaatttgtgcaggctgaagttggtgaagctaccgttgctagcaagcaagccgcccttctcagccctcgcaactctcacactctctgactctcaggctccccaacgccacacccagatcagaactaacaaaaaatatcaatcttcactcctgctgatcttcagttttgtgtttaaagataacttaaaagattcattgccagaaacaaatgtgaatttgtgtttaaaagagggaaagagaacagaagatttgtgcaagatgaagaaaggaatccaccctcaaatgcaatggatatcctatgtgactcaagatggcagattaatgcatgctatgatgacaaaaatacaccatgttggcaacgtctaccacttcagagcaaaacggcaaatggctgaaagtttaggtcagattgccaagtttaagcgtcggtacgggcaggagaatgcagaagatgctgaaaagtga

SEQ ID NO: 86 - protein, 528 aa, Populus balsamifera subsp. trichocarpa
  misc_feature: Ceres ANNOT ID no.1440974
  misc_feature: Bit score of 339.2 for HMM based on sequences of FIGURE 2.
  misc_feature (237)..(286): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKAKTTSDVAVMDLTHGVRTRARTLALKKQQGVKASPPSSPAGYLQLRSRRLEKKPPPIPSLHHDSPRRQHHRQGGQNSSKLGQQQQQEEVEIPSPNLKSSSGSGQEKERGESKVDSREVEENNNSNSKDLGSFGDNVLDIEVKNGLLLSVEVFSTSYIYDWEVPVIFAEFTWPKLPGKLSGNVFNGLEKFKSTRESTPCNLTRGTEDARTPGSTTKPANPTESSRRLHNSTRRHIPTAHEMDEFFGPAEEEQLRQFTEKYNFDPVSDKPLHGRYEWEKLDQVAGISSGVQTVVVVLFPFSIACSFSCKESRGLWGVTQQNTNQSPMSNRSSERGSEKDVDGVAQFGRILPSHRAPLFTSMSATFILYCANLCRLKLVKLPLLASKPPFSALATLTLSDSQAPQRHTQIRTNKKYQSSLLLIFSFVFKDNLKDSLPETNVNLCLKEGKRTEDLCKMKKGIHPQMQWISYVTQDGRLMHAMMTKIHHVGNVYHFRAKRQMAESLGQIAKFKRRYGQENAEDAEK

SEQ ID NO: 87 - DNA, 1387 bp, Arabidopsis thaliana
  misc_feature: Ceres CLONE ID no.1189183
  misc_feature: Encodes the peptide sequence at SEQ ID NO. 88
gcccaatctctctttctttctctctgatgaaaagctaacggaaaatggggaaatacataagaaagagcaaaatcgacggagctggagctggagctggtggtggaggtggaggcggaggtggaggtgaatcctctattgctttaatggatgttgtttcaccttcttcctcttcttcacttggtgttttaactcgagctaaatctctagctcttcaacaacaacaacaacgctgtcttcttcaaaaaccctcttctccttcttcgttaccaccgacttctgcttctcctaatccaccgtcaaagcagaagatgaagaagaagcagcagcagatgaacgattgtggttcgtatcttcagctacggagtcgtcggcttcagaagaaaccaccaattgttgtgattcgttctactaaacggaggaaacagcaacggaggaatgagacatgcggaagaaaccctaaccctaggagtaatttggattcgattcgtggtgatgggtctaggtctgattctgtttctgaaagtgttgtctttggtaaagacaaggatttgatttctgaaatcaataaagatccaacctttggccaaaatttcttcgaccttgaagaagaacacactcaaaggaccacaagggaatccacaccatgcagtttgataagaaggcctgaaatcatgacaaccccgggatcgtctacaaagcttaacatttgtgtaagtgaaagcaaccagagagaagacagtttgtcacgcagccatcgtcgccgaccaactacacctgaaatggacgagtttttctcgggtgctgaagaagaacaacagaagcaattcattgagaagtacaactttgatcctgtgaacgaacaaccactaccaggacggtttgaatggacgaaggtagatgattagaaacaacaaaaaaatggggggttaatagttaatacagaatatattaacattttcctgctaattatcggtttgatcttattaccatcatccgttttcttaactttttcaacatgtaaagagcttaggagaaaaaacccatgtagtgtttttaaattggtgtctgtaacataagtggctgaaaagggtttgtgtaacagaacttgataccaatcctttttaagcctatacagatcaccttagtagtagtactaaagccataagagaaggtttttagaagtaacccaaagtctgtttagggtttagcgtttagggtttagagttctttcggtttaagggtcagtgttttcttttatgaattccggtacagggggactctgcattctcttaaaactctttgtcctgtaaccattttaaaaaatctatccttttatgtgtatacatgtactgatctcaaactcttttcaataaagacttatccttct

SEQ ID NO: 88 - protein, 286 aa, Arabidopsis thaliana
  misc_feature: Ceres CLONE ID no.1189183
  misc_feature: Bit score of 465.7 for HMM based on sequences of FIGURE 2.
  misc_feature (236)..(285): Pfam Name: CDI Pfam Description: Cyclin-dependent kinase inhibitor
  misc_feature: Functional Homolog Of Ceres SEEDLINE ID no. ME06120 at SEQ ID NO. 70
MGKYIRKSKIDGAGAGAGGGGGGGGGGESSIALMDVVSPSSSSSLGVLTRAKSLALQQQQQRCLLQKPSSPSSLPPTSASPNPPSKQKMKKKQQQMNDCGSYLQLRSRRLQKKPPIVVIRSTKRRKQQRRNETCGRNPNPRSNLDSIRGDGSRSDSVSESVVFGKDKDLISEINKDPTFGQNFFDLEEEHTQRTTRESTPCSLIRRPEIMTTPGSSTKLNICVSESNQREDSLSRSHRRRPTTPEMDEFFSGAEEEQQKQFIEKYNFDPVNEQPLPGRFEWTKVDD

SEQ ID NO: 89 - protein, 286 aa, Arabidopsis thaliana
  misc_feature: Public GI ID no.26450253
  misc_feature: Bit score of 460.1 for HMM based on sequences of FIGURE 2.
  misc_feature (236)..(285): Pfam Name: CDI Pfam Description: Cyclin-dependent kinase inhibitor
  misc_feature: Functional Homolog Of Ceres SEEDLINE ID no. ME06120 at SEQ ID NO. 70
MGKYIRKSKIDGAGAGAGGGGGGGGGGESSIALMDVVSPSSSSSLGVLTRAKSLALQQQQQRCLLQKPSSPSSLPPTSASPNPPSKQKMRKKQQQMNDCGSYLQLRSRRLQKKPPIVVIRSTKRRKQQRRNETCGRNPNPRSNLDSIRGDGSRSDSVSESVVFGKDKDLISEINKDPTFGQNFFDLEEEHTQRTTRESTPCSLIRRPEIMTTPGSSTKLNICVSESNQREDSLSRSHRRRPTTPEMGEFFSGAEEEQQKQFIEKYNFDPVNEQPLPGRFEWTKVDD

SEQ ID NO: 90 - protein, 222 aa, Arabidopsis thaliana
  misc_feature: Public GI ID no.15239719
  misc_feature: Bit score of 323.7 for HMM based on sequences of FIGURE 2.
  misc_feature (172)..(221): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMKKSKITGDISVMEVSKATAPSPGVRTRAAKTLALKRLNSSAADSALPNDSSCYLQLRSRRLEKPSSLIEPKQPPRVHRSGIKESGSRSRVDSVNSVPVAQSSNEDECFDNFVSVQVSCGENSLGFESRHSTRESTPCNFVEDMEIMVTPGSSTRSMCRATKEYTREQDNVIPTTSEMEEFFAYAEQQQQRLFMEKYNFDIVNDIPLSGRYEWVQVKP

SEQ ID NO: 91 - protein, 189 aa, Arabidopsis thaliana
  misc_feature: Public GI ID no.15230194
  misc_feature: Bit score of 135.2 for HMM based on sequences of FIGURE 2.
  misc_feature (143)..(188): Pfam Name: CDI Pfam Description: Cyclin-dependent kinase inhibitor
  misc_feature: Functional Homolog Of Ceres SEEDLINE ID no. ME06120 at SEQ ID NO. 70
MGKYIKKSKVAGAVSVKDKSHPPALGFRTRAAAAKNLALHRLRSHSDEADSFNYLQLRSRRLVKLPLLTNTRKQQKQQLIPSVNQCQTKNPRASSGPAKKLEPDTTTEEACGDNERISRSDCNFGDKGFDLESENRSMISDSKSIQSEIEDFFASAEQQQQRFFIQKYNFDIVSDNPLPGRYEWVKVMP

SEQ ID NO: 92 - DNA, 938 bp, Brassica napus
  misc_feature: Ceres CLONE ID no.977794
  misc_feature: Encodes the peptide sequence at SEQ ID NO. 93
attttatttttctcgcctcgcttccctcctcgaagctttttccctctcattctctctttcccgctctcgagctaagcttccccctctcccccaaaatsaacctcccaaaatgggcaaatacatgaagaaatcgaaggttaccaacaacgacacggaacccaccgagccaacttctctgggagttcgcaccagagccgctaaaaccctagctttgaagcggctcaattcctccgcctctgattccgctttggccggagactcctcttgctaccttcagctccgcagccgccgcctcgagaaaccaatggcgctgacggagccgaaacagccgccgagaattaaggagtctgcctcgaagggtcgggttaactccggctcgggctcggttcgtgtagacggagatgattggttcggaaagtctgatgctttttgtggagagaacagtcctgattttgaatcgagacaaagcacaagggagagcacgccttgtaactttactgaggatctggagatcattgttacaccagggtctagcacaaagtcgatgcgcacagcaaccagagattgcataagggaccgagatagctcagtcccatcaactagtgaactggaggagttytttgcctatgccgagcagcaacagcagaggctgttcatggacaagtacaacttcgacattgtgaatgatatgcccctcactggacgctacgagtgggtacaagtcagtccatgaagttcaaagggagcmagctccagtgacatggtgtggaagtagaatgtggtgaatttaacagactaaccgaacatcgaaatcctttataaaggagtgtaatyttaagtaataatgcggttagaaaacaagttggtaaaagtagattaragacctgaacctcmcaccatttgtactaatytyttttggtgaatttaratgcttagtg

SEQ ID NO: 93 - protein, 207 aa, Brassica napus
  misc_feature: Ceres CLONE ID no.977794
  misc_feature: Bit score of 383.1 for HMM based on sequences of FIGURE 2.
  misc_feature (157)..(206): Pfam Name: CDI Pfam Description: Cyclin-dependent kinase inhibitor
  misc_feature: Functional Homolog Of Ceres SEEDLINE ID no. ME06120 at SEQ ID NO. 70
  misc_feature (170)..(170): Xaa is any aa, unknown, or other
MGKYMKKSKVTNNDTEPTEPTSLGVRTRAAKTLALKRLNSSASDSALAGDSSCYLQLRSRRLEKPMALTEPKQPPRIKESASKGRVNSGSGSVRVDGDDWFGKSDAFCGENSPDFESRQSTRESTPCNFTEDLEIIVTPGSSTKSMRTATRDCIRDRDSSVPSTSELEEXFAYAEQQQQRLFMDKYNFDIVNDMPLTGRYEWVQVSP

SEQ ID NO: 94 - DNA, 1143 bp, Glycine max
  misc_feature: Ceres CLONE ID no.630905
  misc_feature: Encodes the peptide sequence at SEQ ID NO. 95
aaaaaaattttccctctctctctcaaattttctctccctcaaaaaacccttcactcctttccctctcttttctaattttttttttagattcacccaaaacccgacaacccacacatggggaagtacatgaagaagtccaaaatcgccggtgacgtcgccgccgtgatcatggaggctccgccgccgcactcccacctcggcgtccgcacccgcgccaagactctcgccctccagaatacctccccggactcctccgcctacctccagctccgcagccgccgcctcctcaagctcccccctaccccgccggaaaatccccgccgctccgccgccgaaaccgccgccaattcccgcctcgccaaaacgacgtcgtcccgtaacgccgaaaagttcgcatctttcgatgacgacaacaataccgaatgctctttcggcgaaaatttcttagacgccgaacccagggaggaaaggagcaccagggaaagcaccccttgtagttttataagggactcaaatgccattcatacccctggttcaaccacaaggccaaggactcgccaaataatccatgagcacatccaaagaaacattccaacggcttatgagatggaggagttctttgcttatgccgagaagcagcaacaaacaatatttatggacaagtacaatttcgacattgtcaatgaagtacctctgcctggacggtacgagtgggtcccagtactccactaggagtgtcatatggtgataatatgggatttcaagagccattagacttgtattttaattttaacaactagaagaagctttgactaaccatttagattgcttgaggctcttgtttaacaagctacaagggaaaggatctgtttagaaatttccaatatccgattagtagtttagtagtgtctttctgatctgtagggtgtagggggggtatatggtatatctagtttctaagtcatctttaatgtaatttcattaccttctgtttatataattcagcggggattagacatgatgttcttgtagagaggtagtactcatccatcttagttcttcatgctggaaatttggcttactgaagttttaaccttggggaccatcttaatgaatgtcttaatgtcaaaaaaaaaaaaaaaa

SEQ ID NO: 95 - protein, 205 aa, Glycine max
  misc_feature: Ceres CLONE ID no.630905
  misc_feature: Bit score of 273.7 for HMM based on sequences of FIGURE 2.
  misc_feature (157)..(204): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMKKSKIAGDVAAVIMEAPPPHSHLGVRTRAKTLALQNTSPDSSAYLQLRSRRLLKLPPTPPENPRRSAAETAANSRLAKTTSSRNAEKFASFDDDNNTECSFGENFLDAEPREERSTRESTPCSFIRDSNAIHTPGSTTRPRTRQIIHEHIQRNIPTAYEMEEFFAYAEKQQQTIFMDKYNFDIVNEVPLPGRYEWVPVLH

SEQ ID NO: 96 - protein, 180 aa, Glycine max
  misc_feature: Public GI ID no.42362378
  misc_feature: Bit score of 276.6 for HMM based on sequences of FIGURE 2.
  misc_feature (132)..(180): Pfam Name: CDI Pfam Description: Cyclin-dependent kinase inhibitor
  misc_feature: Functional Homolog Of Ceres SEEDLINE ID no. ME06120 at SEQ ID NO. 70
MAQVKARARTALAMAASASSRKRRKISINNNFVQIKSLSNATVPATGERISGESPASCCSSIGSVDDENRIIKFSDLEVESTRVVTSTCDCGEQQQQIRREISLTSELRITNSSSQEVDSAEEQITQTKSLPPQKMPTELELDEFFAAAEKDIRKRFSDKYNYDIVKGVSLEGRYEWVKL

SEQ ID NO: 97 - protein, 166 aa, Glycine max
  misc_feature: Public GI ID no.42362389
  misc_feature: Bit score of 151.2 for HMM based on sequences of FIGURE 2.
  misc_feature (118)..(166): Pfam Name: CDI Pfam Description: Cyclin-dependent kinase inhibitor
  misc_feature: Functional Homolog Of Ceres SEEDLINE ID no. ME06120 at SEQ ID NO. 70
MEMAQVKARARTALAMAASASSPKRRKISFVQIKSLSNATSPTTEERISGESPASCCSSNGSFDNENRIIKSSDLEVESAQVETWTCNCGEQQQQKIRREMSLTREVDSTEEHITKTKSRCVPTESELEDFFAAAEKDIQKRFTDKYNYDFVKDMPLEGRYEWVQL

SEQ ID NO: 98 - protein, 223 aa, Medicago truncatula
  misc_feature: Public GI ID no.70906129
  misc_feature: Bit score of 133.4 for HMM based on sequences of FIGURE 2.
  misc_feature (174)..(222): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMKKLKSKSESPSPNSTPTPSPSPSPTPITTNSPPPTTPNSSDGVRTRARTLALENSNNQNQNLSVSSDSYLQLRNRRLKRPLIRQHSAKRNKGHDGNPKSPIGDSIAEEKTVQKSPEPENAEFKENAEDTERSARETTPVHLIMRADVLRPPRPITRRTFPTEANPKTEQPTIPISREFEEFCAKHEAEQQREFMEKYNFDPVTEQPLPGRYEWEKVSP

SEQ ID NO: 99 - protein, 210 aa, Solanum lycopersicum
  misc_feature: Public GI ID no.23899378
  misc_feature: Bit score of 415.4 for HMM based on sequences of FIGURE 2.
  misc_feature (161)..(209): Pfam Name: CDI Pfam Description: Cyclin-dependent kinase inhibitor
  misc_feature: Functional Homolog Of Ceres SEEDLINE ID no. ME06120 at SEQ ID NO. 70
MGKYIRKTRKTEDVSPLGVLTRAKALALNGGDGGSYLELRSRRLVKPFTVLEGRRQKNGVPKNPNLVNPNPNQQIPNVCVNSEEGKGVKEMENQKEKEKSCLGPEDSFGENLLEFEGRKRTTRESTPCSLIRDSDNIQTPGSSTRRTNANEANGRVPNSIQPTIPTDLEMEEFFTRAEKEQQRKFIEKYNFDPVNEKPLPGRYEWVKVNH

SEQ ID NO: 100 - protein, 185 aa, Solanum lycopersicum
  misc_feature: Public GI ID no.23899381
  misc_feature: Bit score of 241.1 for HMM based on sequences of FIGURE 2.
  misc_feature (137)..(184): Pfam Name: CDI Pfam Description: Cyclin-dependent kinase inhibitor
  misc_feature: Functional Homolog Of Ceres SEEDLINE ID no. ME06120 at SEQ ID NO. 70
MGKYLRKSGHVMESSSLGVRTRSTTLALQRLQSSSSSTPPPSLPSASDSCYLQLRSRRLHKPPTPIPCPNSHPHSASVDEISFPDNNLHFQHTHRSTRESTPCSLVREVDEMVNPGSATRQTELNTTTQRRRNFILRNIPSAHEIEDFFTFAEQQQQRLFMDKYNFDVVNDVPLSGRYEWIRVNH

SEQ ID NO: 101 - protein, 156 aa, Nicotiana sylvestris
  misc_feature: Public GI ID no.15963346
  misc_feature: Bit score of 205.3 for HMM based on sequences of FIGURE 2.
  misc_feature (106)..(155): Pfam Name: CDI Pfam Description: Cyclin-dependent kinase inhibitor
  misc_feature: Functional Homolog Of Ceres SEEDLINE ID no. ME06120 at SEQ ID NO. 70
MEVSDDVDLDVPTTTTKKRKISSDGDVKLISPALLRCRSHTGVGDTPAGNLVSPSGSVNLKENDDDSNLDHDLASCCSRNGSTEENNVVASAESKEAKLSSERERTPEKMPSEKEIEDFFAVRQKAIFKRFREKYNFDFEKEEPSEGRYEWVRIGS

SEQ ID NO: 102 - protein, 163 aa, Nicotiana tomentosiformis
  misc_feature: Public GI ID no.15963344
  misc_feature: Bit score of 245.0 for HMM based on sequences of FIGURE 2.
  misc_feature (113)..(162): Pfam Name: CDI Pfam Description: Cyclin-dependent kinase inhibitor
  misc_feature: Functional Homolog Of Ceres SEEDLINE ID no. ME06120 at SEQ ID NO. 70
MRKCKGIEEVTIMEVSDVDLEVPTTTKKRKISSDGDVKLMSPPLLRCRSHSGVGDTPAGSLVSPSSSVNLNDASNLDHDLASYCLRNGSSEENSVIASAESKEAKLSSERQRTPEKMPSEKEIEEFFAARQKAILKRFRKKYNFDFEKEEPLEGRYEWVRIGS

SEQ ID NO: 103 - protein, 213 aa, Sorghum bicolor
  misc_feature: Public GI ID no.92429657
  misc_feature: Bit score of 457.8 for HMM based on sequences of FIGURE 2.
  misc_feature (163)..(212): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKGKVSGEVAVMEVPGGALLGVRTRSRTLALQRAQRPLDKGDAEDAAAEYLELRSRRLEKPHKDPLPPPSAPATKRGAGRKVATAAAAAAAPHGLAEDDVEVSFGENVLDFDAMERSTRETTPCSLIRNPEMISTPGSTTKSKTSNSMTSRRRMETSICRFIPSSHEMEEFFSAAEKQEQQSFREKYNFCPVNDCPLPGRYEWARLDC

SEQ ID NO: 104 - DNA, 1116 bp, Triticum aestivum
  misc_feature: Ceres CLONE ID no.746644
  misc_feature: Encodes the peptide sequence at SEQ ID NO. 105
accaatttacccgcgcctcgcttaaatccgccaggcgcacccaggggggcccaaaccctagcccgggccgcgccgcgcatgggcaagtacatgcgcaagcccaaggtctccggcgaggtggccgtcatggaggtcgccgccgcgccgctaggggtccgcacccgcgcacgagcgctcgcgatgcagaggcagccgcagggggcggcggtggccaaggaccagggggagtacctggagctcaggagtcggaagctcgagaagctgcccccgccgccgccggcggcgaggaggagggcggccgcggcggagcgtgtcgaggccgaggccgaggccgacgaggtgtccttcggtgagaacgtgctcgagtcggaggccatggggaggggtaccagggagacgacgccctgcagcttgattagggactcgggaacgataagcactcctggatccacaacaagaccgagccactcgaattcccatcgcagggtgcaagctccagcgcgccatattattccatgttcagcagagatgaatgagttcttctctgctgcggagcaaccgcaacagcaagccttcattgacaagtacaactttgatcctgtgaacgactgtcctctcccaggccgatacgagtgggtgaagctagactgataattctccaggaaggagagcaccatgtacttctccgctccctccaccttagcgtcgtggtaaaggcgcgccccgtcgtgttagctttgtttccgttgtaaaaagaattaggttagcctgtagtagcctcaatggtcgtgtaacatacagaagtaatgctgagttacaccctaatccctcaaactccaatgtaaccgttagcagctcattctgtaatgaccacctctagggcctgatcttatcatctgttaccagttgccagactaatgtagtagagctagctagatattgtatcacagcttaacttgtaatgtgggctgggctgcagtgccatctgcattccagtgttgtgctgcattgcacctgaagtgctgtaacttccgtctattaccttctggttcatggtatgtgaaaaggctggtgacggtgcttgaaattcaaaaaaaaataaaaaaaaaaaaaaaa

SEQ ID NO: 105 - protein, 190 aa, Triticum aestivum
  misc_feature: Ceres CLONE ID no.746644
  misc_feature: Bit score of 403.0 for HMM based on sequences of FIGURE 2.
  misc_feature (142)..(190): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKPKVSGEVAVMEVAAAPLGVRTRARALAMQRQPQGAAVAKDQGEYLELRSRKLEKLPPPPPAARRRAAAAERVEAEAEADEVSFGENVLESEAMGRGTRETTPCSLIRDSGTISTPGSTTRPSHSNSHRRVQAPARHIIPCSAEMNEFFSAAEQPQQQAFIDKYNFDPVNDCPLPGRYEWVKLD

SEQ ID NO: 106 - DNA, 882 bp, Zea mays subsp. mays
  misc_feature: Ceres CLONE ID no.298166
  misc_feature: Encodes the peptide sequence at SEQ ID NO. 107
gtcgcacagaatcccttggtgcaccctgcgagggcctcctcgaaaccctagcttgcccagcccctccgggccatgggcaagtacatgcgcaaggccaaggcttccagcgaggttgtcatcatggatgtcgccgccgctcctctcggagtccgcacccgagcgcgcgccctcgcgctgcagcgtctgcaggagcagcagacgcagtgggaggaaggtgctggcggcgagtacctggagctaaggaaccggaggctcgagaagctgccgccgccgccggcgaccacgaggaggtcgggcgggaggaaagcggcagccgaggccgccgcaactaaggaggctgaggcgtcgtacggggagaacatgctcgagttggaggccatggagaggattaccagggagacgacgccttgcagcttgattaacacccagatgactagcactcctgggtccacgagatccagccactcttgccaccgcagggtgaacgctcctccggtgcacgccgtcccaagttctagggagatgaatgagtacttcgctgccgaacagcgacggcaacagcaggatttcattgacaagtacaacttcgatcctgcaaacgactgccctctcccaggcaggtttgagtgggtgaagctagactgatggattcagagggacgagagagcagcaggcatggaatggaactcaccccccgctccctccacaccaccccagcgttgtggcagaggcgcataccgtcgtgttagcttcgtttctgctgtaaaaaaaacccttagtgttttatttagcatgtagccttaactggtcgtgtgttacagtacagaactgatgctgagttacaacaccctgatctgatccctcaactccaatgtaaccctt

SEQ ID NO: 107 - protein, 190 aa, Zea mays subsp. mays
  misc_feature: Ceres CLONE ID no.298166
  misc_feature: Bit score of 296.0 for HMM based on sequences of FIGURE 2.
  misc_feature (142)..(190): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKAKASSEVVIMDVAAAPLGVRTRARALALQRLQEQQTQWEEGAGGEYLELRNRRLEKLPPPPATTRRSGGRKAAAEAAATKEAEASYGENMLELEAMERITRETTPCSLINTQMTSTPGSTRSSHSCHRRVNAPPVHAVPSSREMNEYFAAEQRRQQQDFIDKYNFDPANDCPLPGRFEWVKLD

SEQ ID NO: 108 - DNA, 1272 bp, Zea mays subsp. mays
  misc_feature: Ceres CLONE ID no.623089
  misc_feature: Encodes the peptide sequence at SEQ ID NO. 109
accgcccgccctcccgcgcctttttccgctagccaacgcacggctgacggcaccacaaggcaagcccgcccgctctcggctctcgctctgctcctgccccccttctctctctctctctctctcctgcagcgctagcgagccctcgccttcccttccccattactcccaggattccccttgcgactgcaccacgccccacccaaacccacctaccgcctccgctcccctctccagcgagtcgggggcacggacgggacgggacgggaccagacgaccaggccatggggaagtacatgcgcaagggcaaggtgtccggggaggtcgccgtcatggaggtacccggcggcgcgctgctcggcgtccgcacccgctcccgcacgctcgcgctgcagcgcgcgcagaggccgctcgacaagggcgacgcggaggacgccgccgcggagtacctcgagctcaggagccggaggctcgagaagccgcacaaggagcatccgccgccgcccgcgcccgcgaccgcgaccaagaggggcgccgggaggaaggccgtcgccgccgcggcgcagcacgtgctgatggaggacgaggtcgaggtctcgttcggggacaacgtgcttgacttggacaccatggaaaggagtaccagagagacaacaccgtgcagcctgattaggaacccagagatgataagcaccccaggatccacaactaaaagcaaaaccagcagcaactcgacgacttcccgccgcagaacggaggaaaccccgagctgccggttcataccgagctcgctcgagatggaggagttcttctcggcggccgagcaacaggagcagcatagcttcagggagaagtacaacttctgtcccgtgaacgactgtcctctccctggccggtacgaatgggcgaggctagactgctagattccccacccagcacaagagcaccattgatctgattgatatgtgtctaccacaccacaatgtgactagcgccgccgccgccgccgtggaccgtggaggaggcgcaaccaactgtggatctcgatcgcattagctttgttgtctgttgtaaaaattagagtagttagctttgtagccggatgaatgattttgtgtaaccaacaggcgtggtcacacaacctcactgtaacctgttaactgctcaagctgctgtaaccgcgaaccgaatctcatgtagcgtaggcctagcgcagtcgtctcatctgttcctagctctcgaaattgattgaatggaattagagttagaatttgt

SEQ ID NO: 109 - protein, 212 aa, Zea mays subsp. mays
  misc_feature: Ceres CLONE ID no.623089
  misc_feature: Bit score of 456.0 for HMM based on sequences of FIGURE 2.
  misc_feature (162)..(211): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKGKVSGEVAVMEVPGGALLGVRTRSRTLALQRAQRPLDKGDAEDAAAEYLELRSRRLEKPHKEHPPPPAPATATKRGAGRKAVAAAAQHVLMEDEVEVSFGDNVLDLDTMERSTRETTPCSLIRNPEMISTPGSTTKSKTSSNSTTSRRRTEETPSCRFIPSSLEMEEFFSAAEQQEQHSFREKYNFCPVNDCPLPGRYEWARLDC

SEQ ID NO: 110 - DNA, 1126 bp, Zea mays
  misc_feature: Ceres CLONE ID no.1448390
  misc_feature: Encodes the peptide sequence at SEQ ID NO. 111
attcccgcgattcccccgcctcccgttgcccagctagctagctgcccacctcgccgccgccgcctcccgcccaccggaagcacaggaagcagagcaagccggcgccatgggcaagtacatgcgcaagagcaaggcctcgggggaggtggccgtcatggaggtcgccggcgcgctgctcggcgtccgcacccgctcccgcaccctcgccgcgcagcagcagcgcgctccgtccccttcgccgcagcgcaagggccacgaggacggcgactacctcgagctcaggagcaggaggctcgagaagcagccgccgccggggcccaaggacaaggaggacgcgccgcagccgccggccgccggtgggaggaggatggagcaggcgccgtcgtcgttcgccgccgagggcttcgaggccgacctcgaggtctccttcggcgacaacgtcctggactgggacgccaccgacaggggcgccagggagacgacgccgtgcagcctcatctacagctcggagacgatgagcacccccgggtcggcgaccggaggagcccgcaaccactcccgccgcagggcgcagacgccggtctgccgctacgtgccgagctcgctggagatggacgagttcttcgccgccgccgagcagcagcaacaccagaccttcagggacaagtacaacttctgtcctgcgagcggctgcccgctccccgggcggtacgagtggacggtgctagactgctagggcttcatacctcacaccaccaccaggagctcctccattgatccctgtagcaccaaaatgaccactaccagaagaagcagcagcagcagcagcttgtcatatgccgtgggcgcgatgcaaatgcaaatgcaaatgtagcgttaggttttctaattcacctgttgtaaaaacttagagttagcccgcagtcagtcagtcagtagtagctcagccagccagccatccatctctgagtgtaaggaacagcctgatccccaacctcactgtaacctcttagttaacaacatgtcatctccgtaggcttcaatttagcttgattagcagctcagttattctctgtgccccagtcctccatccatcaatgaaatcaatcagagctagattttttcc

SEQ ID NO: 111 - protein, 209 aa, Zea mays
  misc_feature: Ceres CLONE ID no.1448390
  misc_feature: Bit score of 329.0 for HMM based on sequences of FIGURE 2.
  misc_feature (161)..(208): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKSKASGEVAVMEVAGALLGVRTRSRTLAAQQQRAPSPSPQRKGHEDGDYLELRSRRLEKQPPPGPKDKEDAPQPPAAGGRRMEQAPSSFAAEGFEADLEVSFGDNVLDWDATDRGARETTPCSLIYSSETMSTPGSATGGARNHSRRRAQTPVCRYVPSSLEMDEFFAAAEQQQHQTFRDKYNFCPASGCPLPGRYEWTVLDC

SEQ ID NO: 112 - DNA, 706 bp, Musa acuminata
  misc_feature: Ceres CLONE ID no.1734216
  misc_feature: Encodes the peptide sequence at SEQ ID NO. 113
atgacttccgcgcttttcatcccatctcatactacgactgatcaagagagggagacagcgggatggggaagcattcgagcaagaggagacagatcggggaactcgcggtgatggaggcgacgaagccgatgggtgcgaggacgaggacggcgagaagactggccctcgcggcgttggacggccgccggagctcgaagaagaagaaagcgacgggagaataccaccagatctccaacctcgagctccgaagttgcagcgtcgtcctgaaacctcggatcgccagatccgcggcgaattccggcggccggcgaaattcaagccctgaactcagtctcatctcccggtcctccagcgacgcctcctgtgaggcagcggagacgccgtttcgatcatcggagcttggccaggaattggacgacgcgaccttcttccgctgcaatggagaaagggaagagacggccgcctcgagtaatgacggacaagcgacgagtgatcttgaatcaacggtggagatgggatcgcgcagaagatcgacggcgattgcaacaccctccgttgccgagctggaggagttcttcgcgggcgcagagagagacctgcgacggcgattcgtcgagaggtacaacttcgacgtcgtcaaggacgtgccattggccggccgctacgagtggattccgttgaccccgtgaacagggaggagaagaaa

SEQ ID NO: 113 - protein, 208 aa, Musa acuminata
  misc_feature: Ceres CLONE ID no.1734216
  misc_feature: Bit score of 93.6 for HMM based on sequences of FIGURE 2.
  misc_feature (158)..(207): Pfam Name: CDI Pfam Description: Cyclin-dependent kinase inhibitor
  misc_feature: Functional Homolog Of Ceres SEEDLINE ID no. ME06120 at SEQ ID NO. 70
MGKHSSKRRQIGELAVMEATKPMGARTRTARRLALAALDGRRSSKKKKATGEYHQISNLELRSCSVVLKPRIARSAANSGGRRNSSPELSLISRSSSDASCEAAETPFRSSELGQELDDATFFRCNGEREETAASSNDGQATSDLESTVEMGSRRRSTAIATPSVAELEEFFAGAERDLRRRFVERYNFDVVKDVPLAGRYEWIPLTP

SEQ ID NO: 114 - DNA, 1109 bp, Panicum virgatum
  misc_feature: Ceres CLONE ID no.1913678
  misc_feature: Encodes the peptide sequence at SEQ ID NO. 115
ctccccattattctactcccgggattcctttcctccccctgttgctgcgaccgcgacctgccgtcgcttgcctctgcttctcctcctcgcttcgcttccgaccaagctttcgagccagcggccgccgcagcaggggttcgggagacggggccaggccatggggaagtacatgcggaagggcaaggtgtccggggaggtcgccgtcatggaggtccccggcggcgcgctgctcggcgtccgcacgcgctcccgcacgctcgcgctgcagcgggcgcagaggccgcccgacaagggggaggcaggcgaggccgccggggagtacctcgagctccggagccggaggctcgagaagccgcccaaggagcaggcggcggcgcccgcgcccaagaatggcgccgctacgaaggccgctgccgccgcggcgtcgcccgcgctggccgaggacgaggtcgaggtgtccttcggggagaacgtgctcgacttcgattctatggaaaggaataccagagagacgacgccttgcagtttgattaggaactcagagatgataagcaccccaggatccacaactaaaagcaaaataagcagctcgatgacatcccgtcgcagaatggaaagctcagtctgtcgtttcataccgaattcactcgagatggaagagttcttcgcagcggctgaacagcatgagcagcataccttcagggagaagtataacttctgtcctgtgaacgacagccctcttcctggacggtatgaatggacgaggttaggatgctagattttcagcacaagagcttcattgatctgatatgtctacagcaatgactggtgtcgtggacgtggcgccaaccaactggattgcattagcctccttgtcttttgtaaaaattagattaattagcctgtagctgaatgatcgtgtgtaatgaacaggtccagcgctgacttacacacagatccccaaccttactgtaaccgttaactggtcaacgctcatgctgtaaccgaaccatctcatgtagtgtagtgtaggcctaatcctctgtgcctagtccttgaaccaaattaatgaattagagttatatttgcaaaaaaaaaaaaaaaaaaaa

SEQ ID NO: 115 - protein, 206 aa, Panicum virgatum
  misc_feature: Ceres CLONE ID no.1913678
  misc_feature: Bit score of 458.3 for HMM based on sequences of FIGURE 2.
  misc_feature (156)..(205): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKGKVSGEVAVMEVPGGALLGVRTRSRTLALQRAQRPPDKGEAGEAAGEYLELRSRRLEKPPKEQAAAPAPKNGAATKAAAAAASPALAEDEVEVSFGENVLDFDSMERNTRETTPCSLIRNSEMISTPGSTTKSKISSSMTSRRRMESSVCRFIPNSLEMEEFFAAAEQHEQHTFREKYNFCPVNDSPLPGRYEWTRLGC

SEQ ID NO: 116 - protein, 233 aa, Oryza sativa subsp. indica
  misc_feature: Public GI ID no.125542322
  misc_feature: Bit score of 362.0 for HMM based on sequences of FIGURE 2.
  misc_feature (185)..(232): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKGKVSGEVAVMEVGGALLGVRTRSRTLALQRTTSSQKPPEKGEGDPGAGAGAGAEYLELRSRRLEKPPPAHAAGQGEGDRQEGFRRRREDAGGAASGPRSSRRRSRCPSATTFLTSTATPWRVGTLAFENVCLQCSRSTRETTPCSLIRSSEMISTPGSTTKTNTSMSSRRRMETSVCRYVPSSLEMEEFFAAAEQQQHQAFRERYNFCPVNDCPLPGRYEWTRLDC

SEQ ID NO: 117 - protein, 253 aa, Oryza sativa subsp. indica
  misc_feature: Public GI ID no.125532331
  misc_feature: Bit score of 272.2 for HMM based on sequences of FIGURE 2.
  misc_feature (204)..(253): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKAKVVVSGEVVAAAVMELAAAPLGVRTRARSLALQKRQGGEYLELRSRRLEKLPPPPPPPPRRRATAAAATADATATESAEAEVSFGGENVLELEAMERIAPFVSLNCVKNTWVAPSPKYPRVGATCLQGTKGVPYERDEQVLRHFWFVILGARSSSRNTRETTPCSLIRDPDTISTPGSTTRRSHSSSHCKVQTPVRHNIIPASAELEAFFAAEEQRQRQAFIDKYNFDPVNDCPLPGRFEWVKLD

SEQ ID NO: 118 - protein, 262 aa, Oryza sativa subsp. indica
  misc_feature: Public GI ID no.125541233
  misc_feature: Bit score of 85.0 for HMM based on sequences of FIGURE 2.
  misc_feature (209)..(258): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKFRGATGEELAAMEVTQVVGVRTRSRSAAAAGATTTKVQAASAASTRRRKALLPTAVVGTTRRDGGSCYLQLRSRMLFMAPPRPAPAARAPVVAEAAGSGNGAAAHAAAGLSRCSSTASSVDAAAQDRSLACRSDVAEAGSEHVPEGSASDSASGRDRERRETTPSSFLPGEVSDLESDLAGGQKRSRPLPSAATASAQQATRPKIPPAAEIEAFFAAAEEAEAKRFAAKYNFDVVRGVPLDAGRFEWTPVVSSRS

SEQ ID NO: 119 - protein, 221 aa, Oryza sativa subsp. japonica
  misc_feature: Public GI ID no.115450609
  misc_feature: Bit score of 460.9 for HMM based on sequences of FIGURE 2.
  misc_feature (173)..(220): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKGKVSGEVAVMEVGGALLGVRTRSRTLALQRTTSSQKPPEKGEGDPGAGAGAGAEYLELRSRRLEKPPPHTPPAKEKETARRASAAAAAAVRMPAAPQAAEEFEAEVEVSFGDNVLDLDGDAMERSTRETTPCSLIRSSEMISTPGSTTKTNTSISSRRRMETSVCRYVPSSLEMEEFFAAAEQQQHQAFRERYNFCPVNDCPLPGRYEWTRLDC

SEQ ID NO: 120 - protein, 221 aa, Oryza sativa subsp. japonica
  misc_feature: Public GI ID no.125584844
  misc_feature: Bit score of 458.2 for HMM based on sequences of FIGURE 2.
  misc_feature (173)..(220): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKGKVSGEVAVMEVGGALLGVRTRSRTLALQRTTSSQKPPEKGEGDPGAGAGAGAEYLELRSRRLEKPPPHTPPAKEKETARRASAAAAAAVRIPAAPQAAEEFEAEVEVSFGDNVLDLDGDAMERSTRETTPCSLIRSSEMISTPGSTTKTNTSISSRRRMETSVCRYVPSSLEMEEFFAAAEQQQHQAFRERYNFCPVNDCPLPGRYEWTRLDC

SEQ ID NO: 121 - protein, 194 aa, Oryza sativa subsp. japonica
  misc_feature: Public GI ID no.115482472
  misc_feature: Bit score of 318.1 for HMM based on sequences of FIGURE 2.
  misc_feature (145)..(194): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKAKVVVSGEVVAAAVMELAAAPLGVRTRARSLALQKRQGGEYLELRSRRLEKLPPPPPPPPRRRATAAAATADATAAESAEAEVSFGGENVLELEAMERNTRETTPCSLIRDPDTISTPGSTTRRSHSSSHCKVQTPVRHNIIPASAELEAFFAAEEQRQRQAFIDKYNFDPVNDCPLPGRFEWVKLD

SEQ ID NO: 122 - protein, 194 aa, Oryza sativa subsp. japonica
  misc_feature: Public GI ID no.125575112
  misc_feature: Bit score of 313.1 for HMM based on sequences of FIGURE 2.
  misc_feature (145)..(194): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKAKVVVSGEVVAAAVMELAAAPLGVRTRARSLALQKRQGGEYLELRSRRLKKLPPPPPPPPRRRATAAAATADATAAENPEAEVSFGGENVLELEAMERNTRETTPCSLIRDPDTISTPGSTTRRSHSSSHCKVQTPVRHNIIPASAELEAFFAAEEQRQRQAFIDKYNFDPVNDCPLPGRFEWVKLD

SEQ ID NO: 123 - DNA, 576 bp, Sorghum bicolor
  misc_feature: Ceres ANNOT ID no.6003994
  misc_feature: Encodes the peptide sequence at SEQ ID NO. 124
atgggcaagtacatgcgcaaggtcaaggtttccggcgaggtcgccatcatggatgtgtcctccgctccgctcggagtccgcacccgcgcgcgcgccctcgcgctgcagcgcctgcagaagcagcaggcgcagggggaggagggcgccggcggcgagtacctggagctaaggagccggaggctcgagaagctgccgccaacagcagcgcccatgaggaggaaggccgcggccgcggcagccgccgctaaggaggaggtggaggcgtcgtacggggagaacatgctcgagttggaggccatggagaggggtaccagggagacgacgccctgcagcttgattaactctgagatgattgccactcccagaactcccgggtccacaacaagatccaatcactcttcccaccgcagggtgaaagctcctccggtgcacgccgtcccaagttcaagggagatgaatgagtacttcgctgctgaacagcgacgccaacaacaggctttcattgacaagtacaactttgatcctgtaaatgactgccctctcccaggcaggtttgaatgggtgaagctagactga

SEQ ID NO: 124 - protein, 191 aa, Sorghum bicolor
  misc_feature: Ceres ANNOT ID no.6003994
  misc_feature: Bit score of 334.6 for HMM based on sequences of FIGURE 2.
  misc_feature (143)..(191): Pfam Name: CDI Pfam Description: Cyclin-dependent kinase inhibitor
  misc_feature: Functional Homolog Of Ceres SEEDLINE ID no. ME06120 at SEQ ID NO. 70
MGKYMRKVKVSGEVAIMDVSSAPLGVRTRARALALQRLQKQQAQGEEGAGGEYLELRSRRLEKLPPTAAPMRRKAAAAAAAAKEEVEASYGENMLELEAMERGTRETTPCSLINSEMIATPRTPGSTTRSNHSSHRRVKAPPVHAVPSSREMNEYFAAEQRRQQQAFIDKYNFDPVNDCPLPGRFEWVKLD

SEQ ID NO: 125 - DNA, 642 bp, Sorghum bicolor
  misc_feature: Ceres ANNOT ID no.6068427
  misc_feature: Encodes the peptide sequence at SEQ ID NO. 126
atggggaagtacatgcgcaagggcaaggtgtccggggaggtcgccgtcatggaggtccccggcggcgcgctgctcggcgtccgcacccgctcccgcacgctcgcgctgcagcgcgcgcagaggccgctcgacaagggcgacgccgaggacgccgctgcggagtacctcgagctcaggagccggaggctcgagaagccgcacaaggacccgttaccgccgccgtctgcgcctgcgaccaagaggggcgccgggaggaaggtcgccaccgccgccgccgccgccgcggcgccgcacgggctggcggaggacgacgtcgaggtctccttcggcgagaacgtgctcgacttcgacgccatggaaaggagtaccagagagacaacaccgtgcagtttgattaggaacccagagatgataagcaccccaggatccacaactaaaagtaaaaccagcaactcgatgacttcccgtcgcagaatggaaacctcaatctgccgtttcataccaagttcgcatgagatggaagagttcttctcagcagctgaaaaacaggagcagcaaagcttcagggagaagtataacttctgtcctgtgaacgactgtcctcttccgggtcggtatgaatgggcgaggctagactgctag

SEQ ID NO: 126 - protein, 213 aa, Sorghum bicolor; identical to SEQ ID NO: 103
  misc_feature: Ceres ANNOT ID no.6068427
  misc_feature: Bit score of 457.8 for HMM based on sequences of FIGURE 2.
  misc_feature (163)..(212): Pfam Name: CDI Pfam Description: Cyclin-dependent kinase inhibitor
  misc_feature: Functional Homolog Of Ceres SEEDLINE ID no. ME06120 at SEQ ID NO. 70

SEQ ID NO: 127 - DNA, 1009 bp, Arabidopsis thaliana
  misc_feature: Ceres SEEDLINE ID no.ME09503
  misc_feature: Genomic Sequence
  misc_feature: Encodes the peptide sequence at SEQ ID NO. 129
atgggaagagggagaagttcatcgtcttcttcaatagagagtagcagcaagagcaacccattcggtgcttcgtcaagtactcgaaacctaagcacggacctgagactcggactcagcttcgggacatcctcagggactcaatatttcaacggtggctatgggtactccgttgcagctccggcggtagaggatgcggaatatgtggcggctgtggaggaggaagaagagaatgagtgtaacagtgtagggagcttttacgtgaaagtgaacatggaaggagttccaattggaagaaagatcgatctaatgtctcttaatggctaccgcgacttgatcagaacccttgatttcatgttcaacgcatccattctctgtaagtttctatgtatacataatgtcatatcagaatgatttatatgtcttagaggtagcaaatttctaacgatatttttttctttcttataagtccgttttgattttttttttttttttacggaatgaaaaaatacttccgctcattactattcttttgtttgaaggttaatatcgccgtaataatcgcccatcactatttcataggttgtttgtttgtttgtcaaaaaaaaaatctggataacgttatatgtcagagttattattccgtaggtagagtttatatattgcgcagtgtgtaagtactgtgtaatgggtaaattgtaaaaatgatgaaaactgatgggaattgaaaaaatggaaatatataggggctgaagaagaagacatgtgcaatgagaagagtcacgtgctaacgtacgcagataaggaaggtgactggatgatggttggagatgttccttgggagtaagcactcttttcatccttttttgtataattagattgttaattatgcagaaaattaactatatgatcatccttatatatatttttaatttgtgggttgattttttgcaggatgttcttgtctactgtgagaagactgaagatttcaagagctaattaccactactga

SEQ ID NO: 128 - DNA, 528 bp, Arabidopsis thaliana
  misc_feature: Ceres SEEDLINE ID no.ME09503
  misc_feature: Encodes the peptide sequence at SEQ ID NO. 129
atgggaagagggagaagttcatcgtcttcttcaatagagagtagcagcaagagcaacccattcggtgcttcgtcaagtactcgaaacctaagcacggacctgagactcggactcagcttcgggacatcctcagggactcaatatttcaacggtggctatgggtactccgttgcagctccggcggtagaggatgcggaatatgtggcggctgtggaggaggaagaagagaatgagtgtaacagtgtagggagcttttacgtgaaagtgaacatggaaggagttccaattggaagaaagatcgatctaatgtctcttaatggctaccgcgacttgatcagaacccttgatttcatgttcaacgcatccattctctgggctgaagaagaagacatgtgcaatgagaagagtcacgtgctaacgtacgcagataaggaaggtgactggatgatggttggagatgttccttgggagatgttcttgtctactgtgagaagactgaagatttcaagagctaattaccactactga

SEQ ID NO: 129 - protein, 175 aa, Arabidopsis thaliana
  misc_feature: Ceres SEEDLINE ID no.ME09503
  misc_feature: Bit score of 303.0 for HMM based on sequences of FIGURE 3.
  misc_feature (71)..(168): Pfam Name: AUX_IAA Pfam Description: AUX/IAA family
MGRGRSSSSSSIESSSKSNPFGASSSTRNLSTDLRLGLSFGTSSGTQYFNGGYGYSVAAPAVEDAEYVAAVEEEEENECNSVGSFYVKVNMEGVPIGRKIDLMSLNGYRDLIRTLDFMFNASILWAEEEDMCNEKSHVLTYADKEGDWMMVGDVPWEMFLSTVRRLKISRANYHY

SEQ ID NO: 130 - protein, 218 aa, Pinus taeda
  misc_feature: Public GI ID no.32396293
  misc_feature: Bit score of 248.4 for HMM based on sequences of FIGURE 3.
  misc_feature (94)..(217): Pfam Name: AUX_IAA Pfam Description: AUX/IAA family
  misc_feature: Functional Homolog Of Ceres SEEDLINE ID no. ME09503 at SEQ ID NO. 129
MSASVGGMEKSGTSAQQENNRSLDFAETELKLGLPGVATGERQRICGKRSFSEARESRKFSIPHEEAHKFHEPNLGTEKQMVRPANDPPKMGPPPPRKAQIVGWPPVKDFRKVRTIAASSSLYVKVSMDGAPYLRKVDLKMYSTYHDLSSALENMFGCLITMGKSGSHALNESNLFDVRNGSEYVPTYEDKDGDWMLVGDVPWDMFVDSCQRMRIMKA

SEQ ID NO: 131 - protein, 231 aa, Pinus taeda
  misc_feature: Public GI ID no.32396299
  misc_feature: Bit score of 265.5 for HMM based on sequences of FIGURE 3.
  misc_feature (26)..(228): Pfam Name: AUX_IAA Pfam Description: AUX/IAA family
  misc_feature: Functional Homolog Of Ceres SEEDLINE ID no. ME09503 at SEQ ID NO. 129
MSCSVGGMEKSSTGAQQENKCSLDIFAETELRLGLPGVAAGERQRICGKRSFSEAMESRNFSIPQEEAHKFHEPNLGTEKQMVRPANDPPKMGPTPPKAQIVGWPPVKDFRKVRTIAASSSLYVKVSMDGAPYLRKVDLKMYSTYHDLSSALENMFGCLITMGKCGSSGIKESNLMDVVNGSEYVATYEDKDGDWMLVGDVPWQMFVDSCQRVRIMKASEAIGLAPRAMEK

SEQ ID NO: 132 - protein, 302 aa, Pinus taeda
  misc_feature: Public GI ID no.32396295
  misc_feature: Bit score of 277.6 for HMM based on sequences of FIGURE 3.
  misc_feature (134)..(294): Pfam Name: AUX_IAA Pfam Description: AUX/IAA family
  misc_feature: Functional Homolog Of Ceres SEEDLINE ID no. ME09503 at SEQ ID NO. 129
MERFANDGDEHSLKETELRLGLPGVCESDTGLGQTRNGKRAFSEVMDSTKASSFNDNKWIFPSVKCQPPTSAITETAEACKGSQPGLFSATPGQKIMMQGGCGAPQSWAGDNGLSKSTAPKDELHPKTPRGGPTEKTNAASQSQAATDPAMAPAPKAQVVGWPPIRSFRKNTLAANSKPNDEGSSSNALYVKVSMDGAPYLRKVDLKMYSTYHELSSALEKMFSCFTMGQCGSPGLSESKLIDLLNGSEYVPTYEDKDGDWMLVGDVPWEMFVDSCKRLRITKASEAIGLAPRAMEKSRSKN

SEQ ID NO: 133 - protein, 190 aa, Gossypium barbadense
  misc_feature: Public GI ID no.34550779
  misc_feature: Bit score of 469.9 for HMM based on sequences of FIGURE 3.
  misc_feature (11)..(190): Pfam Name: AUX_IAA Pfam Description: AUX/IAA family
  misc_feature: Functional Homolog Of Ceres SEEDLINE ID no. ME09503 at SEQ ID NO. 129
MEGSVGYDNDLNLRATELRLGLPGTEPVSIVRSNKRSLQQVADDDCGVNGCRSDDQNETAPPPPKAQIVGWPPIRSYRKNNIQTKKNESEGGGIYVKVSMDGAPYLRKIDLKIYSGYPELLQAIENMFKFTIGEYSEREGYKGSDYAPTYEDKDGDWMLVGDVPWEMFITSCKRLRIMKGSEARGLGCGV

SEQ ID NO: 134 - DNA, 1290 bp, Gossypium hirsutum
  misc_feature: Ceres CLONE ID no.1855369
  misc_feature: Encodes the peptide sequence at SEQ ID NO. 135
gcttctctctcttctcacattagctattgtgttcttcattttgcttgttgtaactatttaaagataaggagtaagttcttaagtgtttcatactttgatgtctacacctttggaacatgattacataggtttggcagagacttcttcaatggaaagaagctctgagaagatatcttcttcttcttcctcttcaattccctccaatattgaagacaaaaccaccaacaatccttccctgaatctcaaagaaactgagctgaggcttggcttaccaggttctcagtcacctgagagaaagctgtctctttttggcaaagatttggagactaatgataaaagcaacggttttgttggtagccctttgaagaacttggtgtctggagctaaaaggggtttctcagatgccattgatgggtctaatgggaaatgggttttcgctataaatggtaaatctgatgtagagttgggtaaaggtgctgtcttggcctctcctagaggtggtttggacagtaaaaccaatccccaacaggtaaggacgtctgtgcctgtcatgaaagaggttgttggtgttccccagtctccaaaaccggttcaagataagaagaatcttgttcctcctgtaaatgaacatactagtgccccagctgcaaaggcacaggtggtaggatggccaccaatcagatcattcaggaagaacagcatggcctctaatttggcaaagaacagtgatgaagctgctggttgtctgtatgtaaaggtgagcatggatggagcaccatacttgaggaaggttgacctcaagacctacaataactatagggaattctcatcagctttggagaagatgttcagctgctttactatcgggcagtgcggttccaacggtgatggtctcagtgagagtcgtttgatggatcttctccacggatctgagtatgtgctgacatatgaagacaaggatggtgattggatgcttgttggtgatgttccatgggagatgttcaccgattcgtgtaggaggctacggataatgaaaggttcagaggcaatcggactagctccaagagccatggagaaatgcaagaaccagaactaatgcaaaagacctggaaaaaacacaggaaactttactcaacaactttatatacatatgtgtgtgctttcagatattacagtttgatgtatttagtagaagtaagagaaaaaggagattgtattaggcaaattatggcattgaagacatatccaattatttaaggttgtctggtttaaaaaaaaaaaaaaaaaaaa

SEQ ID NO: 135 - protein, 315 aa, Gossypium hirsutum
  misc_feature: Ceres CLONE ID no.1855369
  misc_feature: Bit score of 313.7 for HMM based on sequences of FIGURE 3.
  misc_feature (30)..(307): Pfam Name: AUX_IAA Pfam Description: AUX/IAA family
  misc_feature: Functional Homolog Of Ceres SEEDLINE ID no. ME09503 at SEQ ID NO. 129
MERSSEKISSSSSSSIPSNIEDKTTNNPSLNLKETELRLGLPGSQSPERKLSLFGKDLETNDKSNGFVGSPLKNLVSGAKRGFSDAIDGSNGKWVFAINGKSDVELGKGAVLASPRGGLDSKTNPQQVRTSVPVMKEVVGVPQSPKPVQDKKNLVPPVNEHTSAPAAKAQVVGWPPIRSFRKNSMASNLAKNSDEAAGCLYVKVSMDGAPYLRKVDLKTYNNYREFSSALEKMFSCFTIGQCGSNGDGLSESRLMDLLHGSEYVLTYEDKDGDWMLVGDVPWEMFTDSCRRLRIMKGSEAIGLAPRAMEKCKNQN

SEQ ID NO: 136 - DNA, 995 bp, Gossypium hirsutum
  misc_feature: Ceres CLONE ID no.1932235
  misc_feature: Encodes the peptide sequence at SEQ ID NO. 137
aaacacatgcatttgttcttcatcatcatctaccctttcttgaattatatatagcagaactcatagcaacatttccaaatatatacatatcaaccatagttcaatacatcgatctatcaatcaatgaatcagctatcaaccttcaatcaatcatggtgtttgagaaagatcttaaccttgatgcaacggagctccgattaggcctaccagcctcatcgaaggagtctcttaggatcagtaacaaaagagccttgcctgatatgaatgatgattctggtgtcgcagctgctaaaaaatgtgaccaagaaactgctccacccaccaaggcacaagttgtagggtggccaccgatccgatcatacagaaaaaacagccttcaaacaaagaaaactgaggctgaaacaagtggaatgtatgtcaaagttagcatggatggagctccttatcttagaaagattgatttaaaggtttataaaggatacccagaattgttcaaggccttggaagacatgttcaagttcaaagttggtaaatattcagaaagggaaggatacaatggatcagaatttgtgccaacttatgaagataaagatggtgattggatgttggctggagatgtaccatgggaaatgttcattaatgcttgcaaaaggctgaggatcgtgagaggatcagaagcaagaggcttgggctgtgttgtatgaaaacaaaataacccataaattgacaatttcgaagcctatttacaaatgattgagaaataagttgaggtccttttttttttttttgctttgggtttattggcaagaaagaaaaagaaacatttttttttcatgtatagtttggaaattggcatgttttgattttcgtggaatttgtacaaaggagaatacgattttccttttttttttccatgtatcatgtaacaaggaaaattatattattaattaaaaggatggattcatcccattttgtaaaaaaaaaaaaaaaaaaaa

SEQ ID NO: 137 - protein, 183 aa, Gossypium hirsutum
  misc_feature: Ceres CLONE ID no.1932235
  misc_feature: Bit score of 440.4 for HMM based on sequences of FIGURE 3.
  misc_feature (7)..(183): Pfam Name: AUX_IAA Pfam Description: AUX/IAA family
  misc_feature: Functional Homolog Of Ceres SEEDLINE ID no. ME09503 at SEQ ID NO. 129
MVFEKDLNLDATELRLGLPASSKESLRISNKRALPDMNDDSGVAAAKKCDQETAPPTKAQVVGWPPIRSYRKNSLQTKKTEAETSGMYVKVSMDGAPYLRKIDLKVYKGYPELFKALEDMFKFKVGKYSEREGYNGSEFVPTYEDKDGDWMLAGDVPWEMFINACKRLRIVRGSEARGLGCVV

SEQ ID NO: 138 - DNA, 1795 bp, Gossypium hirsutum
  misc_feature: Ceres CLONE ID no.1948456
  misc_feature: Encodes the peptide sequence at SEQ ID NO. 139
gtgttgggctctttctttcttgttagctggtgtttgtttcctgagaaagctaaaaaaaaatgcaggaatcttttgttctttgttaagctctaaaagctgaaagtttaaattccagttctttctcaccgtttttctcagcaaccaaacatgttacaaccctacaaagcttctttaatgtagtactatcatttcttctttaaaaaaaaaaacactcttttgctcttatttccccttttggcgcgtgcgtacggttgtgaagtattgagggtgtttattatttgttgtttttttataattactgatgtctccgccgctgcttggcgtggaggaggaaggggttcagagcaatgttactttactcggttcttcaggctcaatggaaagtgtgtgccagaatagtgctgaattgaaggaacggaactacatgggcttgtctgattgttcttcagtggatagctctgttttttcccctccctccgaggaaagaaaggctagtttgaatctaaaggcgactgagcttaggctcggacttcctggattgcagtcgcctgaaagaaatccagagctttgcttgttaagttcttctcagcttgatgagaagccgcttttccctttgcatccttcaagtgatggtcactgctttgcatcacagaagaatgttgtttcagggaataaaagagggttctctgatgcaatggatgggttctcagagggcaagtttctttccgattcaaaagttgatgttatgctgtcacctaggccttcttcaaacttcggggctcaatcaatgaaagcaaaagaaatcacaagccaaaacgtggtgcatgacaggcctcatgctgctgacaagatcaggcctaatcccaatgcatctgcaaacaataacagcggagcacctgctaacaaggcacaggttgtaggttggccacctatcagatcatttaggaagaactcattgtcctcggctttgaagaacactgatgaagtcgatggaaaggcaaggcctggtgctttgtttgtgaaggttagcatggatggtgctccgtatttgaggaaagtagacttgaaaaactacactaaatatcaggagctgtcttctgcacttgagaagatgttcagctgttttaccataggtcagtatggatctcatggaacctcgggcagggagctgttgagcgaaagcaagctcaaggatctacttcatggatcagaatatgttcttacttacgaggataaagatggtgactggatgcttgtgggtgatgttccatgggagatgttcactgacacctgcaaaaggttgaggatcatgaaaagctctgatgccattggactcgctccgagggccatggaaaaatgcaggaaccggaactagctaccatcatacatgatcttttcccacacaccgaagattattatttctgaaagagatgacatgatgctggagtgggtaggagatcatcatgtaagcctgtttttgttctactgaaaaaagtcgtatccagtgcgtaaggctaccgctataagcaagaactagaaattcccattgtaggcacaaccattgtcggtgtttgtagcgaataaacctgttagtctacattaagttataaaaccttcctagtcctagcgtttgtgagtaactttaagattctatcagtcatgagtccgaacgagtccctgtttcaaagcatgatctttttagtttgtaaagtgcattgcttgttgaacttttatggtgcgtgtttgaatgatgaaagacctcgacatattatcagaaaaaaaaaaaaaaaaaaaa

SEQ ID NO: 139 - protein, 357 aa, Gossypium hirsutum
  misc_feature: Ceres CLONE ID no.1948456
  misc_feature: Bit score of 278.5 for HMM based on sequences of FIGURE 3.
  misc_feature (66)..(349): Pfam Name: AUX_IAA Pfam Description: AUX/IAA family
  misc_feature: Functional Homolog Of Ceres SEEDLINE ID no. ME09503 at SEQ ID NO. 129
MSPPLLGVEEEGVQSNVTLLGSSGSMESVCQNSAELKERNYMGLSDCSSVDSSVFSPPSEERKASLNLKATELRLGLPGLQSPERNPELCLLSSSQLDEKPLFPLHPSSDGHCFASQKNVVSGNKRGFSDAMDGFSEGKFLSDSKVDVMLSPRPSSNFGAQSMKAKEITSQNVVHDRPHAADKIRPNPNASANNNSGAPANKAQVVGWPPIRSFRKNSLSSALKNTDEVDGKARPGALFVKVSMDGAPYLRKVDLKNYTKYQELSSALEKMFSCFTIGQYGSHGTSGRELLSESKLKDLLHGSEYVLTYEDKDGDWMLVGDVPWEMFTDTCKRLRIMKSSDAIGLAPRAMEKCRNRN

SEQ ID NO: 140 - DNA, 1634 bp, Gossypium hirsutum
  misc_feature: Ceres CLONE ID no.1920182
  misc_feature: Encodes the peptide sequence at SEQ ID NO. 141
acaagaatgcttgaaatttcttcagctttactggtttaagtccattcttttacatttgtctttatgatcttaactatttcactggattttgttaaaagaaaaaaaaaaggttgtgaagtattgagggtgtttattatttgttgtttttttataattactgatgtctccgccgctgcttggcgtggaggaggaagggattcagagcaatgttactttactcggttcttcaggctcaatggaaagtgtgtgccagaatagtgctgacttgaaggaacggaactacatgggcttgtctgattgttcttcagtggatagctctgttttttcccctccgtccgaggaaagaaaggctagtttgaatctaaaggcgactgagcttaggctcggacttcctggattgcagtcgcctgaaagaaatccagagctttgcttgttaagttcttctcagcttgatgagaagccgtttttccctttgcatccttcaagtgatggtcactgctttgcatcacagaagagtgttgtttcagggaataaaagagggttctctgatgcaatggatgggttctcagagggcaagtttctttctgattcaaaagttgatgttatgctgtcacctaggccttcttcaaacttcggggctcaaccaatgaaagctaaagaaatcacgagccaaaacgtggtgcatgacaggcctcatgctgctgacaagaccaggcctaatcccaatgcatctgcaaacaataacagtggagcacctgctaacaaggcacaggttgtaggttggccacctatcagatcatttaggaagaactcattggcctcggcgtcgaagaacactgatgaagtcgatgggaaggcagggcctggtgctttgtttgtgaaggttagcatggatggtgctccgtatttgaggaaagtagacttgaaaaactacactaaatatcaggagctgtcttctgcacttgagaagatgttcagctgttttaccataggtcagtatggatctcatggaacctcgggcagggagctgctgagcgaaagcaagctcaaggatctacttcatggatcagaatatgttcttacttacgaggataaagatggtgactggatgcttgtgggtgatgttccatgggagatgttcactgacacctgcaaaaggttgaggatcatgaaaagctctgatgccattggactcgctccgagggccatggaaaaatgcaggaaccggaactagctaccatcatacatgatcttttcccacacaccgaagattattatttctgaaagagatgacatgatgctggagtgggtaggagatcatcatgtaagcctgtttttgttctactgaaaaaagtcgtatccagtgcgtaaggctactgctataagcaagaactagaaattcccattgtaggcacaaccatttgtcggtgtttgtagcaaataaacctgttagtctacattaagttataaaaccttcctagtcctagcgtttgtgaggaactttaagattctatcagtcatgagtccgaacgagtccctgtttcaaagcatgatctttttagtttgtaaagtgcattgcttgttgaacttttatggtgcgtgtttgaatgatgaaagacctcgacatattatcc

SEQ ID NO: 141 - protein, 357 aa, Gossypium hirsutum
  misc_feature: Ceres CLONE ID no.1920182
  misc_feature: Bit score of 280.2 for HMM based on sequences of FIGURE 3.
  misc_feature (66)..(349): Pfam Name: AUX_IAA Pfam Description: AUX/IAA family
  misc_feature: Functional Homolog Of Ceres SEEDLINE ID no. ME09503 at SEQ ID NO. 129
MSPPLLGVEEEGIQSNVTLLGSSGSMESVCQNSADLKERNYMGLSDCSSVDSSVFSPPSEERKASLNLKATELRLGLPGLQSPERNPELCLLSSSQLDEKPFFPLHPSSDGHCFASQKSVVSGNKRGFSDAMDGFSEGKFLSDSKVDVMLSPRPSSNFGAQPMKAKEITSQNVVHDRPHAADKTRPNPNASANNNSGAPANKAQVVGWPPIRSFRKNSLASASKNTDEVDGKAGPGALFVKVSMDGAPYLRKVDLKNYTKYQELSSALEKMFSCFTIGQYGSHGTSGRELLSESKLKDLLHGSEYVLTYEDKDGDWMLVGDVPWEMFTDTCKRLRIMKSSDAIGLAPRAMEKCRNRN

SEQ ID NO: 142 - DNA, 1078 bp, Gossypium hirsutum
  misc_feature: Ceres CLONE ID no.1835797
  misc_feature: Encodes the peptide sequence at SEQ ID NO. 143
atcctcatcaacatacagttacagcaaccacaaaaaaaggagagttaaaagagtttttaaaaggaatctgcaaaagaaaattcgtcaacttgtacaagatttggagcaacattgaagggtatagcaatggaaaggagagtgaattacgagaatgatctcaatctcatggcaactgagctaagattgggattgcctggttgtggtgatgatgagccccaaagaaaaacaaatcccagtatcagaaataataaaagaactgcacctgagatttctgaggtatcgagttctgagagcagttctagcattacaatgtctgggagtgatgatcaagacagtccccctcctgccaaggaacaagtcgtaggatggccaccaatccgatcatacaggaaaaattgcttacaaagttcgaagagaaatgaagttgaagggatggggatgtatgtgaaagtaagcgttgatggagctccttatctcagaaagattgatctcaaggtttataggagctatcctcaactcctcaaagctttggaaaatatgttcaagctcaccattggtgcatactcaaagagggaaggctacaatggatctgactatgctcctacttatgaagacaaagatggtgactggatgcttgttggagatgttccctgggagatgttcatttcctcctgcaagaggctgagaatcatgaaaggatcagaagctagagggttgggctgtgtatgagccaccaaattatttaacaagaaagaaagttttctttggctttggataatccaaattctgcaaggaagatcaatttggtcttcctggaaagtgagggggctatttgctagagcaaaatttctcaaagatttgacgacatggctggcctttttagcctcctctatgcatgtcaaatatctatacttgttttatagcacaaaaccaaaaaggcacgatattaaagaatagttaagatccaatccaattgtacaaaacgacatacactattgctttatcattttttccagtatacgaagaagattaaataaaaaggcaatagaatacagtttatgcatttactgttttgatt

SEQ ID NO: 143 - protein, 200 aa, Gossypium hirsutum
  misc_feature: Ceres CLONE ID no.1835797
  misc_feature: Bit score of 403.4 for HMM based on sequences of FIGURE 3.
  misc_feature (11)..(200): Pfam Name: AUX_IAA Pfam Description: AUX/IAA family
  misc_feature: Functional Homolog Of Ceres SEEDLINE ID no. ME09503 at SEQ ID NO. 129
MERRVNYENDLNLMATELRLGLPGCGDDEPQRKTNPSIRNNKRTAPEISEVSSSESSSSITMSGSDDQDSPPPAKEQVVGWPPIRSYRKNCLQSSKRNEVEGMGMYVKVSVDGAPYLRKIDLKVYRSYPQLLKALENMFKLTIGAYSKREGYNGSDYAPTYEDKDGDWMLVGDVPWEMFISSCKRLRIMKGSEARGLGCV

SEQ ID NO: 144 - DNA, 971 bp, Gossypium hirsutum
  misc_feature: Ceres CLONE ID no.1794204
  misc_feature: Encodes the peptide sequence at SEQ ID NO. 145
acatgcatttgttctttctcctctaagaactgatcatctttcagctaagctttcaatctagctttagttatagaaaaaaacagtggaattaagggtatggcatttgagaaagatctcaaccttgatgccaccgagctccggctaggcttaccgggaacctccgacgagtcagctaagaaccaaacgccggcaactcttcggagcaacaacaaaagagccttgcctgaagaatctatgtctagtaatgccacagcttccaaaaactgtgaccaagaaactgctccactccccaaggcacaagtgatagggtggccaccgatcagatcttacagaaaaaacaacttgcaacctaagaaaagtgagggtgaaattagtgggatatatgtgaaagtgagcatggatggggctccttatcttagaaagatagatttgaaggtgtttaaagggtaccaagaattgcttaaggccttggaagacatgttcaagttcaaagctggtgaatattcagagagggaaggatataatggatcagaatttgtgcccacttatgaagataaagatggtgattggatgttggtcggagatgtaccatgggagatgttcaccaattcttgcaaaaagctgaggatcatgaaaggatcagaagcaagaggcttgggttgtgttgtttgaaaaaaaggaagaaaaaaaaatagcccttcagcttagggtatccaaagaagaaattacgatcccttttttttttcttctttgttgattaagcaacaaagaagattaatcttaggatgttgtccaaggcataacccaaaaaaatatatattttcatgtatagttttggcatgtttctaatttccttgtggaatttgtacaaaggaaaacatatgaagttcataacatggttttccttttttttttctttttcatgtatattataaaccaaatccttcttttaaaaaaaaaaaaaaaaaaaa

SEQ ID NO: 145 - protein, 191 aa, Gossypium hirsutum
  misc_feature: Ceres CLONE ID no.1794204
  misc_feature: Bit score of 424.7 for HMM based on sequences of FIGURE 3.
  misc_feature (7)..(191): Pfam Name: AUX_IAA Pfam Description: AUX/IAA family
  misc_feature: Functional Homolog Of Ceres SEEDLINE ID no. ME09503 at SEQ ID NO. 129
MAFEKDLNLDATELRLGLPGTSDESAKNQTPATLRSNNKRALPEESMSSNATASKNCDQETAPLPKAQVIGWPPIRSYRKNNLQPKKSEGEISGIYVKVSMDGAPYLRKIDLKVFKGYQELLKALEDMFKFKAGEYSEREGYNGSEFVPTYEDKDGDWMLVGDVPWEMFTNSCKKLRIMKGSEARGLGCVV

SEQ ID NO: 146 - DNA, 1117 bp, Gossypium hirsutum
  misc_feature: Ceres CLONE ID no.1853542
  misc_feature: Encodes the peptide sequence at SEQ ID NO. 147
acatgcatatgttctttctcctctaagaactgatcatctttcagctaagctttcaatctcttagagctaaatttctagctttagttatagaaaaaaaaacagtggaattaagggtactatggcatttgagaaagatctcaaccttgatgccaccgagctccggctaggcttaccaggatcctccgacgagtcagctaagaaccaaacgccagcaactcttcggagcaacaacaaaagagccttgcctgaagaatctatgtctactaatgccacagcttccaaaaactgtgaccaagaaactgctccactccccaaggcacaagtggtagggtggccaccgatcagatcttacagaaaaaacaacttgcaacctaagaaaagtgagggtgaaattagtgggatatatgtgaaagtgagcatggacggggctccttatcttagaaagatagatttgaaggtgtttaaagggtacccagaattgcttaaggccttggaagagatgtttaagttcaaagctggtgaatattcagagagggaaggatataatggatcagaatttgtacccacttatgaagataaagatggtgattggatgttggtcggagatgtaccatgggagatgttcaccaattcttgcaaaaagctgaagatcatgaaaggatcagaagcaagaggcttgggttgtgtttgaaaaaaaatagcccttcagcttagggtatacaaagaagaaattacgatcccatttttttttcttctttgttgattaagcaacaaagaagattaatcttaggatgttgtccaaggcataacccaaaaaaatatatattttcatgtatagttttggcatgtttctaatttccttgtggaatttgtacaaaggaaaacatattaagttcataacatggttttcctttttttctttttcatgtatattataaatcaaatccttcttttgcctttggtctttatttacattatccatcactcttgaaagaggaaaaaagaaagatggaatctttggatttcaaatttaatatatataatgatgtaagatgttttcaaaaagagaaaaggaaggaagaaaagggatttaaagtaaaaaaaaaaaaaaaaaaaa

SEQ ID NO: 147 - protein, 190 aa, Gossypium hirsutum
  misc_feature: Ceres CLONE ID no.1853542
  misc_feature: Bit score of 417.5 for HMM based on sequences of FIGURE 3.
  misc_feature (7)..(190): Pfam Name: AUX_IAA Pfam Description: AUX/IAA family
  misc_feature: Functional Homolog Of Ceres SEEDLINE ID no. ME09503 at SEQ ID NO. 129
MAFEKDLNLDATELRLGLPGSSDESAKNQTPATLRSNNKRALPEESMSTNATASKNCDQETAPLPKAQVVGWPPIRSYRKNNLQPKKSEGEISGIYVKVSMDGAPYLRKIDLKVFKGYPELLKALEEMFKFKAGEYSEREGYNGSEFVPTYEDKDGDWMLVGDVPWEMFTNSCKKLKIMKGSEARGLGCV

SEQ ID NO: 148 - DNA, 1663 bp, Gossypium hirsutum
  misc_feature: Ceres CLONE ID no.1838776
  misc_feature: Encodes the peptide sequence at SEQ ID NO. 149
gaaaaaaaagtttctcttctttgctttctttcaagtaaaaatcaaacgaaaaacaacttaaataatattaaaagatattgattttgatcatcaaattttctgtttctgatccaccaatccaatcagagtgttgaagtattgaagctgtctgtgttctgtttgttttttgaaatctgatgtctccgccgcttcttggcgtggaggaagggggtcagaacaatgtgactttactgggttcttctggctctatggatagtgtgtgccagaataatgctgaattgaaggaacgcaattacatgggcttgtctgattgttcttctattgatagctctgttgtcacccctggttctgacgatggcaacgtaagtacgaatctgaaggcaacagagctcaggcttgggcttcctggatcacagtctcctgaaagaaatcctgagctttgcttgttaagctctgctcaacttgatgagaaaccccttttccctttgcatccttcaagtgatggtcactgctttccatctcaaaagactgtagtttcaggcaacaaaagaggcttctctgatgcaatggatggtttctcagaggggaatttcctttctaattcgaaagtagatgtgatgttgacacccaggccttcgtcaaacttgggactgaaatctggttctatgcttgagaaccttggggttcaaccaacaagggccaaagaggtcacgaaccagaaggtggtaaaggactcgtctcatgctgctaatgagacgaggcccaatcataatgcatctgcaaacaataacagtggagcacctgcttccaaggcacaggttgtaggttggcctcctattagatcgtttagaaagaactcattggccacctcttccaagaacactgatgaagtagatggaaagacagggcctgatgctctttttgttaaggtcagcatggatggtgctccttatctgaggaaagtggacttgaaaaactactctaaatatcaggatctgtcttctgcacttgaaaagatgttcagctgttttaccataggtcaatgtggttctcatggaaccctgggtagggagctgctgagcgaaagcaagctgaacgatcttctgcatggatcagaatatgttctcacttatgaggataaagatggtgattggatgcttgtgggtgatgtcccatgggagatgtttactgatacctgcaaaaggctgaggatcatgaaaagctctgatgctattggactcgctccaagggccgtggaaaaatgccggaaccggaactagctagtttaatacatgatttttgctatccgaagcagttctttctgaagaaataagaggatgttggagcgggcaggagatcacagggtatctgctttcacatggtgctactttttatcttctatttgcatgggaatttatatcatgtacgcttgtttttatctactaaaattataaaccatcaaggtctagtgttttagagtctctgaacgaatcgctgttcccaatccttttttaagcttgtaaagtgcattgtttcttgaactttcatcgtgtgtgtgttttgtatgttgaaagacccccgacattatctgtaaacccctgactttgattgtattaatcctgtgtgctgctgctttgcgtgtcaaaaaaaaaaaaaaaaaaaa

SEQ ID NO: 149 - protein, 367 aa, Gossypium hirsutum
  misc_feature: Ceres CLONE ID no.1838776
  misc_feature: Bit score of 278.8 for HMM based on sequences of FIGURE 3.
  misc_feature (65)..(359): Pfam Name: AUX_IAA Pfam Description: AUX/IAA family
  misc_feature: Functional Homolog Of Ceres SEEDLINE ID no. ME09503 at SEQ ID NO. 129
MSPPLLGVEEGGQNNVTLLGSSGSMDSVCQNNAELKERNYMGLSDCSSIDSSVVTPGSDDGNVSTNLKATELRLGLPGSQSPERNPELCLLSSAQLDEKPLFPLHPSSDGHCFPSQKTVVSGNKRGFSDAMDGFSEGNFLSNSKVDVMLTPRPSSNLGLKSGSMLENLGVQPTRAKEVTNQKVVKDSSHAANETRPNHNASANNNSGAPASKAQVVGWPPIRSFRKNSLATSSKNTDEVDGKTGPDALFVKVSMDGAPYLRKVDLKNYSKYQDLSSALEKMFSCFTIGQCGSHGTLGRELLSESKLNDLLHGSEYVLTYEDKDGDWMLVGDVPWEMFTDTCKRLRIMKSSDAIGLAPRAVEKCRNRN

SEQ ID NO: 150 - DNA, 1024 bp, Gossypium hirsutum
  misc_feature: Ceres CLONE ID no.1854675
  misc_feature: Encodes the peptide sequence at SEQ ID NO. 151
attgtaacttacagcaacttacaactttgggtatagcatttgaagaaaaaaaaatggaaggcagtgtgggttatgacaatgatctgaatctcaaggcaactgaactcagattagggttgcctggaacagaaccagtttccattgttagacgcaacaagagatcattgcaacaagtagctgatgatgattgtggagtaaatggctgcaaatctgatgatcaaaatgaaactgctcctcctcctcccaaagcacaaatcgtgggttggccaccgatccggtcttatagaaagaacaatattcagacaaagaaaaatgagtctgagggtggtgggatttatgtgaaagtaagcatggatggagcaccatatctaagaaaaattgaccttaaagtttactctgggtaccctgaattattacaggctattgagaacatgttcaagttcaccataggtgagtactctgaaagagaaggctataaaggatcagattatgcacctacttatgaagacaaagatggagattggatgctagtcggtgatgttccatggggaatgttcatcacatcatgtaagagattaaggatcatgaaaggatcagaagctagaggattaggtcgtggtgtatgagaaaaaaaaaacactttgcctaagaacatgaaaaacactgaagatctccattgatgtctccttcacggagaggtatcatcagcttgggttctcgaaggagatttttttggcttcaatagatagtcatctcagattctatggactgggaaagtttttgaaggacttattaaagaaacccagataatatgaagggttcaaagtccaaacttgtaagcaaagaattgattgaagaaattcagcaaatagatgtggattatcccaaagttttgattatgtaatgttaaaacaaagaaacaaaatttgtattgtatatcaggtgtttatctatgtatgtacaattaaaacttatatgggtaataaaatgatgtgtttttttccaaaaaaaaaaaaaaaaaaaa

SEQ ID NO: 151 - protein, 190 aa, Gossypium hirsutum
  misc_feature: Ceres CLONE ID no.1854675
  misc_feature: Bit score of 462.2 for HMM based on sequences of FIGURE 3.
  misc_feature (11)..(190): Pfam Name: AUX_IAA Pfam Description: AUX/IAA family
  misc_feature: Functional Homolog Of Ceres SEEDLINE ID no. ME09503 at SEQ ID NO. 129
MEGSVGYDNDLNLKATELRLGLPGTEPVSIVRRNKRSLQQVADDDCGVNGCKSDDQNETAPPPPKAQIVGWPPIRSYRKNNIQTKKNESEGGGIYVKVSMDGAPYLRKIDLKVYSGYPELLQAIENMFKFTIGEYSEREGYKGSDYAPTYEDKDGDWMLVGDVPWGMFITSCKRLRIMKGSEARGLGRGV

SEQ ID NO: 152 - DNA, 978 bp, Gossypium hirsutum
  misc_feature: Ceres CLONE ID no.1833078
  misc_feature: Encodes the peptide sequence at SEQ ID NO. 153
gcttagattatcgtccctataaaactagttagctgccttcgcatatctctcatcatcaacaactccaactcacggttttggcaaacaaagaaatataaaggaatcccactgtaaccaatatccccaagccttcttcctttcaagcaattatatcattgtaagttagcaatggagaatgatctcaacctcaaggcaacagaactgagattgggattacctggcagtgatgagcccgagagacaaatgatccctaggcctaacaagagaaccttatctgacattgtttctgagggatcaaggtcgaccacagaggaagatcatcaagacactgctcctcctgccaaggtgcaaattgtaggatggccaccagtcagatcataccggaaaaattgtttacaaggcaagaaagatgaggttgaaggggggacaggaatgtatgtcaaagtaagcgttgacggagctccttatctcagaaagattgatctcaaggtttatagaagctaccctcaactcctcttggctttggaaaacatgttcaagcttaccattggtgcatactcagagagggaaggctacaatggatctgactatgctcccacatatgaagacagagatggtgactggatgcttgttggagatgttccctgggaaatgttcatctcctcttgcaagagactgagaatcatgaaagggtcagaagccagagggttggggtgcgtatgagacgcccaaaaatagaacaaaacaaggagattttctttggcttggataatccaaattccacaaggaagatgaagtctgctcttcctgagaagtgagagatgccatttgctagaggaaagattcagagattaaaaagactgcatccttttcaatccaaccttggctggcttttagcctccattatttcaaatacatgtacttctttataaatagcatataccacaaaaccaaaaggcgaaaaaaaaaaaaaaaaaa

SEQ ID NO: 153 - protein, 184 aa, Gossypium hirsutum
  misc_feature: Ceres CLONE ID no.1833078
  misc_feature: Bit score of 396.8 for HMM based on sequences of FIGURE 3.
  misc_feature (5)..(184): Pfam Name: AUX_IAA Pfam Description: AUX/IAA family
  misc_feature: Functional Homolog Of Ceres SEEDLINE ID no. ME09503 at SEQ ID NO. 129
MENDLNLKATELRLGLPGSDEPERQMIPRPNKRTLSDIVSEGSRSTTEEDHQDTAPPAKVQIVGWPPVRSYRKNCLQGKKDEVEGGTGMYVKVSVDGAPYLRKIDLKVYRSYPQLLLALENMFKLTIGAYSEREGYNGSDYAPTYEDRDGDWMLVGDVPWEMFISSCKRLRIMKGSEARGLGCV

SEQ ID NO: 154 - DNA, 1385 bp, Gossypium hirsutum
  misc_feature: Ceres CLONE ID no.1850667
  misc_feature: Encodes the peptide sequence at SEQ ID NO. 155
attaattcctctaaaccttcctatattcctattcctattcttatcatcactctctcaatcctttgcttattacaacaaaacctttttcttctttatttttcacctttcagttcaaagcatcaaacccagaaagcgtggctacaacaaactgcaaaaaaaaggaaacaattagagaaagaagctatgggagttggcttaaagatgacgatgaaaggaggcggaggagatcatgttggaggttgcgacaaagagaagatggggtttgaagagactgagctgaggctagggttgcctggtggtggtggtggtggtggtgacggtgaagttgtgaggaaaagaggcttctctgaaactgttgatttgaagcttaacctttcctccaagcaagatacctctgggatcgatcccaatgatgagaaagtgaaaggcttgcaccaggagaagaatcttctcctttctgccattgatcctgctaagcctcctgccaaagcgcaagttgtgggatggccaccggtccgatcattccgaaagaacatgttagccaccaccacacagaagagcagcagcgaggagagcggcgagaaggcggcgttggtgaaggtgagcatggacggtgcgccttacctccgtaaggtggacttgaggatgtacacaagttaccaccaactctccgatgctttagccaaaatgttcagttctttcactatcggaaattgtggatctcaaggaatgaaggatttcatgaatgagagtaagctgatggatctccttaatggctctgattatgttcctacctatgaggacaaggatggtgactggatgcttgttggtgacgtcccttgggagatgtttgtcgaatcatgcaaaaggttacgcataatgaaaggaacagaagcaatcggactcgcaccaaaagctgtggagaaatgcaagaagagaagctgaaggaggtaggagttgctaatagagcaacctgctcttttgatcttgtgggtcgcctgctgcatgcatgcacatcatcatcatcatcatcatcatgtgatgaaaaattattgcaaagccagcagatggatgcatggatggatggagcagtttggctttgttattactattagggtgtttttgtgttcttaaatattataaaagttataatgtgagataaaataatagtaattaagtatttgatgactactttgttatggaatatggacaaaacataaaaaaaaaaaaaggaacatgaaatattactgtatgtctgtggcaagaacttggcatgttgtcttttgcttcttcctttgtgtgtttaagctttggtattagtttttattgattactactttgcttaatataaaattataaataaataaaaaaaaaaaaaaaaaaaa

SEQ ID NO: 155 - protein, 245 aa, Gossypium hirsutum
  misc_feature: Ceres CLONE ID no.1850667
  misc_feature: Bit score of 292.6 for HMM based on sequences of FIGURE 3.
  misc_feature (17)..(237): Pfam Name: AUX_IAA Pfam Description: AUX/IAA family
  misc_feature: Functional Homolog Of Ceres SEEDLINE ID no. ME09503 at SEQ ID NO. 129
MKGGGGDHVGGCDKEKMGFEETELRLGLPGGGGGGGDGEVVRKRGFSETVDLKLNLSSKQDTSGIDPNDEKVKGLHQEKNLLLSAIDPAKPPAKAQVVGWPPVRSFRKNMLATTTQKSSSEESGEKAALVKVSMDGAPYLRKVDLRMYTSYHQLSDALAKMFSSFTIGNCGSQGMKDFMNESKLMDLLNGSDYVPTYEDKDGDWMLVGDVPWEMFVESCKRLRIMKGTEAIGLAPKAVEKCKKRS

SEQ ID NO: 156 - DNA, 1687 bp, Gossypium hirsutum
  misc_feature: Ceres CLONE ID no.1918745
  misc_feature: Encodes the peptide sequence at SEQ ID NO. 157
aaccaaacaagctacaactatttgcttcttcttctttttttttgtactcttccatattcttcttttaaaaaaattcttaccactttcttctcttctttcggcgcgcgcttgcggttttgttgttctattttttgcacgcatttacaacacttaacagaacagaaaatacttgaaattgcagctaaataattttcaagtgttgaagtattgaagctgtctggtgttttgtttgttttttgaaatctgatgtctccgccgcttcttggcgtggaggaagggggtcagaacaatgtgactttactgggttcttctggctctattgatagtgtgtgccagaataatgctgaattgaaggagcgcaattacatgggcttgtctgattgttcttctattgattgctctgttgtcacccttggttccgacgatagcaacgtaagtttgaatctgaaggcaacagagctcaggcttgggcttcctggatcacagtctcctgaaagaaatcctgagctttgcttgttaagctctgctcaacttgatgagaaaccccttttccctttgcatccttcaagtgatggtcactgctttccatctcaaaagactgtagtttcaggcaacaaaagaggcttctctgatgcaatggatgggttctcagaggggaatttcctttctaattcgaaagtagatgtgatgttgacacccaggccttcatcaaacttgggactgaaatctgtttctatgcttgagaaccttggggttcaaccaacaaaggcgaaagaggtcacgaaccagaaggtggtaaaggactcgcctcatgctgccaatgagacgaggcccaaccataatgcatctgtaaacaataacagtggagcacctgcttccaaggcacaggttgtaggttggcctcctattagatcgtttagaaagaactcattggccacctcttccaagaacactgatgaagtagatggaaaggcagggcctgatgctctttttgttaaggtcagcatggatggtgctccttatctcaggaaagtggacctgaaaaactactctaaatatcaggatctatcttctgctcttgaaaagatgttcagctgttttaccataggtcaatgtggatctcatggatccctgggtagggagctgctgagcgaaagcaagctgaaggatcttctgcatggatcagaatatgttctcacttatgaggataaagatggtgattggatgcttgtgggtgatgtcccatgggagatgtttactgatacctgcaaaaggctgaggatcatgaaaagctctgatgctattggactcgctccaagggccgtggaaaaatgccggaaccggaactagctagtttgatacatgatttttgctatccgatgcagttctttctgaagaaataagaggatgttggagcgggcaggagatcacagggtatctgcttttcacatggtgctactttttatcttctatttgcatgggaatttatatcatgtacgcttgtttttatctactaaaattatgaaaccatcaaggtctagtgttttagagtctctgaacgagtccctgttcccaatctttttttaagcttgtaaagtgcattgtttcttgaactctcatcgtgtgtgtgttttgtatgttgaaagaccgccgacattatctgtaaacccctgactttgattgtatt

SEQ ID NO: 157 - protein, 367 aa, Gossypium hirsutum
  misc_feature: Ceres CLONE ID no.1918745
  misc_feature: Bit score of 279.4 for HMM based on sequences of FIGURE 3.
  misc_feature (65)..(359): Pfam Name: AUX_IAA Pfam Description: AUX/IAA family
  misc_feature: Functional Homolog Of Ceres SEEDLINE ID no. ME09503 at SEQ ID NO. 129
MSPPLLGVEEGGQNNVTLLGSSGSIDSVCQNNAELKERNYMGLSDCSSIDCSVVTLGSDDSNVSLNLKATELRLGLPGSQSPERNPELCLLSSAQLDEKPLFPLHPSSDGHCFPSQKTVVSGNKRGFSDAMDGFSEGNFLSNSKVDVMLTPRPSSNLGLKSVSMLENLGVQPTKAKEVTNQKVVKDSPHAANETRPNHNASVNNNSGAPASKAQVVGWPPIRSFRKNSLATSSKNTDEVDGKAGPDALFVKVSMDGAPYLRKVDLKNYSKYQDLSSALEKMFSCFTIGQCGSHGSLGRELLSESKLKDLLHGSEYVLTYEDKDGDWMLVGDVPWEMFTDTCKRLRIMKSSDAIGLAPRAVEKCRNRN

SEQ ID NO: 158 - DNA, 936 bp, Gossypium hirsutum
  misc_feature: Ceres CLONE ID no.1929487
  misc_feature: Encodes the peptide sequence at SEQ ID NO. 159
attttgcaaagagtttcagtttcagtttttctttttctttttaatgcaaaaacgccagctttttaagagagagatatggtattgaaagaagaaccgaagtcaccggaaagtgacgtcaccagcatgagtttcgaggagacgaagctgactttaggattgccaggggagggacgatcgtcggcgggagctgtaaagtgttctgcaaaacgtggcttcgttgagaccgtagtcgatcttaaagtcgggagttctggtaactgcatgcctggtggacgtgatgacactactactgttatcgattccggtgccggaaaacctcctcccgccaaggaacaagtagtgggttggccaccagtgagatcaagtagaaagaaggctataaatgagaggtttaggtatgtgaaagtagccatggatggagctccatttcttcgcaaagtaaacttacaatgttactctagttacaaccagctcttgaaagatttcgacaacttattcgattgtagtaataaagaggaaagcaagcttatggatgtggtaaaaagaatggagtatgtaccaacttatgaagacaaagacgatgattggatgttagttggagatgttccttggaaaatgttcgtagaatcatgtaagcgtatccgtctgatgaaatgctcagatcctactgtcttcaccttagcatcaaagggctgttcttcttcctcttctccaaaatgttgaatcccaagctgagttcatagtgagtgtggtttatatatatatatatgtatgtatgtatggtatggtaaccccttgtaattatgttagattccaagaataaatttgtgcctttaatataaattatgaacatagaactttaatcatgttccacaactgagtttttattattggatatcattattttgcatattttaaaaaaaaaaaaaaaaaaaa

SEQ ID NO: 159 - protein, 215 aa, Gossypium hirsutum
  misc_feature: Ceres CLONE ID no.1929487
  misc_feature: Bit score of 229.8 for HMM based on sequences of FIGURE 3.
  misc_feature (17)..(204): Pfam Name: AUX_IAA Pfam Description: AUX/IAA family
  misc_feature: Functional Homolog Of Ceres SEEDLINE ID no. ME09503 at SEQ ID NO. 129
MVLKEEPKSPESDVTSMSFEETKLTLGLPGEGRSSAGAVKCSAKRGFVETVVDLKVGSSGNCMPGGRDDTTTVIDSGAGKPPPAKEQVVGWPPVRSSRKKAINERFRYVKVAMDGAPFLRKVNLQCYSSYNQLLKDFDNLFDCSNKEESKLMDVVKRMEYVPTYEDKDDDWMLVGDVPWKMFVESCKRIRLMKCSDPTVFTLASKGCSSSSSPKC

SEQ ID NO: 160 - DNA, 525 bp, Populus balsamifera subsp. trichocarpa
  misc_feature: Ceres ANNOT ID no.1497918
  misc_feature: Encodes the peptide sequence at SEQ ID NO. 161
atgggcagaggagctgcctctagctcttcatcatctttcgaaagcagccgctacccatctgtctccggcgagtcttctttccctcatgtaaagagggaccttagcacagatctaaggcttggacttggcatatcaacctctcgacaggacaacccttccacaccaagtgagcagctattggattggccaccgatcaagccgtctccggggaaggcagtaacatcagaagaaaatgagtgctgtagttccaccttattcgtcaaggtgtacatggaaggcattcaaattggaaggaaactgaacctattagcccacgatggttaccatgacttgatacagactctcgacgaaatgttcaacactagcattctctggcctgaaatggatgttgaacattccgggaaatgccatgtgctgacatatgaagacaaagagggcgattggttgattgttggggatgttccatgggaggtgttcttaccttctgtgcggagattgaagatcaccagggcagacagcctatga

SEQ ID NO: 161 - protein, 174 aa, Populus balsamifera subsp. trichocarpa
  misc_feature: Ceres ANNOT ID no.1497918
  misc_feature: Bit score of 87.6 for HMM based on sequences of FIGURE 3.
  misc_feature (85)..(168): Pfam Name: AUX_IAA Pfam Description: AUX/IAA family
  misc_feature: Functional Homolog Of Ceres SEEDLINE ID no. ME09503 at SEQ ID NO. 129
MGRGAASSSSSSFESSRYPSVSGESSFPHVKRDLSTDLRLGLGISTSRQDNPSTPSEQLLDWPPIKPSPGKAVTSEENECCSSTLFVKVYMEGIQIGRKLNLLAHDGYHDLIQTLDEMFNTSILWPEMDVEHSGKCHVLTYEDKEGDWLIVGDVPWEVFLPSVRRLKITRADSL

SEQ ID NO: 162 - DNA, 924 bp, Populus balsamifera subsp. trichocarpa
  misc_feature: Ceres ANNOT ID no.1459563
  misc_feature: Encodes the peptide sequence at SEQ ID NO. 163
atggcaggtggtcttggttcactcggcggcggcggcggctcttccggggcctccacaaatgactccacaatgtcaaaagtggaggtggtggaggctgaggcaagttcatatccagtggaagctgagctggagctggggctgagtcttggtagtggtggtcgtggtggtggtggtggagggaagggtaaggcaaatgcacggggtgagcgtggcagaatcttgactgccaaggactttccttcggtggtctcccagcctcaaaggcctaacaacaacacttctatttcctctgcttgcgttgttggtgctgtttctgggactaagagagctgctgactctgtctcccatgagggtggatcccctactgctggcagtcaggttgtggggtggcctcctataagggcttatcggatgaatagcttggtgaaccaagcaaaggctgcaagagctgaagaagacaagggaattggtgagaaggatatatctaaggataatttgaagaagaaaatctgtaatggtaacaagaccagtgctcctagtaatgaaaaggggcatcttggatttgtcaaggtgaatatggatgggattccaattggaaggaaggtagatttgaatgctcatgcttgctatgagacattagctcaagcattggaggaaatgtttttcaggtccgccacaactatcaattccattggtggcgagaagcggcaagtaacgaagccctccaagttattggatggattgtccgagttcctactcacttatgaagataaagagggagactggatgcttgtgggagatgttccgtgggggatgttcctcaactcagtaaaaaggcttaggatcatgaggacctcggaggccaatggacttgctccaagattccaggataggaatgagaaacaaagaataaagcctgtttag

SEQ ID NO: 163 - protein, 307 aa, Populus balsamifera subsp. trichocarpa
  misc_feature: Ceres ANNOT ID no.1459563
  misc_feature: Bit score of 183.7 for HMM based on sequences of FIGURE 3.
  misc_feature (120)..(295): Pfam Name: AUX_IAA Pfam Description: AUX/IAA family
  misc_feature: Functional Homolog Of Ceres SEEDLINE ID no. ME09503 at SEQ ID NO. 129
MAGGLGSLGGGGGSSGASTNDSTMSKVEVVEAEASSYPVEAELELGLSLGSGGRGGGGGGKGKANARGERGRILTAKDFPSVVSQPQRPNNNTSISSACVVGAVSGTKRAADSVSHEGGSPTAGSQVVGWPPIRAYRMNSLVNQAKAARAEEDKGIGEKDISKDNLKKKICNGNKTSAPSNEKGHLGFVKVNMDGIPIGRKVDLNAHACYETLAQALEEMFFRSATTINSIGGEKRQVTKPSKLLDGLSEFLLTYEDKEGDWMLVGDVPWGMFLNSVKRLRIMRTSEANGLAPRFQDRNEKQRIKPV

SEQ ID NO: 164 - DNA, 600 bp, Populus balsamifera subsp. trichocarpa
  misc_feature: Ceres ANNOT ID no.1452610
  misc_feature: Encodes the peptide sequence at SEQ ID NO. 165
atggagaggtcaatggcatacgaaagcgatctaaatctaaaggcaacagaactgaggttagggttgcctggaagtgatgagccagagaaaccatcaactactcctagtgttaggagtaataagagagcctcgccagaaatatcagaggagtccaggtccaagggcagttctagtgtgtcctccaatgtcgaaaatggtgaaagagacagtgcccctcctgccaaggcacaagtagtgggatggccaccaatccgatcttataggaaaaattgcttgcaaccaaagaaaaatgatcaagttgatggtgctggcatgtacgtaaaagtgagcgtggatggagctccttatctcaggaagattgatcttaaggtgtacaagagctacccagagctcctcaaagccttggagaatatgttcaagcttaccattggtgaatactcagagaatgaagggtacaacggatctgaatttgctcctacttacgaagataaagatggagactggatgctagttggcgacgttccatgggacatgtttatctcctcctgcaagaggctgagaattatgaaaggatcagaagctagaggattgggctgttga

SEQ ID NO: 165 - protein, 195 aa, Populus balsamifera subsp. trichocarpa
  misc_feature: Ceres ANNOT ID no.1452610
  misc_feature: Bit score of 434.8 for HMM based on sequences of FIGURE 3.
  misc_feature (7)..(194): Pfam Name: AUX_IAA Pfam Description: AUX/IAA family
  misc_feature: Functional Homolog Of Ceres SEEDLINE ID no. ME09503 at SEQ ID NO. 129
MAYESDLNLKATELRLGLPGSDEPEKPSTTPSVRSNKRASPEISEESRSKGSSSVSSNVENGERDSAPPAKAQVVGWPPIRSYRKNCLQPKKNDQVDGAGMYVKVSVDGAPYLRKIDLKVYKSYPELLKALENMFKLTIGEYSENEGYNGSEFAPTYEDKDGDWMLVGDVPWDMFISSCKRLRIMKGSEARGLGC

SEQ ID NO: 166 - DNA, 1101 bp, Populus balsamifera subsp. trichocarpa
  misc_feature: Ceres ANNOT ID no.1496539
  misc_feature: Encodes the peptide sequence at SEQ ID NO. 167
atgtctccaccactacttggtgttgtggaggaggagggtcatagtaatgtcactctactggcttctccggcctcagcagaaagtgcatgcctgaatggtttggaattgaaagagcgtaactacatgggtttgtccgattgttcttccgtggacagctcggcagtctctgcagcatctgatgaaagaaagactagtttaaatctgaaggctactgaattgcggcttgggcttcctgggtcccagtctccagaaagaaatcatgagctttccctgttgagctcggcattacttgatgagaagcccttcttccctttgcatccctcaaatgatggtcactactcctcaacacagaaaaatgttgtttcgggtaacaagagagtgttctctgatgccatggatgagttttcagagagcaagtttctgtcaaattcggaggtaaatgcaatgctctcacccaggccctcaccgaacatgggattgaaacctggcatgttggagaaccttggagttcaacaagctaaagtgaaagagatagtagccccaaaggcaggacaagagagacctcatgcggcaaacgagaccagaccacttcgtaacagctccgcaaacaacagcagtgcacctgctccaaaggcacaagttgtgggttggccacccatcaaatcatttaggaagaattcccttgccaccacctcaaagaacacagaagaagttgatggtaaagcagggccaggtgctttatttatcaaagtcagcatggatggtgctccttatcttagaaaagtggatttgagaaactactctgcatatcaggaattgtcttctgccctcgagaagatgttcagctgtttcaccataggccaatatggatcccatggagctccaggaagggagatgctgagcgagagcaagctgaaggatctgctgcatggctcagaatatgttctcacttatgaggataaagacggagactggatgcttgttggcgatgttccctgggagatgtttattgaaacatgcaagaggctgaggatcatgaagagctctgatgccattggcctagccccaagggccatggagaaatgcaaaaacaggaattag

SEQ ID NO: 167 - protein, 325 aa, Populus balsamifera subsp. trichocarpa
  misc_feature: Ceres ANNOT ID no.1496539
  misc_feature: Bit score of 289.1 for HMM based on sequences of FIGURE 3.
  misc_feature (25)..(317): Pfam Name: AUX_IAA Pfam Description: AUX/IAA family
  misc_feature: Functional Homolog Of Ceres SEEDLINE ID no. ME09503 at SEQ ID NO. 129
MGLSDCSSVDSSAVSAASDERKTSLNLKATELRLGLPGSQSPERNHELSLLSSALLDEKPFFPLHPSNDGHYSSTQKNVVSGNKRVFSDAMDEFSESKFLSNSEVNAMLSPRPSPNMGLKPGMLENLGVQQAKVKEIVAPKAGQERPHAANETRPLRNSSANNSSAPAPKAQVVGWPPIKSFRKNSLATTSKNTEEVDGKAGPGALFIKVSMDGAPYLRKVDLRNYSAYQELSSALEKMFSCFTIGQYGSHGAPGREMLSESKLKDLLHGSEYVLTYEDKDGDWMLVGDVPWEMFIETCKRLRIMKSSDAIGLAPRAMEKCKNRN

SEQ ID NO: 168 - DNA, 873 bp, Populus balsamifera subsp. trichocarpa
  misc_feature: Ceres ANNOT ID no.1498819
  misc_feature: Encodes the peptide sequence at SEQ ID NO. 169
atgcaaggtggttttcttggtggaggaagtggtgggtcggtgtgtatgtcgacggtgtcaatggaggataacgtgttgatgtcatctgaggactcgtcaagcccggatgagggtgaacttgaactgggtcttggtttgagtcttggtggtgcttctggttttaaggattttggtcagcgtagcagtcaacaatatgcaaggattttgactgctaaggatttgccttccaaggtttcttcttcttcttgttgttcttcaacgacttcgtcttcttcttctaccttgagtagagctaatgctactgctgggactaagagggctgctgattctgtttctgcttctaatggtgctgccagcagtcaagttgttgggtggcctccaataagatctcatagaatgcacatcatggttaaccaggcaaagtcacaggctactgaagagttcaactcaatgaataaacgcaagaatgctgtggaagagaaggtgggcaacaaaaacattaatattggtaataccaagactaggacttccctatttgtcaaggtgaatatggatggaaccctgattggtagaaaggttgatctgaatgctcatggctgctatgagacactggctcaagccttggaaaatatgttcctaagaactaccacaactttgaacatggcacgattgagcacacctgaacataaaataatgatagatgcaaaaagacactcacaattgctgggcgggtcatctgagtttgtgctcacttatgaggacaaggatggggattggatgcttgtcggagatgttccttgggggatgtttattagctctgtgaagagactcagaatcatgaggatgtccgaggcaactggacttggcaaatga

SEQ ID NO: 169 - protein, 270 aa, Populus balsamifera subsp. trichocarpa
  misc_feature: Ceres ANNOT ID no.1498819
  misc_feature: Bit score of 166.2 for HMM based on sequences of FIGURE 3.
  misc_feature (100)..(269): Pfam Name: AUX_IAA Pfam Description: AUX/IAA family
  misc_feature: Functional Homolog Of Ceres SEEDLINE ID no. ME09503 at SEQ ID NO. 129
MEDNVLMSSEDSSSPDEGELELGLGLSLGGASGFKDFGQRSSQQYARILTAKDLPSKVSSSSCCSSTTSSSSSTLSRANATAGTKRAADSVSASNGAASSQVVGWPPIRSHRMHIMVNQAKSQATEEFNSMNKRKNAVEEKVGNKNINIGNTKTRTSLFVKVNMDGTLIGRKVDLNAHGCYETLAQALENMFLRTTTTLNMARLSTPEHKIMIDAKRHSQLLGGSSEFVLTYEDKDGDWMLVGDVPWGMFISSVKRLRIMRMSEATGLGK

SEQ ID NO: 170 - DNA, 1152 bp, Populus balsamifera subsp. trichocarpa
  misc_feature: Ceres ANNOT ID no.1446583
  misc_feature: Encodes the peptide sequence at SEQ ID NO. 171
atgtcttctattccaaaggaacatgattacataggcttgtcagagactccttcaatggaaaaaatctctgacaagctctcctcttcctcctctaccctctccactgaagagaatatcaacagcaacagcaacagcaacagcaacagcaccaatacttctctcaacttgaaagaaactgagctaaggcttggcttgccagggtatcagtctccagagagaaaactaacactacctgcagctggggtgtctctttttggaaaagatattgacaccaacaacactaatggttatcctcttaggccgctaaagaatttagtgtcaggaactaagagaggtttctcagatgccattgttgggtcttctgggaaatgggttttctctgggagtaatggatctgaagttgatttgggtaaaggagctattttgttttctcccagaggtgataatggtaattcccagaaatcttgtgttgcaggacctgccaagaaagatgatgttgctcaatctccaaagccagttcaagagaaaatcagccaagtggctgctgcaaatgagaacagcagtgctcctgctgcaaaggcacaggtggtaggatggccaccaattcgctcattccggaagaataccatggcctctagtttggtgaagaacaatgaagatgtcgaaggcaaatcaggatatggttgcctgtacgtaaaggttagcatggatggtgctccataccttaggaaggtggaccttaaaacttacagcaactatctggaactctcatctgctcttgaaaaaatgttcagctgcttcaccattggacaatgtggttctcatgggctgcgagggcaagatggtctaactgagagtcgtttgaaggatattcttcatggttctgaatatgttctcacatacgaagacaaggatggtgattggatgcttgttggtgatgtcccttgggatatgtttaccaactcgtgcaggagattgaggatcatgaaaggttctgaagcaattggacttggaaccagattggatgaacttgctaagcttctgtttgtatcttcatatctgaacatccccgagggccatggagaaatgcaagaaccggaattagcgaaaagagtgcatgaagtcatgaagcttaagaaggatgttttctag

SEQ ID NO: 171 - protein, 365 aa, Populus balsamifera subsp. trichocarpa
  misc_feature: Ceres ANNOT ID no.1446583
  misc_feature: Bit score of 309.3 for HMM based on sequences of FIGURE 3.
  misc_feature (36)..(323): Pfam Name: AUX_IAA Pfam Description: AUX/IAA family
  misc_feature: Functional Homolog Of Ceres SEEDLINE ID no. ME09503 at SEQ ID NO. 129
MEKISDKLSSSSSTLSTEENINSNSNSNSNSTNTSLNLKETELRLGLPGYQSPERKLTLPAAGVSLFGKDIDTNNTNGYPLRPLKNLVSGTKRGFSDAIVGSSGKWVFSGSNGSEVDLGKGAILFSPRGDNGNSQKSCVAGPAKKDDVAQSPKPVQEKISQVAAANENSSAPAAKAQVVGWPPIRSFRKNTMASSLVKNNEDVEGKSGYGCLYVKVSMDGAPYLRKVDLKTYSNYLELSSALEKMFSCFTIGQCGSHGLRGQDGLTESRLKDILHGSEYVLTYEDKDGDWMLVGDVPWDMFTNSCRRLRIMKGSEAIGLGTRLDELAKLLFVSSYLNIPEGHGEMQEPELAKRVHEVMKLKKDVF

SEQ ID NO: 172 - DNA, 963 bp, Populus balsamifera subsp. trichocarpa
  misc_feature: Ceres ANNOT ID no.1535123
  misc_feature: Encodes the peptide sequence at SEQ ID NO. 173
atgtctatgcccttagagcatgattacataggcatatcatctgaggtttcttcaatggaaaacacctctggtactgatacaataaacatctctaccactgcttctaaaggtcttaacttgaaagctactgagttaagactcgggttacccgggtccgactcaccagagagaggtaatgagaatcaacaacttggtttttccttaaacaacaacaatagcaaagacaagagctttgtgtctggggctaggaggggtttctctgttgccattcatggtggctctgctaactgggttttctctgggaatgccggatctgacccgaatttttctcttcgaggtgctaattctggaaaagaagggttccctcactcatcgaagcctgttgtgcaggagaacaagagtcaggttgatggtgctaacactaatggccatggggctgctcctgcttctaaggcacaagttgtgggatggccaccaattcgctcatttcgaaagaatacaatggcttctcatctttcaaagaatgatgatggtgcagaagtcaagtcaggatcagggtgtttgtatgtcaaggtcagtatggatggcgccccttatctgaggaaagttgatctgaaaacatttggcagctacatggaactctcttcggcactagaaaagatgtttagctgctttacaataggccagtgtggctctcatgtagttcctggccaagatgggttgagtgagagtcgattaatggatctcctgcatggttcagaatatgttctcacctacgaagacaaagacaatgattggatgcttgttggtgacgtgccttggaagatgttcaccgactcttgtagaaggctgaggattatgaagggttcagaggcaattggccttgatatagccttgcttttaaatgtttacataactacttcttgcagccccaagagccatggagaagtgcaaaagtcgtaa

SEQ ID NO: 173 - protein, 318 aa, Populus balsamifera subsp. trichocarpa
  misc_feature: Ceres ANNOT ID no.1535123
  misc_feature: Bit score of 310.3 for HMM based on sequences of FIGURE 3.
  misc_feature (36)..(297): Pfam Name: AUX_IAA Pfam Description: AUX/IAA family
  misc_feature: Functional Homolog Of Ceres SEEDLINE ID no. ME09503 at SEQ ID NO. 129
MPLEHDYIGISSEVSSMENTSGTDTINISTTASKGLNLKATELRLGLPGSDSPERGNENQQLGFSLNNNNSKDKSFVSGARRGFSVAIHGGSANWVFSGNAGSDPNFSLRGANSGKEGFPHSSKPVVQENKSQVDGANTNGHGAAPASKAQVVGWPPIRSFRKNTMASHLSKNDDGAEVKSGSGCLYVKVSMDGAPYLRKVDLKTFGSYMELSSALEKMFSCFTIGQCGSHVVPGQDGLSESRLMDLLHGSEYVLTYEDKDNDWMLVGDVPWKMFTDSCRRLRIMKGSEAIGLDIALLLNVYITTSCSPKSHGEVQKS

SEQ ID NO: 174 - DNA, 591 bp, Populus balsamifera subsp. trichocarpa
  misc_feature: Ceres ANNOT ID no.1463397
  misc_feature: Encodes the peptide sequence at SEQ ID NO. 175
atggaaggtggtgttgcatatgagaatgatctaaacctcaaggcaactgagcttagactggggttgccagggacgagctgtactaatgaagaacaagcagtttctggtgctagaaacaacaaacgaccattgccagagaccagagaggagcgtggagcaaaaggcaaatctgatcctcgacatgatgaccaagaaactgcccctgctcccaaggcacagatagtgggctggccaccaatcagatcctaccggaaaaacaccctgcagccaaagaaagctgaagccgaggctgcggctgggatgtacgttaaagtaagcatggatggagcaccataccttagaaagattgatctaaaggtttacaagggataccctgagctcctaaaggctttagagaacatgttcaagctcaccataggtgagtactctgaaagggaaggctacaaaggatcagaatatgcacctacttatgaggacaaagatggtgactggatgctgattggagatgttccatgggatatgttcctgtcatcctgtaagaaattgagaatcattaaaggatcagaagcaacagatggctggaagttttag

SEQ ID NO: 175 - protein, 196 aa, Populus balsamifera subsp. trichocarpa
  misc_feature: Ceres ANNOT ID no.1463397
  misc_feature: Bit score of 403.9 for HMM based on sequences of FIGURE 3.
  misc_feature (11)..(191): Pfam Name: AUX_IAA Pfam Description: AUX/IAA family
  misc_feature: Functional Homolog Of Ceres SEEDLINE ID no. ME09503 at SEQ ID NO. 129
MEGGVAYENDLNLKATELRLGLPGTSCTNEEQAVSGARNNKRPLPETREERGAKGKSDPRHDDQETAPAPKAQIVGWPPIRSYRKNTLQPKKAEAEAAAGMYVKVSMDGAPYLRKIDLKVYKGYPELLKALENMFKLTIGEYSEREGYKGSEYAPTYEDKDGDWMLIGDVPWDMFLSSCKKLRIIKGSEATDGWKF

SEQ ID NO: 176 - DNA, 945 bp, Populus balsamifera subsp. trichocarpa
  misc_feature: Ceres ANNOT ID no.1499563
  misc_feature: Encodes the peptide sequence at SEQ ID NO. 177
atgtcttctattccaaaggaacatgattacataggcttcaacagcaacagcaacagcaacagcaccaatacttctctcaacttgaaagaaactgagctaaggcttggcttgccagggtatcagtctccagagagaaaactaacactacctgcagctggggtgtctctttttggaaaagatattgacaccaacaacactaatggttatcctcttaggccgctaaagaatttagtgtcaggaactaagagaggtttctcagatgccattgttgggtcttctgggaaatgggttttctctgggagtaatggatctgaagttgatttgggtaaaggagctattttgttttctcccagaggtgataatggtaattcccagaaatcttgtgttgcaggacctgccaagaaagatgatgttgctcaatctccaaagccagttcaagagaaaatcagccaagtggctgctgcaaatgagaacagcagtgctcctgctgcaaaggcacaggtggtaggatggccaccaattcgctcattccggaagaataccatggcctctagtttggtgaagaacaatgaagatgtcgaaggcaaatcaggatatggttgcctgtacgtaaaggttagcatggatggtgctccataccttaggaaggtggaccttaaaacttacagcaactatctggaactctcatctgctcttgaaaaaatgttcagctgcttcaccattggacaatgtggttctcatgggctgcgagggcaagatggtctaactgagagtcgtttgaaggatattcttcatggttctgaatatgttctcacatacgaagacaaggatggtgattggatgcttgttggtgatgtcccttgggatatgtttaccaactcgtgcaggagattgaggatcatgaaaggttctgaagcaattggacttgacaataaaacaatttag

SEQ ID NO: 177 - protein, 314 aa, Populus balsamifera subsp. trichocarpa
  misc_feature: Ceres ANNOT ID no.1499563
  misc_feature: Bit score of 303.6 for HMM based on sequences of FIGURE 3.
  misc_feature (26)..(313): Pfam Name: AUX_IAA Pfam Description: AUX/IAA family
  misc_feature: Functional Homolog Of Ceres SEEDLINE ID no. ME09503 at SEQ ID NO. 129
MSSIPKEHDYIGFNSNSNSNSTNTSLNLKETELRLGLPGYQSPERKLTLPAAGVSLFGKDIDTNNTNGYPLRPLKNLVSGTKRGFSDAIVGSSGKWVFSGSNGSEVDLGKGAILFSPRGDNGNSQKSCVAGPAKKDDVAQSPKPVQEKISQVAAANENSSAPAAKAQVVGWPPIRSFRKNTMASSLVKNNEDVEGKSGYGCLYVKVSMDGAPYLRKVDLKTYSNYLELSSALEKMFSCFTIGQCGSHGLRGQDGLTESRLKDILHGSEYVLTYEDKDGDWMLVGDVPWDMFTNSCRRLRIMKGSEAIGLDNKTI

SEQ ID NO: 178 - DNA, 600 bp, Populus balsamifera subsp. trichocarpa
  misc_feature: Ceres ANNOT ID no.1495753
  misc_feature: Encodes the peptide sequence at SEQ ID NO. 179
atggagaggtcaatggcatacgaaagacatctaaatctaaaggcaacagaactgagattagggttgcctggaagcgatgagccagagaaaccatcaactactcctagtgttaggagtaacaagagagcatcaccagaaatatcagaggagtctaggtccaagggcagctctagtctgtcctccaatgttgaaaatagtgaaggagatgatgctcctcctgccaaggcacaagtagtgggatggccaccaatccgatcttacaggaaaaattgcttgcaaccaaagaaaaacgatcgagttgatggtgctggaatgtacgtcaaagtgagcgtggatggagctccttatctcaggaagattgatcttaaggtgtacaggagctacccagagctcctcaaagcattggaagatatgttcaagcttaccatcggagagtactcggagaaggaaggatacaatggatctgactttgctcctacttacgaagataaagatggagactggatgcttgttggagacgttccatgggatatgtttatctccacctgcaagaggctgagaattatgaagggatcagaagctagaggattgggttgttaa

SEQ ID NO: 179 - protein, 199 aa, Populus balsamifera subsp. trichocarpa
  misc_feature: Ceres ANNOT ID no.1495753
  misc_feature: Bit score of 429.1 for HMM based on sequences of FIGURE 3.
  misc_feature (11)..(198): Pfam Name: AUX_IAA Pfam Description: AUX/IAA family
  misc_feature: Functional Homolog Of Ceres SEEDLINE ID no. ME09503 at SEQ ID NO. 129
MERSMAYERHLNLKATELRLGLPGSDEPEKPSTTPSVRSNKRASPEISEESRSKGSSSLSSNVENSEGDDAPPAKAQVVGWPPIRSYRKNCLQPKKNDRVDGAGMYVKVSVDGAPYLRKIDLKVYRSYPELLKALEDMFKLTIGEYSEKEGYNGSDFAPTYEDKDGDWMLVGDVPWDMFISTCKRLRIMKGSEARGLGC

SEQ ID NO: 180 - DNA, 741 bp, Populus balsamifera subsp. trichocarpa
  misc_feature: Ceres ANNOT ID no.1488767
  misc_feature: Encodes the peptide sequence at SEQ ID NO. 181
atgggagcagaaacagctgacacctacagcatgattaattatgaagagactgaattacgcctagggttacctggaggtgctagtaatggaaatgatggtgaggctgcaaagggtaatgggaagagagggttttcagagacggttgacttgaagcttaacctttcaactaaagaaactggaaaggatggatcagatcaggagaaagtagtaatgaaggagaaaactgttgctcctcgccccaatgatcctgcaaagccaccgtccaaggcacaagttgtgggttggccacccattagatcattccgtaaaaatgtcatggccgtccagaagaacagcaacgatgagggtgaaaaggccagtagcagtggcactactggtactgcagctttcgttaaggttagcatggatggtgccccatacttgcgaaaagtggacttgaaattatacaagagctaccgagaactctctgatgctctaggcaaaatgttcagctccttcaccatcggtaactgtggctcacaaggaacgaaagatttcatgaatgaaagcaaattgatagatcttttgaatagttctgagtatgtgccaacttatgaagacaaggatggagattggatgcttgtaggagatgttccatggggaatgtttgtcgattcatgcaagcgcttgaggatcatgaaagggtctgaggccattggacttgccccaagagctgtggagaagtgcaagaacagaagttga

SEQ ID NO: 181 - protein, 236 aa, Populus balsamifera subsp. trichocarpa
  misc_feature: Ceres ANNOT ID no.1488767
  misc_feature: Bit score of 305.2 for HMM based on sequences of FIGURE 3.
  misc_feature (2)..(228): Pfam Name: AUX_IAA Pfam Description: AUX/IAA family
  misc_feature: Functional Homolog Of Ceres SEEDLINE ID no. ME09503 at SEQ ID NO. 129
MINYEETELRLGLPGGASNGNDGEAAKGNGKRGFSETVDLKLNLSTKETGKDGSDQEKVVMKEKTVAPRPNDPAKPPSKAQVVGWPPIRSFRKNVMAVQKNSNDEGEKASSSGTTGTAAFVKVSMDGAPYLRKVDLKLYKSYRELSDALGKMFSSFTIGNCGSQGTKDFMNESKLIDLLNSSEYVPTYEDKDGDWMLVGDVPWGMFVDSCKRLRIMKGSEAIGLAPRAVEKCKNRS

SEQ ID NO: 182 - DNA, 837 bp, Arabidopsis thaliana
  misc_feature: Ceres Clone ID no. 120824
  misc_feature: Encodes the peptide sequence at SEQ ID NO. 183
atataactcggactgactcggctgagaaaaagcgagtcagagacgagtcattcgacgaagcggttcttgactcgccggaggtgaagaggttgagagatgatttattcgatgtcctggatgactcggatcctgaaccagtgagtcaagatctcgactcggttatgaaaagtttcgaagacgagttatcaacggtcaccaccacgacggcgcaaggttcctctaccgccggcgaaactcagcctgatctcggatatcttcttgaagcttccgatgatgagcttggtttaccaccacctccatcgatttctccggttcccgtcgcgaaggaggaggtaacgacggagacggtaacggatttggtacgagcgtcttctgattcgtcaggaatcgacgagatttggggatttgaagatcacgtgtcgaattacggtggtttagattttggttccggcgtcggagatggtggagattacgtggctgttgaggggttgtttgaattttccgacgattgttttgactccggcgatctgttttcgtggcggtcggagtcgttaccggcggaataaataaataacaaactttttttttaattaggtgggaaatgaaaacgatatcgttttgttaaagcgtttggctctccctcgctttttttttttaacccgatggttaatatctattaactaaaattattaggatttaggaaaagttaaatattttgttagtaagggtaatttgctagattagtattagcgaattcgtttgtttgttcttccagatctttttttcatagcttttgttaatgtgaaatttcagaatgaaaaactctctttgtcagtc

SEQ ID NO: 183 - protein, 187 aa, Arabidopsis thaliana
  misc_feature: Ceres Clone ID no. 120824
  misc_feature (1)..(187): Bit score of 382.0 for HMM based on sequences of FIGURE 11.
  misc_feature: Functional Homolog Of SEQ ID NO. 953
ITRTDSAEKKRVRDESFDEAVLDSPEVKRLRDDLFDVLDDSDPEPVSQDLDSVMKSFEDELSTVTTTTAQGSSTAGETQPDLGYLLEASDDELGLPPPPSISPVPVAKEEVTTETVTDLVRASSDSSGIDEIWGFEDHVSNYGGLDFGSGVGDGGDYVAVEGLFEFSDDCFDSGDLFSWRSESLPAE

SEQ ID NO: 184 - DNA, 729 bp, Populus balsamifera subsp. trichocarpa
  misc_feature: Ceres ANNOT ID no.1522920
  misc_feature: Encodes the peptide sequence at SEQ ID NO. 185
atgggagcagaacctgaaaagtatagcatgattaacttcgaagagactgaattacgtctagggttacctggaggaattggtaacggaaatgatggtgaggttgcaaagagtaatgggaagagagggttttctgagactgttgatttgaagcttaacctctctacaaaggaatcaggaaagggaggcgacgaggagaaagtaatgaaggagaagaccgttgctcctccggcctctactgatcctgcaaagccaccggccaaggcacaagttgtgggttggccacccattagatcattccgtaagaatgtcatggctgtacagaagaacagcaatgacaacggtgaaaaatccggtagcagtggcaccggtgtggcttttgttaaggttagcatggatggtgctccgtatttacgaaaagtggacttgaaattatacaagagctaccaagaactctctgacgctctaggcaaaatgttcagctccttcaccattggtaactgtggctcacaaggaatgaaagatttcatgaatgaaagcaaattgatagatcttttgaatggttccgattatgtgccaacttatgaagacaaggatggagattggatgcttgtaggagatgttccatgggaaatgtttgtggattcatgcaagcgcttgaggattatgaaagggtctgaggctattggacttgccccgagagccgtagagaagtgcaagaacagaatttga

SEQ ID NO: 185 - protein, 233 aa, Populus balsamifera subsp. trichocarpa
  misc_feature: Ceres ANNOT ID no.1522920
  misc_feature: Bit score of 311.4 for HMM based on sequences of FIGURE 3.
  misc_feature (2)..(225): Pfam Name: AUX_IAA Pfam Description: AUX/IAA family
  misc_feature: Functional Homolog Of Ceres SEEDLINE ID no. ME09503 at SEQ ID NO. 129
MINFEETELRLGLPGGIGNGNDGEVAKSNGKRGFSETVDLKLNLSTKESGKGGDEEKVMKEKTVAPPASTDPAKPPAKAQVVGWPPIRSFRKNVMAVQKNSNDNGEKSGSSGTGVAFVKVSMDGAPYLRKVDLKLYKSYQELSDALGKMFSSFTIGNCGSQGMKDFMNESKLIDLLNGSDYVPTYEDKDGDWMLVGDVPWEMFVDSCKRLRIMKGSEAIGLAPRAVEKCKNRI

SEQ ID NO: 186 - DNA, 741 bp, Populus balsamifera subsp. trichocarpa
  misc_feature: Ceres ANNOT ID no.1469532
  misc_feature: Encodes the peptide sequence at SEQ ID NO. 187
atgactagcataatgggagcagaacctgaaaagtatagcatgattaacttcgaagagactgaattacgtctagggttacctggaggaattggtaacggaaatgatggtgaggttgcaaagagtaatgggaagagagggttttctgagactgttgatttgaagcttaacctctctacaaaggaatcaggaaagggaggcgacgaggagaaagtaatgaaggagaagaccgttgctcctccggcctctactgatcctgcaaagccaccggccaaggcacaagttgtgggttggccacccattagatcattccgtaagaatgtcatggctgtacagaagaacagcaatgacaacggtgaaaaatccggtagcagtggcaccggtgtggcttttgttaaggttagcatggatggtgctccgtatttacgaaaagtggacttgaaattatacaagagctaccaagaactctctgacgctctaggcaaaatgttcagctccttcaccattggtaactgtggctcacaaggaatgaaagatttcatgaatgaaagcaaattgatagatcttttgaatggttccgattatgtgccaacttatgaagacaaggatggagattggatgcttgtaggagatgttccatgggaaatgtttgtggattcatgcaagcgcttgaggattatgaaagggtctgaggctattggacttgccccgagagccgtagagaagtgcaagaacagaatttga

SEQ ID NO: 187 - protein, 246 aa, Populus balsamifera subsp. trichocarpa
  misc_feature: Ceres ANNOT ID no.1469532
  misc_feature: Bit score of 316.5 for HMM based on sequences of FIGURE 3.
  misc_feature (15)..(238): Pfam Name: AUX_IAA Pfam Description: AUX/IAA family
  misc_feature: Functional Homolog Of Ceres SEEDLINE ID no. ME09503 at SEQ ID NO. 129
MTSIMGAEPEKYSMINFEETELRLGLPGGIGNGNDGEVAKSNGKRGFSETVDLKLNLSTKESGKGGDEEKVMKEKTVAPPASTDPAKPPAKAQVVGWPPIRSFRKNVMAVQKNSNDNGEKSGSSGTGVAFVKVSMDGAPYLRKVDLKLYKSYQELSDALGKMFSSFTIGNCGSQGMKDFMNESKLIDLLNGSDYVPTYEDKDGDWMLVGDVPWEMFVDSCKRLRIMKGSEAIGLAPRAVEKCKNRI

SEQ ID NO: 188 - protein, 189 aa, Arabidopsis thaliana
  misc_feature: Public GI ID no.15219692
  misc_feature: Bit score of 365.9 for HMM based on sequences of FIGURE 3.
  misc_feature (5)..(189): Pfam Name: AUX_IAA Pfam Description: AUX/IAA family
  misc_feature: Functional Homolog Of Ceres SEEDLINE ID no. ME09503 at SEQ ID NO. 129
MDEFVNLKETELRLGLPGTDNVCEAKERVSCCNNNNKRVLSTDTEKEIESSSRKTETSPPRKAQIVGWPPVRSYRKNNIQSKKNESEHEGQGIYVKVSMDGAPYLRKIDLSCYKGYSELLKALEVMFKFSVGEYFERDGYKGSDFVPTYEDKDGDWMLIGDVPWEMFICTCKRLRIMKGSEAKGLGCGV

SEQ ID NO: 189 - protein, 175 aa, Arabidopsis thaliana
  misc_feature: Public GI ID no.18420964
  misc_feature: Bit score of 119.1 for HMM based on sequences of FIGURE 3.
  misc_feature (5)..(171): Pfam Name: AUX_IAA Pfam Description: AUX/IAA family
  misc_feature: Functional Homolog Of Ceres SEEDLINE ID no. ME09503 at SEQ ID NO. 129
MEEEKRLELRLAPPCHQFTSNNNINGSKQKSSTKETSFLSNNRVEVAPVVGWPPVRSSRRNLTAQLKEEMKKKESDEEKELYVKINMEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 190 - DNA, 741 bp, Arabidopsis thaliana
  misc_feature: Public GI ID no.15235385
  misc_feature: Encodes the peptide sequence at SEQ ID NO. 191
atggaaggcggttccgctagtggatcggcttcggctttgtcaaacgatgaaaatctcgtcgtttcttgtgaggattcttcttctcctatagggaatgagcttgagcttggtcttacgttgagccttggtcgcaaagggtatcgagattgtagggtttacgctgatgattcttcttcttcttcatcatcttcttctctgagcagagctagcgtaattgctgggatcaagaggacagctgattccatggctgcaactagtgggcaagttgtgggatggccaccaataaggacttacagaatgaacagtatggttaaccaagctaaggcttcagccactgaagatccgaacttggagataagtcaagccgtaaacaagaatagaagtgattcaacaaagatgagaaattccatgtttgttaaggtgactatggatggcattcctattggaaggaaaatcgatctgaatgctcataaatgctatgaatcattgtcaaacactctagaggaaatgtttctgaaacctaaattaggttcacgcacactagaaaccgatggtcacatggaaacaccggtcaagatactaccagatgggtcttccggattagtactaacgtatgaagacaaggaaggagattggatgcttgttggcgatgttccgtgggggatgtttattggttcagtgagaaggctccggataatgaaaacatcggaggctactggtaaagctcagatgatattatga

SEQ ID NO: 191 - protein, 246 aa, Arabidopsis thaliana
  misc_feature: Public GI ID no.15235385
  misc_feature: Bit score of 166.9 for HMM based on sequences of FIGURE 3.
  misc_feature (88)..(243): Pfam Name: AUX_IAA Pfam Description: AUX/IAA family
  misc_feature: Functional Homolog Of Ceres SEEDLINE ID no. ME09503 at SEQ ID NO. 129
MEGGSASGSASALSNDENLVVSCEDSSSPIGNELELGLTLSLGRKGYRDCRVYADDSSSSSSSSSLSRASVIAGIKRTADSMAATSGQVVGWPPIRTYRMNSMVNQAKASATEDPNLEISQAVNKNRSDSTKMRNSMFVKVTMDGIPIGRKIDLNAHKCYESLSNTLEEMFLKPKLGSRTLETDGHMETPVKILPDGSSGLVLTYEDKEGDWMLVGDVPWGMFIGSVRRLRIMKTSEATGKAQMIL

SEQ ID NO: 192 - DNA, 1307 bp, Arabidopsis thaliana
  misc_feature: Ceres CLONE ID no.123105
  misc_feature: Encodes the peptide sequence at SEQ ID NO. 193
acacattcgtgtaccgtttccgatttttcgttcctccaatttcattctctctctctttaagaaaaattccttgtttttgatccgagaatcgaagtcgccctcgaatcaagattaaaacctcgtttagttctcaatttcagttctgtggatccgtgcgtgacctcaagttttttttttttttctgtctcgaaattcagaatcgtagaggtgttgaaagttgaaaccttttttttggtttgcttggttaatgggtttcttcaaacttgatcgataattggatttgaatcaagggttttagtgttcttgctttgtgtattcgtttggcaatttgggataatgaatggtttgcaagaagtttgttcgtcaagtgggtcggtgatgatcggactaccagctgaagaagacgaaaacgccgcacattcgtcggaggattcatcttgccccgacgagtcagtgtcagagacagagctcgacctagctttgggtcttagcattggtcgtcggaaggttcgatcgtctttgtcttcctcgtcttcttctctgaccagggaaagtgggaccaaacgctctgctgattcttctccggctgccgcctcaaacgcaaccagacaagttgctgtaggttggccgcctctacggacttacagaatcaacagtttggtcaatcaagcaaagtctttagctacggaaggcggcttgagttctggcattcaaaaggagactacaaaaagtgtagtggttgctgctaagaacgatgatgcttgctttatcaaatcgtccaggacttctatgcttgtgaaggtgacaatggacggagttataattggaaggaaggttgatctcaatgctctggattcttatgcagccttagagaaaactttggatctaatgtttttccagattccttctcctgtaacaagatccaacacacaaggatacaagacaattaaggaaacatgtacttcgaaattactggatggctcatcggaatatatcataacatatcaagataaagacggagattggatgcttgtaggagatgttccttggcagatgttcctcgggtctgtgacaagactgagaatcatgaagacatcaattggagctggagtaggtaagtagagagtcctatatagcaaaaacagtttacatctctttggtctgtaactcatatatcacattcacatatatacatgtgcatatgtttatacatgagtgtacatatgtcttgtggtcgtttgtgaatatcaaacaacagcttaaccttgtytttaaagatctttgtatatttagggtttttcactcgc

SEQ ID NO: 193 - protein, 261 aa, Arabidopsis thaliana
  misc_feature: Ceres CLONE ID no.123105
  misc_feature: Bit score of 125.0 for HMM based on sequences of FIGURE 3.
  misc_feature (94)..(261): Pfam Name: AUX_IAA Pfam Description: AUX/IAA family
  misc_feature: Functional Homolog Of Ceres SEEDLINE ID no. ME09503 at SEQ ID NO. 129
MNGLQEVCSSSGSVMIGLPAEEDENAAHSSEDSSCPDESVSETELDLALGLSIGRRKVRSSLSSSSSSLTRESGTKRSADSSPAAASNATRQVAVGWPPLRTYRINSLVNQAKSLATEGGLSSGIQKETTKSVVVAAKNDDACFIKSSRTSMLVKVTMDGVIIGRKVDLNALDSYAALEKTLDLMFFQIPSPVTRSNTQGYKTIKETCTSKLLDGSSEYIITYQDKDGDWMLVGDVPWQMFLGSVTRLRIMKTSIGAGVGK

SEQ ID NO: 194 - DNA, 1141 bp, Arabidopsis thaliana
  misc_feature: Ceres CLONE ID no.32727
  misc_feature: Encodes the peptide sequence at SEQ ID NO. 195
atttagccctttgtttctctacacacatctcacatccccctatctctctctctcttcaaacgttttagttccccaaaaaaatatcaaaagaactaaaagaaaaaccctagaagccgaagaatctcctactcgttgtcgatcggatcacctaactaattactcgttgataatcattatatcgagaaatatgattaattttgaggccacggagctgagattagggctaccgggtgggaatcacggaggagaaatggctggaaaaaataatggtaaaagaggattttctgagactgttgatctcaaactgaatctttcatcgacggctatggattcagtttccaaagtcgatttagagaatatgaaggagaaggtcgtaaaaccaccagccaaggcacaagttgtgggatggccaccggtacgatctttccgcaagaacgtcatgtccggccaaaaaccgaccaccggagatgccaccgaaggaaacgataagacttctggcagcagtggagccacctcatccgcctccgcatgtgccaccgtggcttatgtgaaggttagcatggacggtgcaccgtacctacggaaaattgacttgaaactctacaaaacttaccaagatctctccaacgccttaagcaaaatgtttagctcttttaccataggcaactatggaccacaaggaatgaaagatttcatgaatgagagtaaattgatcgatcttctaaacggatcagattatgttccaacatatgaagataaagatggcgactggatgcttgtaggagacgtaccgtgggagatgtttgttgattcatgcaaacgtatacgaataatgaagggatcagaagcaatcggacttgctccaagggcattagaaaagtgcaagaacagaagttgagttctcgacgacatttcgtgttcttacctaaaaaaggaagaaagcctgtttcgatcggttggatatctcgaaccgagaaagctaaaccggctcgaaactattgttccgagcaaggagtttgcttataatattaattaataataatattaatattgtcggtgtattacattttaaaaaattaaatcgtttttgttatatgtattatatacatatattaatatgtatatttaattaggttgcatc

SEQ ID NO: 195 - protein, 236 aa, Arabidopsis thaliana
  misc_feature: Ceres CLONE ID no.32727
  misc_feature: Bit score of 313.8 for HMM based on sequences of FIGURE 3.
  misc_feature (2)..(228): Pfam Name: AUX_IAA Pfam Description: AUX/IAA family
  misc_feature: Functional Homolog Of Ceres SEEDLINE ID no. ME09503 at SEQ ID NO. 129
MINFEATELRLGLPGGNHGGEMAGKNNGKRGFSETVDLKLNLSSTAMDSVSKVDLENMKEKVVKPPAKAQVVGWPPVRSFRKNVMSGQKPTTGDATEGNDKTSGSSGATSSASACATVAYVKVSMDGAPYLRKIDLKLYKTYQDLSNALSKMFSSFTIGNYGPQGMKDFMNESKLIDLLNGSDYVPTYEDKDGDWMLVGDVPWEMFVDSCKRIRIMKGSEAIGLAPRALEKCKNRS

SEQ ID NO: 196 - DNA, 927 bp, Arabidopsis thaliana
  misc_feature: Ceres CLONE ID no.41161
  misc_feature: Encodes the peptide sequence at SEQ ID NO. 197
atcaacaagtctttctctctctctagacaaccacaagaacacaaaacacacaaaaacaaagaggttctttctttgaagaagaaatggaaaaagttgatgtttatgatgagcttgttaacctaaaggcaacagagctgagattgggattaccagggacagaagaaactgtttcttgtggaaaaagcaacaaaagagttttacctgaagctactgagaaagagattgaatccactggaaaaactgaaaccgcttctcctccaaaggctcagattgttggatggccaccagttagatcttacagaaagaacaatgttcagacaaagaagagtgaatctgaaggtcaaggaaactatgtgaaagtaagtatggatggtgctccatatctaaggaagatagatctaacgatgtataaacaatatccagagttgatgaaatcacttgaaaacatgtttaaattctctgtgggagaatattttgagagagaaggatataaaggctcagactttgtacctacttatgaagacaaagatggtgattggatgcttgttggtgatgttccttgggagatgtttgtttcgtcttgtaagaggctaaggatcatgaaaggatctgaagttaaaggtttaggttgtggtggtctttaacaaacctaattgagagataaagatcaaagagaaagattcaaaaacagagttttttgttctgtttcttgaaacagagtaaatatagctctgaaactgctcgggttcttggggagagatgtttcatacaatcatactttgtgaatgtttacctcatcggtaaaaagagagatgcttaaaatggtcttaagcataaaagtgtgagaaagatctaaatctaaactttagctgtaactctgtctccattaaagagaaaggttttgtggtattagaaaggtctaatccg

SEQ ID NO: 197 - protein, 186 aa, Arabidopsis thaliana
  misc_feature: Ceres CLONE ID no.41161
  misc_feature: Bit score of 380.8 for HMM based on sequences of FIGURE 3.
  misc_feature (11)..(185): Pfam Name: AUX_IAA Pfam Description: AUX/IAA family
  misc_feature: Functional Homolog Of Ceres SEEDLINE ID no. ME09503 at SEQ ID NO. 129
MEKVDVYDELVNLKATELRLGLPGTEETVSCGKSNKRVLPEATEKEIESTGKTETASPPKAQIVGWPPVRSYRKNNVQTKKSESEGQGNYVKVSMDGAPYLRKIDLTMYKQYPELMKSLENMFKFSVGEYFEREGYKGSDFVPTYEDKDGDWMLVGDVPWEMFVSSCKRLRIMKGSEVKGLGCGGL

SEQ ID NO: 198 - DNA, 1403 bp, Arabidopsis thaliana
  misc_feature: Ceres CLONE ID no.37274
  misc_feature: Encodes the peptide sequence at SEQ ID NO. 199
aaaatttaccactccttccatgtttttgtttctctcttcttcttgattgttgcgcttttgttagctttctctggttcattttccatggacggaccttgacctctctgcttcccttcgtgcattttctctctctcactatcctctctctttctagtgtttgtttgatcctctgcgtactctgttcttcttctctcttcagataaaacaagtcctgcatattgaagatctgatgtcttatcgattgctaagtgtggataaggatgaactggttacgtcaccttgtttgaaagaacgtaactacttgggtctctctgattgttcctctgttgatagctcaactattcccaatgttgttgggaagagcaatctcaatttcaaagctactgaactgaggctaggtcttcctgagtctcaatctcctgagagagagactgatttcggtttgctgagtccgagaacacccgatgagaagcttctcttcccgttgctaccttctaaagacaatggttctgctactacagggcataagaatgttgtttctggtaacaagagaggatttgctgacacttgggatgagttttcgggtgtgaaaggatctgttagacccggaggaggaatcaacatgatgttgtcgccgaaagttaaggatgtctcgaagagtattcaagaagaaagatctcatgctaagggtggcttgaacaatgcaccagctgccaaggcacaggttgttggttggcctccaatcagatcataccggaagaatacaatggcttcttctacttcgaagaacactgatgaggttgatgggaaacctggtcttggtgttctgtttgtgaaggtgagcatggatggtgctccgtatctgagaaaggtcgacttgagaacttacacttcctatcaacagttgtcttctgcacttgagaaaatgttcagctgcttcacccttggtcaatgtggtcttcatggtgctcaagggagggaaagaatgagcgagattaaactgaaggatcttcttcatggatcagaatttgtgcttacttatgaagataaagatggtgattggatgcttgttggcgatgtcccatgggagatatttactgaaacatgccagaaactgaagatcatgaagggttctgattctattggcttagctccaggtgcagtggagaaatcgaagaacaaagagcgggtttgaaacgaagatgctcaagacaaaaaaaaaacactatgcacagttccaatgtttaagttttatttactgatgtgtttgaaaactctttagtctttttactaatttgtgttgtaagactttggattctcttatttgtgtgtgcttgttcaaaacaaatacattcttatgtgtgtgtttctactttgaccttcaagatatttcgtctctacgc

SEQ ID NO: 199 - protein, 321 aa, Arabidopsis thaliana
  misc_feature: Ceres CLONE ID no.37274
  misc_feature: Bit score of 270.5 for HMM based on sequences of FIGURE 3.
  misc_feature (47)..(311): Pfam Name: AUX_IAA Pfam Description: AUX/IAA family
  misc_feature (47)..(311): Pfam Name: AUX_IAA Pfam Description: AUX/IAA family
  misc_feature: Functional Homolog Of Ceres SEEDLINE ID no. ME09503 at SEQ ID NO. 129
MSYRLLSVDKDELVTSPCLKERNYLGLSDCSSVDSSTIPNVVGKSNLNFKATELRLGLPESQSPERETDFGLLSPRTPDEKLLFPLLPSKDNGSATTGHKNVVSGNKRGFADTWDEFSGVKGSVRPGGGINMMLSPKVKDVSKSIQEERSHAKGGLNNAPAAKAQVVGWPPIRSYRKNTMASSTSKNTDEVDGKPGLGVLFVKVSMDGAPYLRKVDLRTYTSYQQLSSALEKMFSCFTLGQCGLHGAQGRERMSEIKLKDLLHGSEFVLTYEDKDGDWMLVGDVPWEIFTETCQKLKIMKGSDSIGLAPGAVEKSKNKERV

SEQ ID NO: 200 - DNA, 819 bp, Brassica napus
  misc_feature: Ceres CLONE ID no.981738
  misc_feature: Encodes the peptide sequence at SEQ ID NO. 201
acaagaagagaagtgtgtgtgaaaagaaagttctcatatttcaaaataataaagaagttaagaaatggagaaagatggactcgagcttgagataacggagctgagacttggacttccggggagagatgtgacggagaagatgatgaagaagagaggtttcacggagatgatcatgacgtcttccggaagtcatagtgaacaatgtgagagcagcgttgtttcatctggtgttgacgtggagaaggttaatgaaacgccggcggtgaaaactcaggtggtggggtggccgccggtttgctcttaccggaggaaaaacagctgtaaggaagtttcgacgacgaaagtggggttagggtatgtgaaagttagcatggatggtgtaccttacttgaggaagatggatcttggttcaagccaaggttatgatgatttagcctttgctcttgataagctcttcggtttccatggcattggagtggccttgaaagatggtgataactgcgaatacgttaccatatacgaagacaaagatggagattggatgctcgcgggagatgtaccttggggaatgttcatagagtcatgcaggagggtgaggattatgaaaagatccgaggstaccggatttgggctgcmacctaraggattagacgagtgatatgacggcttgaacaaratgcaagcgamtggttcattaatttaacctttaactggaccaagatcatttagaacmttttccaactcacgttatatgtagtatatcttakacagtactattytgtaagacaatttcaagttatggtttgcataattatcttc

SEQ ID NO: 201 - protein, 197 aa, Brassica napus
  misc_feature: Ceres CLONE ID no.981738
  misc_feature: Bit score of 421.2 for HMM based on sequences of FIGURE 3.
  misc_feature (6)..(192): Pfam Name: AUX_IAA Pfam Description: AUX/IAA family
  misc_feature: Functional Homolog Of Ceres SEEDLINE ID no. ME09503 at SEQ ID NO. 129
  misc_feature (185)..(185): Xaa is any aa, unknown, or other
  misc_feature (191)..(191): Xaa is any aa, unknown, or other
  misc_feature (193)..(193): Xaa is any aa, unknown, or other
MEKDGLELEITELRLGLPGRDVTEKMMKKRGFTEMIMTSSGSHSEQCESSVVSSGVDVEKVNETPAVKTQVVGWPPVCSYRRKNSCKEVSTTKVGLGYVKVSMDGVPYLRKMDLGSSQGYDDLAFALDKLFGFHGIGVALKDGDNCEYVTIYEDKDGDWMLAGDVPWGMFIESCRRVRIMKRSEXTGFGLXPXGLDE

SEQ ID NO: 202 - DNA, 1165 bp, Glycine max
  misc_feature: Ceres CLONE ID no.538020
  misc_feature: Encodes the peptide sequence at SEQ ID NO. 203
gttatgttcttacaagttctatatatatatatatatatacatacatacgcatacttacttgagtcacttgtttaaatatttttctgtttcaaaaaattggaacctttcactgttgaattttgatgactacacccttggaacatgattacataggcttatcagaggctccatccatggagaaaagctgtgataagatatcctcttcagtttcctccaatctttcttctgaggatgagaacactacttcatctctgaacttcaaggagacagagctgaggcttggcctgccaggttgtgattctcctgagaacaacaacaaatcaggggtctctctttttggcaaggatttgcagaagaagaataatggctattcttctgcttcttcaactccttccaacaagaacctcaagaggggcttccctgatgccattagctcttcttcttcctcttctgggaaatggattttctcggcgagtgatgcagcaactgaagctgatttggaaagtggttctaatatctctggaggatgcaacaaagaggttggaatggttcctcactatgagaaaccagctcaagttgctgcaacaaatgaacatgctcctgctcctgctccaaaagcacaagttgtgggatggccaccaattcgatcttttcgaaagaacacgatgatggcttataatttggcaaaatgtgacaacgaagctgaggagaaatcaggagtaggttgtctttacgttaaggtcagcatggatggtgctccatatctcagaaaggttgatctgaaaacctacagcaactatattgaactttcttcagctcttgagaaaatgttcagctgctttaccattggtcaatgcaattctcgtgcacttcctgggaaagatggattaagtgagagtgcattcagggatcttgttgatggctctgaatatgttcttacatatgaagataaggaaggagactggatgcttgtgggtgatgtcccttggaaaatgttcactgagtcatgtaagaaactaaggataatgaaaggctctgaggcaatcgggctagctccaaggggtatggaaaaatttaggagccaatactagtacagaagattctgctccaccactgggtcattcactgaagcatataaagaaggtttagaggagaatttgagctt

SEQ ID NO: 203 - protein, 322 aa, Glycine max
  misc_feature: Ceres CLONE ID no.538020
  misc_feature: Bit score of 319.1 for HMM based on sequences of FIGURE 3.
  misc_feature (44)..(314): Pfam Name: AUX_IAA Pfam Description: AUX/IAA family
  misc_feature: Functional Homolog Of Ceres SEEDLINE ID no. ME09503 at SEQ ID NO. 129
MTTPLEHDYIGLSEAPSMEKSCDKISSSVSSNLSSEDENTTSSLNFKETELRLGLPGCDSPENNNKSGVSLFGKDLQKKNNGYSSASSTPSNKNLKRGFPDAISSSSSSSGKWIFSASDAATEADLESGSNISGGCNKEVGMVPHYEKPAQVAATNEHAPAPAPKAQVVGWPPIRSFRKNTMMAYNLAKCDNEAEEKSGVGCLYVKVSMDGAPYLRKVDLKTYSNYIELSSALEKMFSCFTIGQCNSRALPGKDGLSESAFRDLVDGSEYVLTYEDKEGDWMLVGDVPWKMFTESCKKLRIMKGSEAIGLAPRGMEKFRSQY

SEQ ID NO: 204 - DNA, 1688 bp, Glycine max
  misc_feature: Ceres CLONE ID no.476244
  misc_feature: Encodes the peptide sequence at SEQ ID NO. 205
ggagcttttgttactttgtgacaaatggagggtccttagttctgtttctctttcttctctctgttctctcaaccaagttctcaattcaatcttcttcacccttttgatctgctaattctcaaggtattcaaaattgggaggttttcgtttgaattgtgatgtccaagccactgctaggcataggggaggaggaaggtcaaagcaatgtcactttgttggtttcttcctcagtcatcatggaaagtgtgtgcctgaatagctcaaaattgaaagagcgcaactacatggggttatctgattgttcatctgtggacagctccgcgccgtccttctcagatgagactaaaagcaatctgaaccttaaggctactgagctgagactggggcttccgggattgcagtctcccgaacgagattcagatctttgcttgagaagttcaattcagtttgatgaaaaaccactgtttcctttgcatcctgctactgatgatcaccattcctcatcaaagcctgctgttttgggtaacaaaagagggttctcagatgtcatgagtggattcgccgaggagaaattgcttgttagttctgaggtcaacacaatattgtcaccaaggccttcttctaatgtggcattgaaaccaagctctatgcttgagaatgttggggctcagcaatccaaagccaaagaactcgcaacagcgaaggttggtcttgagaggtctcatgttttcaatgatagcagaacaaatctgaatgattctgctaataacaatagcagtgcaccagctaccaaggcacaggttgttggttggcctcctataagatcatttaggaaaaattcactggccactactacaaagaatgttgaagaagtggatggaaaagcggggtctggtgcactgtttgtaaaggtcagtatggatggtgctccttatttaagaaaagtagacttgaagaattactctgcgtatgccgaactatcttctgcgctggagaacatgttcagctgttttaccataggttcttgtggatctcatggaaatctgggaggggaggtgctgaatgaaaccaagctgaaggatctgcttcatggatcagaatatgttcttacgtacaaggataaagatggcgactggatgctagtgggtgatgttccctgggagatgtttattgagacatgcaagaggctaaggatcatgaagagctccgaagccattggtctagcaccaagagctgttgaaaaaagtaagagaaggaactaggcagtatcaagcatctcatcacactctatccatctaactgcttatggggttaaaaagctttcttggctatgtgagggagcaacacaaggccataatggcttggaaacacaactctaggcatgttggactggatagaatttcgtactaaagctgccttgttgatcatgatattatttactatcagtgtgttctgttgtcatgatgttttatattcagtaagcttttttcatgattgtcacaacttataaaaccccaaaaaacctgtctgtgggaggttcttatattttatgtgctgtcatgttcatgttgtggtgaaggatttgtagtttgtaaattgcatcatctcttatatgtttgcaactttgtgtgataaaaaacaccaagttgttatatatgtaatgcaccttcaactgtttctcttttgtt

SEQ ID NO: 205 - protein, 325 aa, Glycine max
  misc_feature: Ceres CLONE ID no.476244
  misc_feature: Bit score of 292.4 for HMM based on sequences of FIGURE 3.
  misc_feature (24)..(317): Pfam Name: AUX_IAA Pfam Description: AUX/IAA family
  misc_feature: Functional Homolog Of Ceres SEEDLINE ID no. ME09503 at SEQ ID NO. 129
MGLSDCSSVDSSAPSFSDETKSNLNLKATELRLGLPGLQSPERDSDLCLRSSIQFDEKPLFPLHPATDDHHSSSKPAVLGNKRGFSDVMSGFAEEKLLVSSEVNTILSPRPSSNVALKPSSMLENVGAQQSKAKELATAKVGLERSHVFNDSRTNLNDSANNNSSAPATKAQVVGWPPIRSFRKNSLATTTKNVEEVDGKAGSGALFVKVSMDGAPYLRKVDLKNYSAYAELSSALENMFSCFTIGSCGSHGNLGGEVLNETKLKDLLHGSEYVLTYKDKDGDWMLVGDVPWEMFIETCKRLRIMKSSEAIGLAPRAVEKSKRRN

SEQ ID NO: 206 - DNA, 1495 bp, Glycine max
  misc_feature: Ceres CLONE ID no.1623662
  misc_feature: Encodes the peptide sequence at SEQ ID NO. 207
atcaacaaaaccagctcctggacttgcttgcatactctctctttctttctattcaaagatctgtaaatttatatattatcttttatcatatatagtattagtatagtccacttgtttaaaccacctgtgttgcatattctgaatcctatcatcttgtggctttgatgtctagagcattggaacatgattacatagggttggcagagaatccgtcaatggatggtaaaaactcatcatcactgaacttgaaggagacagagctgaggcttggcctccctggttgcgagtctccagagagaaaatcaggttctgcactctgtctttttggcaaagagttgcagaacaacaataacaatgtttgttctttgaaggctggggccaagaggggcttctctgatgccattgacacctcttctgtcactgagggatctcaaggagcttctgctttgttctctccaagaggtggcaatgttgggaagcctcttattggtttagacactcaaactaacaccaccatcaaagaggttggtgcagttcctcaatcagccaaaccggttcaggaaaacaatgatcagtttgctgcaacaaatgcccatgcaattgctcctgctgctaaggcacaagttgtgggatggccaccaattcgatctttccgaaagaacacgatggcctctaatttgacaaagaacaatgatgaagctgagggaaaatcaggatttggttgtctctatgtgaaagtcagtatggatggtgccccttatcttagaaaggttgatctcaaaacctataacaactatatggaactttcctcagctcttgagaagatgttcagctgcttcaccattggtcaatgcaattctcctggacttcctgggaaagatggactaagtgagagctctttgagggatcttctccatggatctgaatatgttcttacatatgaagataaagatggagactggatgcttgtgggtgatgttccttgggagatgttcactgattcatgtcggagactaaggatcatgaagggctctgaggcaattgggctagctccaagggccatggaaaaatctaggagccaaaactaatgcagaaaaaaccccattagaccaaagcggggggtattcattgaagcatataaagatttccaagggtgtttgagtttatgattctgttcaaaatcaaaaacatatgctattcagtgtctcagtttttgtgcattaatatatatagtatgacaagttttatcagtagaattcaactggagacatccagacaatatatacacatattttgtttgtttctctattttgtgtatccttggattctagttgctgtataaaagaattgcttgttgtgcttttccctgtttccctctataactattctgaattttcttcatgtattttattttcattatacatactgaacatttgtattttgttattaaatggtaataaccatatctcttggtcaaaaaaaaaaaaaaaaaaaa

SEQ ID NO: 207 - protein, 307 aa, Glycine max
  misc_feature: Ceres CLONE ID no.1623662
  misc_feature: Bit score of 336.4 for HMM based on sequences of FIGURE 3.
  misc_feature (26)..(299): Pfam Name: AUX_IAA Pfam Description: AUX/IAA family
  misc_feature: Functional Homolog Of Ceres SEEDLINE ID no. ME09503 at SEQ ID NO. 129
MSRALEHDYIGLAENPSMDGKNSSSLNLKETELRLGLPGCESPERKSGSALCLFGKELQNNNNNVCSLKAGAKRGFSDAIDTSSVTEGSQGASALFSPRGGNVGKPLIGLDTQTNTTIKEVGAVPQSAKPVQENNDQFAATNAHAIAPAAKAQVVGWPPIRSFRKNTMASNLTKNNDEAEGKSGFGCLYVKVSMDGAPYLRKVDLKTYNNYMELSSALEKMFSCFTIGQCNSPGLPGKDGLSESSLRDLLHGSEYVLTYEDKDGDWMLVGDVPWEMFTDSCRRLRIMKGSEAIGLAPRAMEKSRSQN

SEQ ID NO: 208 - DNA, 1112 bp, Glycine max
  misc_feature: Ceres CLONE ID no.565974
  misc_feature: Encodes the peptide sequence at SEQ ID NO. 209
ggcatctcatttctcaattctcacattattattcatatctctctctctctcccccaagaaattcaacagagttttgattaacttgaaattgttcaacaagaaatggagaattcattgggaaagtacggaaaagagcttaatctcgaggctacagagttgaggttggggttgcctggaagcgatgagcctgagaaacgttctgctgttagaagcaacaagagatcttcaccagaagcaagtgaagaagagtgcataagcaagggcaacatgaattcttctgatggttctgatatcacaagtgatgaccaagacaacgttgtgccacctgcaaaggcacaagtagtgggatggccaccggttcgatcatataggaagaatagtctacaacaaaagaaagaagaacaggctgaaggggctgggatgtacgtgaaagttagcatggaaggtgcaccttacttgaggaagatagatctaaaggtttacaagagctacccagaactcctcaaggccttggaaaacatgttcaagtgcacatttggtcaatattcggaaagggaagggtataatggatctgaatatgctccaacttatgaagacaaggatggggattggatgctggttggagatgttccatggaacatgtttgtgtcatcctgcaagaggctgagaattatgaaaggatcagaagcaaaggggttgggttgtttttgacccaaaaaccaaagcaggaccatcatgcatacccatatccaaaacatggagcaaagcaatttaccgtgacgtcatccattggaatttcttctgtttggaacatgcaagctagctagctagctagcacttggcctctgtgaatggtcatataaattagcttattgaaaagagagatgcacatacacggttttatttttcctttatttgtttatttcaaaagctaggtgactttttagacctgcttaaaacactattccaaattytcaaagcctaaaccagaattgaaaactgtaatgaaatgagaagagatcgaataaaagcaaaggaaaaaaaaacactattctcatgtgtctggttacgtacaaaatatatatacaaagggatcaagaagtaggaacttc

SEQ ID NO: 209 - protein, 202 aa, Glycine max
  misc_feature: Ceres CLONE ID no.565974
  misc_feature: Bit score of 468.6 for HMM based on sequences of FIGURE 3.
  misc_feature (12)..(202): Pfam Name: AUX_IAA Pfam Description: AUX/IAA family
  misc_feature: Functional Homolog Of Ceres SEEDLINE ID no. ME09503 at SEQ ID NO. 129
MENSLGKYGKELNLEATELRLGLPGSDEPEKRSAVRSNKRSSPEASEEECISKGNMNSSDGSDITSDDQDNVVPPAKAQVVGWPPVRSYRKNSLQQKKEEQAEGAGMYVKVSMEGAPYLRKIDLKVYKSYPELLKALENMFKCTFGQYSEREGYNGSEYAPTYEDKDGDWMLVGDVPWNMFVSSCKRLRIMKGSEAKGLGCF

SEQ ID NO: 210 - DNA, 1177 bp, Glycine max
  misc_feature: Ceres CLONE ID no.626817
  misc_feature: Encodes the peptide sequence at SEQ ID NO. 211
catctcaagtcttatcrtcttcatctcccaagggattcaatacaataccaggctagaagaaactccactcatcaccatctcaagcaactaattaacaagctagtactctttgagtgtttggcaattggcttagatttcttgtacttggaacaagatggaaagcactgtcacatttgagactgatctcaacctcaaggcaaccgagcttagattggggcttccaggaacagaagaaattgttgaaaaaccacttcctgcaagtgctagaattaccaacaaaaggcctttgtctgaaacctctgaggagtgtgcttcaaagggttctagtgctccacatgtggaaactgaagcagcccctcctgccaaggctaagatagtggggtggccaccaatcagatcctacagaaagaacagccttcaggagaatgatggtgctgggatttatgtgaaagtgagcatggatggagctccttacctcagaaagatagacttgaaggtctatggaggctacacacaactcctcaaagctctagaaaacatgttcaagttgaccataggtgagtattctgaaaaagaaggttataagggatctgactatgcacctacatatgaagacaaagatggtgactggatgttagttggagatgttccatgggacatgtttgtgacttcttgcaaaaggctaagaatcatgaaaggatcagaggcaaggggtttgggttgtgctgtatgagaaaaccaaaccactaaaaattactatgagcagagaattaaaaaaagtgttttgggggtgaagggaaaaacatgctgaaaagcttgtgttctcggatctgaagggttttgacttttgaaatcactctagtgtgtgcttttggcatacctttatatggagttatactctgaagcaggagaagatggaagatacggtgcagtttcgatcttcctcaagtttggcaacttttatggttattattttggcatctgtggttggatgctatgcttatgatgttgtttccactgatcctttttgaagtttcatgtgagaaatcttagagatttcaaatgaaactttgtgtagaggagagatagaaaattaaaggttatatgtaatattgtttaatccaagttttttggttgtgttgatacaagaatacaatgtaatatactaagtgttggt

SEQ ID NO: 211 - protein, 192 aa, Glycine max
  misc_feature: Ceres CLONE ID no.626817
  misc_feature: Bit score of 397.2 for HMM based on sequences of FIGURE 3.
  misc_feature (11)..(192): Pfam Name: AUX_IAA Pfam Description: AUX/IAA family
  misc_feature: Functional Homolog Of Ceres SEEDLINE ID no. ME09503 at SEQ ID NO. 129
MESTVTFETDLNLKATELRLGLPGTEEIVEKPLPASARITNKRPLSETSEECASKGSSAPHVETEAAPPAKAKIVGWPPIRSYRKNSLQENDGAGIYVKVSMDGAPYLRKIDLKVYGGYTQLLKALENMFKLTIGEYSEKEGYKGSDYAPTYEDKDGDWMLVGDVPWDMFVTSCKRLRIMKGSEARGLGCAV

SEQ ID NO: 212 - DNA, 1104 bp, Glycine max
  misc_feature: Ceres CLONE ID no.537469
  misc_feature: Encodes the peptide sequence at SEQ ID NO. 213
attcttcaatcaatctctttacctaattatatatatatacacatctttctctctttctcagaaatcagaattgagcaagcgattggatttggataactgaaggtgatcatcattttagatattattataagaagttcatcaaataattgatcagaaatattcgatggggagctttgaaactgagctgaatcttaaggccacagagttgaggttgggattacccggctgtgatgaaactcatgacaaaagttcatccagtagtggatctgttgttagaagcaacaagagatcttcaccagaacccagtgtggaagagtccaggtgcaactctaatggttcttcagattctaccaccacaagtgatcatgatgaagacagtgtccaacctgcaaaggtacaagtagtggggtggccaccaattagatcttttaggaagaacagtctgcaacaacagaagaaggtggagcagcagggtgatggaagtggaacgtatttgaaagtgagcatggctggtgcaccttacttgaggaagatagatctgaaggtttacaatagctacccagaactcctcatggccttgcaaaatttgttcaagtgcacatttggtgaatattcagagagggaaggttacaatggatctgaatacgctcctacttatgaagacaaggatggtgactggatgctggttggagatgttccatggaacatgtttgtatcctcctgcaagaggctgaaaataatcaaaggatcagaagcaaaggggttgggttgtttgtgaccaacaaaacttgcaaaagcaaatcaaatcaaaatagtcacatgaggtcttcaaagacaaataccctttgtgttgtgcaagcaaatacatggtgtttatgagaactcatatatatatatatatatattaggaaaatagatggatattatctatgtatacattatttttgctttattaatttcagcagaggcggctttgaggtctgctttctaaattatatgtaatcctctaaaaaagaaagagaaagaaaatataagaaaagctaatgctatttcrattgtacagatcaaaaatataataataataataatctcmctttgtcttag

SEQ ID NO: 213 - protein, 204 aa, Glycine max
  misc_feature: Ceres CLONE ID no.537469
  misc_feature: Bit score of 395.7 for HMM based on sequences of FIGURE 3.
  misc_feature (8)..(204): Pfam Name: AUX_IAA Pfam Description: AUX/IAA family
  misc_feature: Functional Homolog Of Ceres SEEDLINE ID no. ME09503 at SEQ ID NO. 129
MGSFETELNLKATELRLGLPGCDETHDKSSSSSGSVVRSNKRSSPEPSVEESRCNSNGSSDSTTTSDHDEDSVQPAKVQVVGWPPIRSFRKNSLQQQKKVEQQGDGSGTYLKVSMAGAPYLRKIDLKVYNSYPELLMALQNLFKCTFGEYSEREGYNGSEYAPTYEDKDGDWMLVGDVPWNMFVSSCKRLKIIKGSEAKGLGCL

SEQ ID NO: 214 - DNA, 1143 bp, Glycine max
  misc_feature: Ceres CLONE ID no.582463
  misc_feature: Encodes the peptide sequence at SEQ ID NO. 215
ctgaagaagcctagcttgtttcattgttgtccaacacaaactattgctttgtactttgcatagaaaacaagtatcaagagatttggtggtggaggattctgataatctggtcacaggggaagatggaaagcagagtggtatttgagaatgatttgaatctcaaggcaacagagctaagattggggttgccagggacggaggacaaaaccgtgcatgctattagtattagaaacaacaaaaggcaagtgcctgaaacttctcaagagtctgtttccatttccaaggcctcacctgaccagcatgtggagagtgatccagcccctccagccaaggcaaagatagtggggtggccaccaatcagatcttacaggaaacaaagcctgcaggagggtgatcagggggatgggatctatgtgaaagtgatcatggatggagcaccttacctcagaaagattgacttgaaagtctataggggctatcctgaactactcaaagctttagaaaccatgttcaagttgaccataggtgagtactctgaaagagagggttacaagggttctgaatatgcacctacatatgaagacaaagatggtgactggatgctagttggagatgttccatgggacatgtttatgacttcctgcaaaaggctaagagtcatgaaaggctcagaagctagagggttgggttgtggtgtgtgacaaacagttaatttactatggctatgatgaggagattaaatcattctttcatcaattcagttcttggaactaagggattttgaatcaatgcttagctatctgtctatctatcaccatgccaatctgggaggactctaaagtagggatatggaaggctctttctacaagttttgtcaatatttctggttattaattttagcatatgtgattgggggtgctatatgctattatttccattgaaccctttcaagaggaacctcagagaaatttgtcttaaacgaagtttgtggacaagagagataaaagggattgatttgttcatccaaggtttttttttttctttttctttttatctcacacaaaaatatagtgtaatacatcaaatattcatgtaatactttgcaattcaatggacacaaaattaacaaaaaaaaaaaaaaaa

SEQ ID NO: 215 - protein, 192 aa, Glycine max
  misc_feature: Ceres CLONE ID no.582463
  misc_feature: Bit score of 374.7 for HMM based on sequences of FIGURE 3.
  misc_feature (11)..(192): Pfam Name: AUX_IAA Pfam Description: AUX/IAA family
  misc_feature: Functional Homolog Of Ceres SEEDLINE ID no. ME09503 at SEQ ID NO. 129
MESRVVFENDLNLKATELRLGLPGTEDKTVHAISIRNNKRQVPETSQESVSISKASPDQHVESDPAPPAKAKIVGWPPIRSYRKQSLQEGDQGDGIYVKVIMDGAPYLRKIDLKVYRGYPELLKALETMFKLTIGEYSEREGYKGSEYAPTYEDKDGDWMLVGDVPWDMFMTSCKRLRVMKGSEARGLGCGV

SEQ ID NO: 216 - DNA, 975 bp, Glycine max
  misc_feature: Ceres CLONE ID no.1069818
  misc_feature: Encodes the peptide sequence at SEQ ID NO. 217
agacacgcgaaagcaaacacacagggagcgaagaagaaacccagctaggggcgtctggtgcattggcgcaggagaccaatggcgggcctcgggtttgaggagaccaagctccggctcggcctgccaggcggcagcaacgaggccgaggaggcggccgccgcggtgaggagctccggcaagaggggctacgccgagaccatcgacctcgtgctgaagctggagccagcgtcggcggccgcgccgccgtccgaggacgacgaggaagtggccgatggtgtcgcggaggcgcagccctctccggctgctgccgacgggcagttgaagcggtcgccgagccagtgcagcgtggtcaccgccgcgcagccggacgcggaccccgagaagccgcgcgcgcccaaggcgcaggcggtggggtggccgccggtgcggtcgttccggaggaacatgctggcggcgacggcggagagagggggggcggcgctggtgaaggtgagcatggacggcgcgccctacctgcgcaaggtggacatgggcacctacaagagctaccaggagctgtccaaggccctggagaagatgttcagctccttcaccatcggcaacgactgctcgcaggctcaggggatgacgggcatgaacgagagcaagctggtggacctgctcaacggctccgactatgtgcccacctacgaggacaaggacggcgactggatgctcgtcggcgacgtcccctgggagatgttcgtcgcgtcctgcaagcgcctccggataatgaaaggatcagaagccatcggcctggcaccaagggcaatggagaaatgcaagagcaggagctgaccgtttgctaccaattcaagattatggctctgcttgcccaactatgtaccatactatactgcgtactcctacttcctatgttttatcttgttgttatatatgtgtagtatgtatacgtgaggaaaaaaaaaaaaaaaa

SEQ ID NO: 217 - protein, 252 aa, Glycine max
  misc_feature: Ceres CLONE ID no.1069818
  misc_feature: Bit score of 283.6 for HMM based on sequences of FIGURE 3.
  misc_feature (4)..(244): Pfam Name: AUX_IAA Pfam Description: AUX/IAA family
  misc_feature: Functional Homolog Of Ceres SEEDLINE ID no. ME09503 at SEQ ID NO. 129
MAGLGFEETKLRLGLPGGSNEAEEAAAAVRSSGKRGYAETIDLVLKLEPASAAAPPSEDDEEVADGVAEAQPSPAAADGQLKRSPSQCSVVTAAQPDADPEKPRAPKAQAVGWPPVRSFRRNMLAATAERGGAALVKVSMDGAPYLRKVDMGTYKSYQELSKALEKMFSSFTIGNDCSQAQGMTGMNESKLVDLLNGSDYVPTYEDKDGDWMLVGDVPWEMFVASCKRLRIMKGSEAIGLAPRAMEKCKSRS

SEQ ID NO: 218 - DNA, 1616 bp, Glycine max
  misc_feature: Ceres CLONE ID no.511737
  misc_feature: Encodes the peptide sequence at SEQ ID NO. 219
ggtttttctgtcttaaggcttcattcattgagcttttctcttcttatttctatttctctctccccaaaagcttttgtttctctctgcttatggaaggcccttaaactttcgctctctctgcttcactttctcgcttttgcattttcttgtgaaaaaaaaaaatcctcagaacaaaaataggtcttcttcttctctgatctaccaaagcttcaaattctccttagtttggtttgtctgtgagtttggagtgtaatgtcgccgccgacgctggtaacggaggaggaggggcggagcaccgtggcgtccgattcttcgcaatccttggactgtttctctcagaatggtgctggattgaaagaacggaattacttagggttgtctgattgctcatcagtggatagctgtgcctctactgtgccaagcttgtgtgatgagaaaaaggagaacatgaatttgaaggctacagagttgaggcttggtcttcccggattccaatcgcctgaaagggaaccggatcttttctctttaagctcaccaaagcttgatgagaagccactcttccctttgcttcctactaaagacgggatttgctcgtcggggcagaaagctgttgtttctggcaacaaaagaggttttgctgataccatggatgggttttctcaggggaagtttgctggtaatacagggatgaacgcggtgctatcacctagaccttctggagctcaaccttctgctatgaaagaaacaccaagcaaattgtcagaacgtccttgctcaactaataatggaaccggtcataaccatacaggtgcttctatcagtggcagcgcaccggcttctaaggcacaggttgttggttggcctcctattagatcatttaggaaaaactcaatggctaccaccactaacaagaacaatgatgaagtcgatggaaaaccaggtgttggcgcactctttgtgaaggtcagcatggatggtgctccgtatcttaggaaggtagatctaagaagttatacaacatatcaggaactatcttctgcccttgagaagatgttcctaagctgttttaccctaggtcagtgtggttcccatggagctccaggaagagaaatgttgagtgagagcaagctgagggatcttctgcatggttctgagtatgttctcacttatgaagataaagatggagattggatgcttgtaggggatgtgccatgggaaatgttcattgagacttgcaaaaggctgaaaattatgaagggttctgatgccattggtttagctcccagggccatggaaaagtctaaaagcaggatttagggtatcctggatttcctcttttgtctaatcaagtgtttattgttggatcctccggaatgggaaaagcaaaggatgatgactgaaatcctggcattggtggtttaacgcccttccacttatttgttttcaagtccctcaagagtttgtcatggtcctgtgttaatttgttaccactgtaatatcatatgaaagctacaatgaaatattagtatttgtggagtctgtaatcattataggaatccgtttgttttggaagaattgaacatctgttacagccgccaccatacggttctaacact

SEQ ID NO: 219 - protein, 289 aa, Glycine max
  misc_feature: Ceres CLONE ID no.511737
  misc_feature: Bit score of 292.1 for HMM based on sequences of FIGURE 3.
  misc_feature (1)..(281): Pfam Name: AUX_IAA Pfam Description: AUX/IAA family
  misc_feature (1)..(281): Pfam Name: AUX_IAA Pfam Description: AUX/IAA family
  misc_feature: Functional Homolog Of Ceres SEEDLINE ID no. ME09503 at SEQ ID NO. 129
MNLKATELRLGLPGFQSPEREPDLFSLSSPKLDEKPLFPLLPTKDGICSSGQKAVVSGNKRGFADTMDGFSQGKFAGNTGMNAVLSPRPSGAQPSAMKETPSKLSERPCSTNNGTGHNHTGASISGSAPASKAQVVGWPPIRSFRKNSMATTTNKNNDEVDGKPGVGALFVKVSMDGAPYLRKVDLRSYTTYQELSSALEKMFLSCFTLGQCGSHGAPGREMLSESKLRDLLHGSEYVLTYEDKDGDWMLVGDVPWEMFIETCKRLKIMKGSDAIGLAPRAMEKSKSRI

SEQ ID NO: 220 - DNA, 1183 bp, Glycine max
  misc_feature: Ceres CLONE ID no.565422
  misc_feature: Encodes the peptide sequence at SEQ ID NO. 221
aagacttctttccatttcccattttctcattctctgtttcgctttcaccgagtaacttcactttccccaactccacctgagaaagatacccataattcgcacgcacgcacgcacgcacttgttctgactcagtgcttgtgttggacgcagaagaaccagaaaagaaaaacaagcacgaggagatgattaacttcgaagaaaccgagttgcgactcggcctccctggcgggtctgcgagtgatcacaacgagtcaacaacggtcaagggcagtggtggaaagagaggcttctctgaaactgcttctgttgatttgaagcttaatctttcttccagtgatgactctgcctcagattcaccttcatctgcgtctacagagaagactaccactgctgcacctcttcctccttctcgagccaacgaccctgcaaaaccacctgcaaaggcacaagtggtgggttggccaccagttaggtcatttagaaagaacatagttcaaaggaacaagaatgaagaggaagcagctttcgtgaaggtgagcatggatggtgcaccgtatctacgaaaggtggacataaagttgtacaagagctaccaggagctgtcagatgcgctggctaagatgttcagttccttcacgattgaaaaatgtgggtcccaagggatgaaggactttatgaatgagaccaaattgatagaccttttgaacggctctgattatgtacccacttatcaagacaaggacggagactggatgctcgtcggtgacgtgccctgggaaatgttcgttgaatcatgccagcgccttcgcataatgaaaggttctgaggctatcggccttgcaccaagagccgtggaaaagtgcaagaacagaagctgaagtgattttagggttcggccacaacaatcggcttggttgttcatctgtgtcacaaggaagcaaatgtactcgagcaagatcgagtctcttttaggaataagagtttaattataattattattattatgtgtctctgtaattttcttatatgtgtattatacgaatgagaaaatagttggaaattcgttagggacaagaaataatatagaagatgtttatatgatcccgtttttgtttccaggtaaaaatatgtgactttgtccattytattgcctgcttaatgataatgtcaatgtttccagttt

SEQ ID NO: 221 - protein, 231 aa, Glycine max
  misc_feature: Ceres CLONE ID no.565422
  misc_feature: Bit score of 306.6 for HMM based on sequences of FIGURE 3.
  misc_feature (2)..(223): Pfam Name: AUX_IAA Pfam Description: AUX/IAA family
  misc_feature: Functional Homolog Of Ceres SEEDLINE ID no. ME09503 at SEQ ID NO. 129
MINFEETELRLGLPGGSASDHNESTTVKGSGGKRGFSETASVDLKLNLSSSDDSASDSPSSASTEKTTTAAPLPPSRANDPAKPPAKAQVVGWPPVRSFRKNIVQRNKNEEEAAFVKVSMDGAPYLRKVDIKLYKSYQELSDALAKMFSSFTIEKCGSQGMKDFMNETKLIDLLNGSDYVPTYQDKDGDWMLVGDVPWEMFVESCQRLRIMKGSEAIGLAPRAVEKCKNRS

SEQ ID NO: 222 - DNA, 1159 bp, Glycine max
  misc_feature: Ceres CLONE ID no.514595
  misc_feature: Encodes the peptide sequence at SEQ ID NO. 223
actattattgccacwyacaaatcaattaactgaattcttagacagagaaagaggagtagtactagtgataaggtgatcataatagagcataatataagagagtgaaaactcatggaggttggcctcaacaagaaggagaacatggggtttgaggaaactgagctaaggcttggactgcctggaaacgtaggaggcactggcactgaagaagtgctcatcaggaagagaggtttctctgagactgaaactgaaactgaggaggatgagtctgctaccactgtggatttgatgcttaatctttcttctaaggaagctgctgctgctgcagatccaactgataagcacaagactttgcctaaggagaagactcttctgcctgcagatcctgctaagcctccagccaaggcacaggtggtaggttggccacctgtgcggtccttccggaagaacatgttagctgtacaaaagagcgtcggagaagagaacgagaagaacagcagcagccctaatgcaagctttgtcaaagttagcatggatggagcaccttacctccgcaaagtggacttgaagatgtacaagagttaccgagagctctctgattctttaggcaaaatgttcagctccttcaccataggcaattgtgaatcccaaggaatgaaggatttcatgaatgagagcaagctgaatgatcttttgaacagctctgattatgtcccaacctatgaggacaaggatggtgactggatgcttgtcggtgatgtcccatgggagatgtttgttgaatcatgcaagcgtttacgcatcatgaaaggaaaggaggccattggtcttggtcttgcaccaagagccatggcaaaatccaagaacaggagctagactagtcgcacaattcatgacctgccccatcctttgtaattgcggtgcccagttggcttagttactaaagtaaggataattaagctgcagcagacacggatggacattgctaagtggttgaattatagttaatttgtgtcattatggtttgttataatatttcatcaaacaaaacaatgagatgcatgtctaattaagtactaatcatgaacaggaacataatgactctcaatcatgttgttagacttggctttcttatatatcgatctttgcttgttttgtg

SEQ ID NO: 223 - protein, 254 aa, Glycine max
  misc_feature: Ceres CLONE ID no.514595
  misc_feature: Bit score of 281.6 for HMM based on sequences of FIGURE 3.
  misc_feature (11)..(244): Pfam Name: AUX_IAA Pfam Description: AUX/IAA family
  misc_feature (11)..(244): Pfam Name: AUX_IAA Pfam Description: AUX/IAA family
  misc_feature: Functional Homolog Of Ceres SEEDLINE ID no. ME09503 at SEQ ID NO. 129
MEVGLNKKENMGFEETELRLGLPGNVGGTGTEEVLIRKRGFSETETETEEDESATTVDLMLNLSSKEAAAAADPTDKHKTLPKEKTLLPADPAKPPAKAQVVGWPPVRSFRKNMLAVQKSVGEENEKNSSSPNASFVKVSMDGAPYLRKVDLKMYKSYRELSDSLGKMFSSFTIGNCESQGMKDFMNESKLNDLLNSSDYVPTYEDKDGDWMLVGDVPWEMFVESCKRLRIMKGKEAIGLGLAPRAMAKSKNRS

SEQ ID NO: 224 - DNA, 1203 bp, Glycine max
  misc_feature: Ceres CLONE ID no.566396
  misc_feature: Encodes the peptide sequence at SEQ ID NO. 225
atagaaagaggacacaaagtgaaagagaagggagctatagccataaggagaaaaactttcaaagaggtgaaagcaaaagagttcttcttttccttttttatatatacttgggtgctaagctgtatgagttcattgacaagcctgaaatggcaactatgctgacaaaggagcatggtctgaacctcaaggagaccgagctttgcctcggtttgcctggtgggggaggcggcggcggcggcggcggcggcggcggcggtggtgaggtggaaactccaagggccactgggaagagagggttctctgagactgttgatctgaaacttaatcttcattccaaggaagatctgaatgagaatctgaagaatgtctcaaaggagaagaccctccttaaggatcctgccaagccaccggctaaggctcaagtggttggttggccaccagtgaggtcatacaggaagaacatgatggcagtacaaaaggttagcactgaggatgtggcagagaagacaacaagcagcactgctaatcctggggcatttgtcaaggtttccatggatggagcaccttacctgcgcaaggtggacctcacaatgtacaaaagctacaaagagttatctgatgccttggccaaaatgttcagctccttcaccatgggtaactatggggcccaaggaatgatagacttcatgaatgagagcaagttgatggatcttcttaacagctctgagtatgtgccaagctatgaagataaggatggtgactggatgctcgtgggtgatgtcccatgggagatgtttgttgagtcatgcaagcgtctgcgaataatgaagggatcagaagcgattgggcttgcgccaagagcaatggaaaaatgcaaaagcagaagctgaagcgggcctaatacaatgttcaatgaaatcccgtaccaaagtggacctatatatatatatatatatatgaagcacttcagcgagactatggagcggagtgttgttagcttgaatgtgtctggtgttttttgttttgttcgtatatagattcaacttttaattttaaggagccgatcgatggggcatttgtaatggacaagaagcaataaacttaacctatatagtctggcttgtttattatgtgatccttccatgctgtcatgattgttgtgtgctaaaataccttgaattttaattcatactttattccctc

SEQ ID NO: 225 - protein, 247 aa, Glycine max
  misc_feature: Ceres CLONE ID no.566396
  misc_feature: Bit score of 304.4 for HMM based on sequences of FIGURE 3.
  misc_feature (11)..(239): Pfam Name: AUX_IAA Pfam Description: AUX/IAA family
  misc_feature: Functional Homolog Of Ceres SEEDLINE ID no. ME09503 at SEQ ID NO. 129
MATMLTKEHGLNLKETELCLGLPGGGGGGGGGGGGGGGEVETPRATGKRGFSETVDLKLNLHSKEDLNENLKNVSKEKTLLKDPAKPPAKAQVVGWPPVRSYRKNMMAVQKVSTEDVAEKTTSSTANPGAFVKVSMDGAPYLRKVDLTMYKSYKELSDALAKMFSSFTMGNYGAQGMIDFMNESKLMDLLNSSEYVPSYEDKDGDWMLVGDVPWEMFVESCKRLRIMKGSEAIGLAPRAMEKCKSRS

SEQ ID NO: 226 - DNA, 830 bp, Glycine max
  misc_feature: Ceres CLONE ID no.612705
  misc_feature: Encodes the peptide sequence at SEQ ID NO. 227
acctcaatcacaaactagttttctctaaccaaccatacagtactcctcactagctataccctggttaatccatggagaaagaagctgttggccttgaaatcactactgagctaaggttgggccttcccggtggggaattacctgacaagaacgagaagataaagaagagggtgttctccgagattcaagctcatgatgatgatgaaaacagttcctccgaacaagaccgcaaaatccaaaccaagaatcaagtggtggggtggcctccggtgtgttcgtaccgcaagaagaacaccgtcaatgaaaccaaaatgtacgtcaaagttagcatggacggggctcctttcttgcgtaaaattgatttagctatgcacaagggatattcggagctggtcttggccttggagaagttcttcggttgctatggaattcgcgaagcgttgaaggatgcggagaatgctgaacacgttcccatatacgaggacaaagatggtgactggatgctcgttggagatgtcccttgggagatgtttattgagtcatgcaagaggttgaggattatgaagagatcagatgcaaagggcttcgatctgcaaccaaaagggtctttaaaaggatttatagaaggcgtaacaaaatgaaaaatatagatgaagcaaaaaagattggcttctaatcaatgtcgtacacgttttgaagacatccaatttcatgttgtcgttttattatatttgaggaagaagaaacattttatagtatggtgcatgaatcagatttctgtctatgttaagacctaagaatgaaggaaatatacagaagtcagtttaatc

SEQ ID NO: 227 - protein, 189 aa, Glycine max
  misc_feature: Ceres CLONE ID no.612705
  misc_feature: Bit score of 370.3 for HMM based on sequences of FIGURE 3.
  misc_feature (6)..(175): Pfam Name: AUX_IAA Pfam Description: AUX/IAA family
  misc_feature: Functional Homolog Of Ceres SEEDLINE ID no. ME09503 at SEQ ID NO. 129
MEKEAVGLEITTELRLGLPGGELPDKNEKIKKRVFSEIQAHDDDENSSSEQDRKIQTKNQVVGWPPVCSYRKKNTVNETKMYVKVSMDGAPFLRKIDLAMHKGYSELVLALEKFFGCYGIREALKDAENAEHVPIYEDKDGDWMLVGDVPWEMFIESCKRLRIMKRSDAKGFDLQPKGSLKGFIEGVTK

SEQ ID NO: 228 - DNA, 1343 bp, Glycine max
  misc_feature: Ceres CLONE ID no.564134
  misc_feature: Encodes the peptide sequence at SEQ ID NO. 229
aattggccaacactacataacagagcaaagagaaaagcttccttcaatgtagttgtgattcttcaataccatatattctctttctctttcttgatttgtgttgtgaaacagttaaaagtggtcttgatgtctgaggcattggaagaggttgttccttcaatgaaaggagggtgtgaagaagaagggttgaacctggaggctactgagctgaggcttgggttgccagggtgtgagtcaccagagagggagggtgtgcttaagagtgtggtggtgtctggggccaagaggggtttctctgatgccattgatggaaactggaatggtggaggatctgaaaaagatgtcgctgccttgttttctccaacttcaaggggtgctgttagtgttagtgttagtgctgccaagtctctcactctcactgcaacagactgcaccaaccaaccaactgctttgggtgcttctgttctcaaggaaactgttccacactctccaaaaccattacatgagaataagccccagatttctgctccagctgcaaaggcgcaagttgtgggatggccaccaatccgttcattcaggaagaactcaatggcttctcagcctcagaagaatgatgctgctgctgatgcagaagccaagtctggatgcctttatgttaaagtcagcatggaaggcgccccatatttgaggaaagtggatctgaatagttttaccacttacaaggacctctctttggcacttgaaaagatgtttagttgttttacactcagtcaatgtggctcatatggggtttctagtcgggaaaatttaagtgaaagtagattgatggatctccttcatggttcagaatatgttcttacctatgaagacaaggatggagattggatgctagttggtgatgttccgtgggagatgttcactgagtcttgcaagaggctgaggataatgaagagttctgaagcaattgggctagcacctagagccatggaaaagtgcaaaagtcgctactagctagtgcaatgctgtatgcttttgtcttctaatcctgaaagatggaagaccacatttaagcatataatacctgagtatttcttacgtataattctatatacgagattgggtgtcataaactttttagtgggcaatatatattgatgacagcatattaggtttgttgtagtagccgtctatatcattgatgtagatgtttaaggttttaggttgttctcccacacttcagttacagtcatcaaggcttaccgtagtatgtaaattttgcatttctgtgagcgagcattttgtttgtcatggcaagctaagaaaagaaatatcatactttcttc

SEQ ID NO: 229 - protein, 294 aa, Glycine max
  misc_feature: Ceres CLONE ID no.564134
  misc_feature: Bit score of 306.9 for HMM based on sequences of FIGURE 3.
  misc_feature (21)..(286): Pfam Name: AUX_IAA Pfam Description: AUX/IAA family
  misc_feature: Functional Homolog Of Ceres SEEDLINE ID no. ME09503 at SEQ ID NO. 129
MSEALEEVVPSMKGGCEEEGLNLEATELRLGLPGCESPEREGVLKSVVVSGAKRGFSDAIDGNWNGGGSEKDVAALFSPTSRGAVSVSVSAAKSLTLTATDCTNQPTALGASVLKETVPHSPKPLHENKPQISAPAAKAQVVGWPPIRSFRKNSMASQPQKNDAAADAEAKSGCLYVKVSMEGAPYLRKVDLNSFTTYKDLSLALEKMFSCFTLSQCGSYGVSSRENLSESRLMDLLHGSEYVLTYEDKDGDWMLVGDVPWEMFTESCKRLRIMKSSEAIGLAPRAMEKCKSRY

SEQ ID NO: 230 - protein, 326 aa, Medicago truncatula
  misc_feature: Public GI ID no.92872146
  misc_feature: Bit score of 321.7 for HMM based on sequences of FIGURE 3.
  misc_feature (25)..(318): Pfam Name: AUX_IAA Pfam Description: AUX/IAA family
  misc_feature: Functional Homolog Of Ceres SEEDLINE ID no. ME09503 at SEQ ID NO. 129
MSTPLEHDYIGLANNPSMDKTSSSLNFKETELRLGLPGCESPDRKSVSAAGAGGGVSFFANKDLKSINVCSPLKNLVASVGAKRGFSDAIDESSKKWSFSMNDGSEGGSLFSPRGGNVGKPLAGLETQTNIQKINTNATKNIKEVLHQSVHEKNKQVSGTNEHANAPAAKAQVVGWPPIRSFRKNTMASNLTKNNDEAEGKPEFDCLYVKVSMDGAPYLRKVDLKTYNNYMELSSALEKMFTCFTIGQCNSPGLPGKDGLSESSLRDLLHGSEYVLTYEDKDGDWMLVGDVPWGMFADSCRRLRIMKGSDAIGLAPRAMEKSRSQN

SEQ ID NO: 231 - protein, 179 aa, Pisum sativum
  misc_feature: Public GI ID no.1352058
  misc_feature: Bit score of 390.9 for HMM based on sequences of FIGURE 3.
  misc_feature (6)..(170): Pfam Name: AUX_IAA Pfam Description: AUX/IAA family
  misc_feature: Functional Homolog Of Ceres SEEDLINE ID no. ME09503 at SEQ ID NO. 129
MAREGLGLEITELRLGLSCGEPKKNEKKRMFSEIDGGVEENGGSGDRKSVDKKNQVVGWPPVCSYRKKNMNEGSKMYMKVSMDGAPYLRKIDLCLHKGYLELALALEKLFDCCGIEEALKDAENCEHVPIYEDKDGDWMLVGDVPWEMFIESCKRLRIMKRSDAKGFDLQPKGSLKRFI

SEQ ID NO: 232 - protein, 193 aa, Vigna radiata
  misc_feature: Public GI ID no.11131103
  misc_feature: Bit score of 440.6 for HMM based on sequences of FIGURE 3.
  misc_feature (12)..(193): Pfam Name: AUX_IAA Pfam Description: AUX/IAA family
  misc_feature: Functional Homolog Of Ceres SEEDLINE ID no. ME09503 at SEQ ID NO. 129
MENSLGSYEKELNLKATELRLGLPGSDEPEKRATARSNKRSSPEASDEESISNGSDVTKEDNVVPPAKAQVVGWPPIRSYRKNNVQQKKEEESEGNGMYVKVSMAGAPYLRKIDLKVYKSYPELLKALENMFKCIFGEYSEREGYNGSEYAPTYEDKDGDWMLVGDVPWNMFVSSCKRLRIMKGSEAKGLGCF

SEQ ID NO: 233 - protein, 196 aa, Vigna radiata
  misc_feature: Public GI ID no.416641
  misc_feature: Bit score of 383.9 for HMM based on sequences of FIGURE 3.
  misc_feature (11)..(196): Pfam Name: AUX_IAA Pfam Description: AUX/IAA family
  misc_feature: Functional Homolog Of Ceres SEEDLINE ID no. ME09503 at SEQ ID NO. 129
MESRVVFESDLNLKATELRLGLPGTEEKEDNNLRTHAVLRNNKRQVRETSQDSVSISKASHHQQHVETVSAPPPKAKIVGWPPIRSYRKNSVQEGEGDGIFVKVSMDGAPYLRKVDLKVYGGYPELLKALETMFKLAIGEYSEREGYKGSEYAPTYEDKDGDWMLVGDVPWDMFVTSCKRLRIMKGSEARGLGCVV

SEQ ID NO: 234 - protein, 188 aa, Vigna radiata
  misc_feature: Public GI ID no.11131101
  misc_feature: Bit score of 394.8 for HMM based on sequences of FIGURE 3.
  misc_feature (6)..(174): Pfam Name: AUX_IAA Pfam Description: AUX/IAA family
  misc_feature: Functional Homolog Of Ceres SEEDLINE ID no. ME09503 at SEQ ID NO. 129
MEKEDLGLEITELRLGLPGAGGENNTDKDKNKNKKRVFSDIEGENSSSEEDGKKETKNQVVGWPPVCSYRKKNTVNEPKLYVKVSMDGAPFLRKIDLAMHKGYSDLAFALDKFFGCYGICEALKDAENAEHVPIYEDKDGDWMLVGDVPWEMFRESCKRLRIMKRSDAKGFDLQPKGSLKGFIEGVRK

SEQ ID NO: 235 - protein, 203 aa, Vigna radiata
  misc_feature: Public GI ID no.11131105
  misc_feature: Bit score of 402.7 for HMM based on sequences of FIGURE 3.
  misc_feature (8)..(203): Pfam Name: AUX_IAA Pfam Description: AUX/IAA family
  misc_feature: Functional Homolog Of Ceres SEEDLINE ID no. ME09503 at SEQ ID NO. 129
MGSYETELNLRATELRLGLPGSDEPQEKRPCSGSVVRSSNKRSSPELEESRCKSNINSDSSDSTTTSDHNEDSVQPAKVQVVGWPPIRSFRKNSLQQKKVEQGDGTGMYLKVSMAGAPYLRKIDLKVYKSYPELLKALQNLFKCTFGEYSEREGYNGSEYAPTYEDKDGDWMLVGDVPWNMFVSSCKRLRIIKGSEAKGLGCL

SEQ ID NO: 236 - protein, 195 aa, Nicotiana tabacum
  misc_feature: Public GI ID no.4887018
  misc_feature: Bit score of 456.9 for HMM based on sequences of FIGURE 3.
  misc_feature (11)..(194): Pfam Name: AUX_IAA Pfam Description: AUX/IAA family
  misc_feature: Functional Homolog Of Ceres SEEDLINE ID no. ME09503 at SEQ ID NO. 129
MERTATYEKDLNLKATELRLGLPGIDEPEKQSSSASTSAKYSKKRTSSEMDNSSSGKENEQDSAPAPKAQVVGWPPVRSYRKNVLQIKKSESDNSSGMYLKVSMDGGTYLRKIDLKVYNSYPELLKALQNMFKCTIGVYTEREGYNGSDYAPTYEDKDGDWMLVGDVPWDMFLNSCRRLRIMKGSEAKGLHAYRL

SEQ ID NO: 237 - protein, 202 aa, Nicotiana tabacum
  misc_feature: Public GI ID no.4887016
  misc_feature: Bit score of 449.0 for HMM based on sequences of FIGURE 3.
  misc_feature (11)..(194): Pfam Name: AUX_IAA Pfam Description: AUX/IAA family
  misc_feature: Functional Homolog Of Ceres SEEDLINE ID no. ME09503 at SEQ ID NO. 129
MERTATYEKDLNLEATELRLGLPGINEPEKQSSSASTSAKYSKKRTSSEMDNSSSGKENEQDSAPAPKAQVVGWPPVRSYRKNVLQVKKSESDNSSGMYLKVSMDGGTYLRKIDLKVYKSYPELLKALQNMFKCTIGVYTEREGYNGSEYAPTYEDKDRDWMLVGDVPWDMFINSCRRLRIMKGSEAKGLHAYRLWTYRPSN

SEQ ID NO: 238 - protein, 220 aa, Nicotiana tabacum
  misc_feature: Public GI ID no.4887022
  misc_feature: Bit score of 391.8 for HMM based on sequences of FIGURE 3.
  misc_feature (11)..(212): Pfam Name: AUX_IAA Pfam Description: AUX/IAA family
  misc_feature: Functional Homolog Of Ceres SEEDLINE ID no. ME09503 at SEQ ID NO. 129
MERTATYVKDLNLEATELRLGLPGINEPEKQSSSASTSAKYSKKRTSSEMDNSSSGKENEQDSAPAPKAQVVGWPPVRSFRKNVLTVQKKSTGNGESSSGGAAFVKVSVDGAPYLRKVDLKMYKSYQQLSDALGKMFSSFTIGNCGNHGFKDFMNESKLIDLLNGSDYVPTYEDKDGDWMLVGDVPWEMFVDSCKRLRIMKGSEAIGLAPRAVEKCKNRS

SEQ ID NO: 239 - protein, 349 aa, Solanum tuberosum
  misc_feature: Public GI ID no.81074526
  misc_feature: Bit score of 294.8 for HMM based on sequences of FIGURE 3.
  misc_feature (67)..(341): Pfam Name: AUX_IAA Pfam Description: AUX/IAA family
  misc_feature (67)..(341): Pfam Name: AUX_IAA Pfam Description: AUX/IAA family
  misc_feature: Functional Homolog Of Ceres SEEDLINE ID no. ME09503 at SEQ ID NO. 129
MSPPLLGVGEEEGQSNVTLLASSTSLGSICKKGSALKERNYMGLSDCSSVDSCNISTSSEDNNGCGLNLKATELRLGLPGSQSPERGEETCPVSSTKVDEKLLFPLHPAKDTAFSVSQKTVVTGNKRGFSDAMDGFSEGKFLSNSGVKSGDAKETSHVQPTKMKDANTHSTVPERPSAVNDASNRAGSGAPATKAQVVGWPPIRSFRKNTLASASKNNEEVDGKAGSPALFIKVSMDGAPYLRKVDLRTYSAYQELSSALETMFSCFTIGQYGSHGAPGKDMLSESKLKDLLHGSEYVLTYEDKDGDWMLVGDVPWEMFIDTCKRLRIMKGSDAIGLAPRAMEKCRSRN

SEQ ID NO: 240 - DNA, 1238 bp, Triticum aestivum
  misc_feature: Ceres CLONE ID no.742023
  misc_feature: Encodes the peptide sequence at SEQ ID NO. 241
attcaccacttcatctctcctccctctttctcttccctctatatatacgcacccccacccagttcttgcttcctctctctcttccaccacctccatctcctaatcacaagccatcttgcatacacggagagagaaagagaagccaagagatcagcagctgctcgagtagctcgcgtggaggtgtccaaggtgggagacccaagcacgggctagctagccgaccagctgctccgccggagccgatggctggcgccgacgtcgacgtcgggacggagctcaggctcgggctgcccgggggcggcgccgaggcggccaaggccgggaagaggggctatgaggacaccattgacttgaagctcacgctgcccaccggcggcatgcaggaagactctgccggcaagccggagccagccgccgacaaggccaagaggcccgctgaggccgcggccgccgaccccgagaagccacctgctcccaaggcacaggccgtgggttggccaccagtccggtcgtaccgcaggaacgccatgaccgtccagtcggtgaagatcaagaaggaggaggagaccgagaagcagcagcctgctgctgccgctgctgctggtgccaacggctccaactttgtcaaggtgagcatggacggcgcgccctacctgcgcaaggtggatctcaagatgtacaacacctacaaggacctctccattgctctgcagaagatgttcagcaccttcaccgcaactgggaatgaggggaagatggttgaggcagtgaacggttcagatgttgttactacttacgaagacaaggatggagactggatgcttgttggagacgtcccatgggagatgtttgttgcttcatgcaaacgcttgaggatcatgaaggggtccgaagccatcggtcttgcaccaagggccaaggacaagtacaagaacaagagctaaagatggggcagtaagaggaagactatgatgccacaaggatggtgttcttgcagtgtgctatggtttcttagatatataatgttttcaattattagctggattaaaagaagggagagttgccatgtttaatttgttggtggaccagaagcaataatctatctgtagttagctgttcgtgctatgtcgtcttgtaacttgtgctggttcatgatctggagaaatagtaacagcgcttatttcggttctttctaaaaaaaaaaaaaaaaaaaaaaaaaaaccaaaaaaaaaaaaaaa

SEQ ID NO: 241 - protein, 233 aa, Triticum aestivum
  misc_feature: Ceres CLONE ID no.742023
  misc_feature: Bit score of 285.0 for HMM based on sequences of FIGURE 3.
  misc_feature (10)..(225): Pfam Name: AUX_IAA Pfam Description: AUX/IAA family
  misc_feature: Functional Homolog Of Ceres SEEDLINE ID no. ME09503 at SEQ ID NO. 129
MAGADVDVGTELRLGLPGGGAEAAKAGKRGYEDTIDLKLTLPTGGMQEDSAGKPEPAADKAKRPAEAAAADPEKPPAPKAQAVGWPPVRSYRRNAMTVQSVKIKKEEETEKQQPAAAAAAGANGSNFVKVSMDGAPYLRKVDLKMYNTYKDLSIALQKMFSTFTATGNEGKMVEAVNGSDVVTTYEDKDGDWMLVGDVPWEMFVASCKRLRIMKGSEAIGLAPRAKDKYKNKS

SEQ ID NO: 242 - DNA, 1151 bp, Triticum aestivum
  misc_feature: Ceres CLONE ID no.576268
  misc_feature: Encodes the peptide sequence at SEQ ID NO. 243
cttttcgcattgcagcctctcaaaacagccaaaccgaaccccaaaagctcgccgagaaacgcagaaaggagcgaagcaaaccaagcagcagcagcagcggaagaagaagaagaagcgaggagctgagccagctagcaatggcggcggacctgggcttcgaggcgaccgagctccggctcggcctgcccggcggcggcgagggggaggcgaggagctcctccggcaagaggggcttcgccgagaccatcgacctgaagctcaagctggagccggccggcgaggaggcgccggccgaggaggatcgggccgacgtggccgtggtcgccgccgcggcggcagagaaccaggaggagacggcgaccgacgccggcggagggaagatgaagaggtcgccgagccagagcagcgtcgtcaccaccgccgcgctgcccgaccccgccgagaagccgcgcgctcccaaggcgcaggtggtggggtggcctccggtccggtcgttccggaagaacatcctggcggagaagtcgtcgccggcggcagcggcggcgttcgtcaaggtgagcatggacggcgcgccctacctgcgcaaggtggacctcaacatgtacaagacctaccaggacctctccaaggccctcgagaagatgttcagctccttcaccatcggaaactgtggaactccagggatgaacggcatgaacgagagcaagctgatggatcttctcaacggatccgagtatgttccgacgtacgaggacaaggacggcgactggatgctcgtcggcgacgtcccatgggagatgttcgtcgagtcatgcaagcgccttcggataatgaagggatcagaagctattggccttgcaccaagggcgatggagaaatgcaagaacaggagctgaggagaggatgcactaaatgttatgcaagaatcaaaatacctatataaccttgcttgctcatccctgtatcatattctctgtcctaagtctaagtctgtatctcctgatcagtgaagtcattttggtttgtgatcttctcttttccagtcagtcagtcccaagtctcatcttgttatatacataagaaagaagaatccaagaacatgtgagatgtatctgtacctgtctgccacataattgtgtcttctccttttc

SEQ ID NO: 243 - protein, 252 aa, Triticum aestivum
  misc_feature: Ceres CLONE ID no.576268
  misc_feature: Bit score of 310.9 for HMM based on sequences of FIGURE 3.
  misc_feature (5)..(244): Pfam Name: AUX_IAA Pfam Description: AUX/IAA family
  misc_feature: Functional Homolog Of Ceres SEEDLINE ID no. ME09503 at SEQ ID NO. 129
MAADLGFEATELRLGLPGGGEGEARSSSGKRGFAETIDLKLKLEPAGEEAPAEEDRADVAVVAAAAAENQEETATDAGGGKMKRSPSQSSVVTTAALPDPAEKPRAPKAQVVGWPPVRSFRKNILAEKSSPAAAAAFVKVSMDGAPYLRKVDLNMYKTYQDLSKALEKMFSSFTIGNCGTPGMNGMNESKLMDLLNGSEYVPTYEDKDGDWMLVGDVPWEMFVESCKRLRIMKGSEAIGLAPRAMEKCKNRS

SEQ ID NO: 244 - DNA, 1102 bp, Triticum aestivum
  misc_feature: Ceres CLONE ID no.615386
  misc_feature: Encodes the peptide sequence at SEQ ID NO. 245
caaaccctcacaactcacctacagccagctgagaagaacgacttgcaagttgtaaccacctctagtcggtagacacgcacctcgtcgccggagacaggaactgatggcggctgccatgagctacgtgcatgccgacgtggagaacctcaaggcgacggagctgaggctcggcctgccgggcgtcgaggagagcgacaagatgccgtcgccgccgtccactcccagggccggcaccaagcgcgcgctcgccggggagcaccgcgaggaggagcccaaggccgcgcccccggccgccaaggcgcaggtggttgggtggccgcccgtgaggtcctacaggaagagctgcttccagcaggcgagcagcaagaccaaggaggccgcgccggcacctgtggtggtgaagcaggaggaggctgccgttgccgcggcgccgcccgccgccgcagccgcgggcggatcactgtacgtgaaggtgagcatggacggagccccctacctgaggaagatcgacctcaagatgtacaagggctaccgcgagctcagggaggccctggaggccatgttcctcggcttctccggcgacgcaggcagcgtgaacccgtcggacttcgccgtgacctacgaggacaaggacggcgacctcatgctcgtcggcgacgtgcccttcgggatgttcatgagcacttgcaagaggatgaggatcatgaagggatccgaagcaagaggcctaggatcatcaaaggagtgaaaatggaatctatctacgaagaacacgcaacatgccatgggtgcatgtgtgcaacatggaggaattcttttgttcttttgggcatgttgtcgactcatctaccacagtgctactcttcaaggcaaagacgcaagctgattcgagtggagttttatttttattttgttttttaaaataggtgttagcaacacaaaaggagtggagatccgttcgagttgaatcggatctccatgtgtgtttgtacaaagaaaacagctttctttccgtgttaagccatgtcaatggttggttgatgtctcccttgagtttggttatatcaaaggttgcaagaaaatctcaaaaaaaaaaaaaaaa

SEQ ID NO: 245 - protein, 214 aa, Triticum aestivum
  misc_feature: Ceres CLONE ID no.615386
  misc_feature: Bit score of 300.7 for HMM based on sequences of FIGURE 3.
  misc_feature (14)..(213): Pfam Name: AUX_IAA Pfam Description: AUX/IAA family
  misc_feature: Functional Homolog Of Ceres SEEDLINE ID no. ME09503 at SEQ ID NO. 129
MAAAMSYVHADVENLKATELRLGLPGVEESDKMPSPPSTPRAGTKRALAGEHREEEPKAAPPAAKAQVVGWPPVRSYRKSCFQQASSKTKEAAPAPVVVKQEEAAVAAAPPAAAAAGGSLYVKVSMDGAPYLRKIDLKMYKGYRELREALEAMFLGFSGDAGSVNPSDFAVTYEDKDGDLMLVGDVPFGMFMSTCKRMRIMKGSEARGLGSSKE

SEQ ID NO: 246 - DNA, 1202 bp, Triticum aestivum
  misc_feature: Ceres CLONE ID no.644455
  misc_feature: Encodes the peptide sequence at SEQ ID NO. 247
accaccaccacaccacacttgctcgtctccctctgcccctccccttcctcctatagcaatcaaaccaccagctccactcccccctccccttcctccgtcctcaccctccccctcctgctactccccagttcatgtcctgctgcttcccatgtcgccgcctctcgagctcgactacataggcctctcggccgccgccggcggccgcccggacgacgacctgaaaggcaccgagctccgcctcggacttcccggctgcgagtcgcccgaccgccgcccggtcgccgccaccaccacactggagctgctgcccgccaagggggccaagcgagggttttcggacgaggtcgtgccgcctgcgccgatttccgccgccgggaaaggcaaggaggcgtccggggatgagaaggacaagaaggtcgccgccccgccgcagcctgctgccaaggctcaggtggtgggatggccaccagtccgcagctaccgcaagaacacgatggcaaccaccaccaaccagctgaagagcagcaaggaggattctgacacgaagcaggggcaagagtttctgtatgtcaaggtcagcatggatggtgcgccttacctgaggaaggttgacctcaagacatacaagaactataaggacatggttgtggcgctagggaaaatgttcattggcttcaggaccgggaaggatggtgcatctgagaacagaaaggatggtgaatatgtgatgacttacgaagacaaggatggagactggatgctggttggtgacgtcccatgggagatgttcaccgaggcttgccggaggatcagggtcatgaaaagttcagatgtagttgggcttggagttacaagggcaggggttaagtccaagaataagaactaaaacggtcgctgcccacggtttgaagacgaggtcgcacatgccgtctgtactactgcatggttttcctatcccacaagtaaaatcacccgttactctaccgtttaagatttgcgacatctcctagagacttatgctctatattttgttgtgcccacgttgttgtacgcgtgttatttccatccgtgtaaatggttggtaagcagtgcgagagctactgctgtgtttgatgactcctatgtattttgccactcttgtcctgaaccggtcgttcgtcgtaaatgtgaaggttgcaagactatcaaaaaaaaaaaaaaaa

SEQ ID NO: 247 - protein, 245 aa, Triticum aestivum
  misc_feature: Ceres CLONE ID no.644455
  misc_feature: Bit score of 472.9 for HMM based on sequences of FIGURE 3.
  misc_feature (23)..(235): Pfam Name: AUX_IAA Pfam Description: AUX/IAA family
  misc_feature: Functional Homolog Of Ceres SEEDLINE ID no. ME09503 at SEQ ID NO. 129
MSPPLELDYIGLSAAAGGRPDDDLKGTELRLGLPGCESPDRRPVAATTTLELLPAKGAKRGFSDEVVPPAPISAAGKGKEASGDEKDKKVAAPPQPAAKAQVVGWPPVRSYRKNTMATTTNQLKSSKEDSDTKQGQEFLYVKVSMDGAPYLRKVDLKTYKNYKDMVVALGKMFIGFRTGKDGASENRKDGEYVMTYEDKDGDWMLVGDVPWEMFTEACRRIRVMKSSDVVGLGVTRAGVKSKNKN

SEQ ID NO: 248 - DNA, 1125 bp, Triticum aestivum
  misc_feature: Ceres CLONE ID no.756966
  misc_feature: Encodes the peptide sequence at SEQ ID NO. 249
aagcaaacacacatcgtcttctcctctcagcgagacagagctatcagatctcgtctttcacatcgcatccaaacgtacttgcaaagttcttccctagcgcaagcactgcccggcatcttcccacgtccactggaaatggaagctaccgacagcctcctcatggccaccgagctcaggctgggcctccccggcaccgacgacaagccacacaagatcacctcggcgatgtcgccgccggcgactcccaggggcaagaagcgcaccctggacgccttcgagtccaccgcctccgatgaggccgacaggtccgacgacaccgcgaccgcaccccccgtggccaaggcacaagttgtcgggtggccgccggtgaggcgctgcttccaggcagcggcgagcaagagcaaggcgaagaaagcggacgaggccagcagcaacaacacgccgtccgcggcggtgccgacgagcaccaacggctccttcgtcaaagtgagcatggacggagcgccctacctcaggaaggtcgacatgaggatgtacaagggctaccgggagctcagggaggccctggaggccatgttcgtctgcttctccggggcagacggcggcgcctccaacggcgggggcgcaaacccggccgagtacgccatcacctacgaggacaaggacggcgacctcatgcttgtcggagacgtgcccttcgatatgttcagcggcacatgcaagaagttgaggatcatcaagagatccgaagccacaggcctgggatccaaataatgaagacttgagaagcaagatgatatcatgggctctctctttttttttctttttacggtttatactttttgttcttcgatctgggttcgatcaccaagccaaaagggacgagcttggtgcatcagagagcacacatggatgtgtgccctttgtttgggtccttgaagtaggccttcttagaagcacaaaggagatgtggagatttgggttaaactctccatgtgtttgtacaaacgaaacagttatattgattgttgattacttatcatcatgcatgtttttgctggggggctttccttccggtttccccttggcttggctgtgcttttgtatccaaaaaaaaaaaaaaaa

SEQ ID NO: 249 - protein, 212 aa, Triticum aestivum
  misc_feature: Ceres CLONE ID no.756966
  misc_feature: Bit score of 250.9 for HMM based on sequences of FIGURE 3.
  misc_feature (8)..(212): Pfam Name: AUX_IAA Pfam Description: AUX/IAA family
  misc_feature: Functional Homolog Of Ceres SEEDLINE ID no. ME09503 at SEQ ID NO. 129
MEATDSLLMATELRLGLPGTDDKPHKITSAMSPPATPRGKKRTLDAFESTASDEADRSDDTATAPPVAKAQVVGWPPVRRCFQAAASKSKAKKADEASSNNTPSAAVPTSTNGSFVKVSMDGAPYLRKVDMRMYKGYRELREALEAMFVCFSGADGGASNGGGANPAEYAITYEDKDGDLMLVGDVPFDMFSGTCKKLRIIKRSEATGLGSK

SEQ ID NO: 250 - DNA, 1220 bp, Triticum aestivum
  misc_feature: Ceres CLONE ID no.1052710
  misc_feature: Encodes the peptide sequence at SEQ ID NO. 251
gaagcaacgcccgcaccccaacctcaaccgcacgctacgctatccaagcctcacgcacttctcatttcccagcgaccttgttcgccggctcgaacgtccgtccatggagatcatcgacgcggagctgcggctcggcccgcccggcagcggcgacgcggcgttcggcgcgcagaagaagcgctcgttgtcgacagtggcggcggcggcggccaccagcgaggcctccgggaccgacgaccacgacgccgcgccggcttccaaggttcaggtggttgggtggccgccggtgggggcgtaccggaagagcacgttccagtcggcgtcggcggcgaaggagagtaaagtcgccggcgaggccgggaagagaggggggctgtacgtgaaggtgagcatggacggggcgccctacctgcgcaaggtggacctgcggacgtacggggggtacggggagctgcgggccgcgctggacgcccgattcggctgcttctcctcctgctccggctcctcgccggacaacggccagttcgccatggcctacgaggacaaggacggcgacctcatgctcgccggcgacgtcccgtgggacatgttcatctcctcctgcaagaggctgaggataatgagaagctcggaagcacgatgatggcgacgaaaaggacacgatcgaacacgcacacacacacacatacatgaagcgatctggagacgatggaaaccggccgtggcacatgatgaggagacgggcacacgcgcgcatgggccagatgcatgatcaggccatgggtgagcggcgacggaggccggccgtgagccgggctacgcgggcacgcgcgcatctggcatgcacgtacgcacgctctgtgaagcactccatccatccgctcggtacgaacgcgaggctgggtccaggactcacagggcgcgcgctccggcgggtcaggccggccggccggatcggcgtgcagcactagcagtagcggcagcagtactgttttgttgtactagtaggtagtacatgcatctactgatgtacagtcagaggttcaggttcagccagccatgtagtaagaaagaactggaacttgtgtgtagataagttctctgcttagtttgtagttaatctaatcttttgtaccgctgaggaactgggacacggatcataaaatgagagggagattaagctccaaatatggtcgttttttcgaaaaaaaaaaaaaaaa

SEQ ID NO: 251 - protein, 179 aa, Triticum aestivum
  misc_feature: Ceres CLONE ID no.1052710
  misc_feature: Bit score of 229.1 for HMM based on sequences of FIGURE 3.
  misc_feature (21)..(179): Pfam Name: AUX_IAA Pfam Description: AUX/IAA family
  misc_feature: Functional Homolog Of Ceres SEEDLINE ID no. ME09503 at SEQ ID NO. 129
MEIIDAELRLGPPGSGDAAFGAQKKRSLSTVAAAAATSEASGTDDHDAAPASKVQVVGWPPVGAYRKSTFQSASAAKESKVAGEAGKRGGLYVKVSMDGAPYLRKVDLRTYGGYGELRAALDARFGCFSSCSGSSPDNGQFAMAYEDKDGDLMLAGDVPWDMFISSCKRLRIMRSSEAR

SEQ ID NO: 252 - DNA, 1204 bp, Triticum aestivum
  misc_feature: Ceres CLONE ID no.697018
  misc_feature: Encodes the peptide sequence at SEQ ID NO. 253
gccagcaaacaaaaagagctcctttcctcctcgcccttcacctgcctccttccctcccaatgccgccgcccaatctccaagcgcgcgactacatcggcctcgtccgccgcgccctccgcctcctcctgctcctcctccgcctcgggcgacgccggcccgcacctcgccctccgcctcggcctgcccggccgcgaccacccggaggccgccgtcgacgccgcgctcacgctagggccggctccagctactgctcccgtccctcacaggggcggcgccaagcgcgggttcgccgactcgctcgaccgctcccctgccgctgctgccgcgctgccggggaggaagacaagcacaagggcgaagccgccgccgccggagccggagctcctccagccgccaaggcacaagttgttggatggccgcctgttcggagctaccgtaagaacacgctagccgccaatgccacaaagaccaaggccgagaacgaaggtagaagcgaggcagggtgctgctatgtcaaggtcagcatggatggagccccgtacctaaggaaggtcgatcttaagacttactccagctatgacaacctttccctggagctggagaagatgttcagctgcttcatcactggcaaaagtagttcctgcaaaacttcgacgagagacaggctcactgatggttctagggctgatgctcttcaggaccaagagtatgtacttacctatgaagacaaggatgctgactggatgcttgttggtgatcttccttgggacttgtttaccactacttgtcggaaactgagaatcatgagaggctctgatgctgctggaatggccccaagatagctggaaccgaccggccagaacaaacaggaggcgtccgtccgtcctggtctctcctcctcctgaagtcttctgtctgaatcacgcaagtgtggaattttgagttaacgctgcaaggcgccgctgaagggtgcgaaggttgtctcaactttctgaaagtgtctgcgctgctggtagttttatctgtctacgtgtgtagtggaatatgtgcgtcctactgtaaaacaatccgtttttggcctcgccgttgtagatgtccttttggttcatgaaagatcgccgcctgtatgatgatgctttcgcctatgctcttacatatatatttgaagtcaagtcgtattttatgaagaaaaaaaaaaaaaaaa

SEQ ID NO: 253 - protein, 260 aa, Triticum aestivum
  misc_feature: Ceres CLONE ID no.697018
  misc_feature: Bit score of 218.2 for HMM based on sequences of FIGURE 3.
  misc_feature (108)..(259): Pfam Name: AUX_IAA Pfam Description: AUX/IAA family
  misc_feature: Functional Homolog Of Ceres SEEDLINE ID no. ME09503 at SEQ ID NO. 129
MPPPNLQARDYIGLVRRALRLLLLLLRLGRRRPAPRPPPRPARPRPPGGRRRRRAHARAGSSYCSRPSQGRRQARVRRLARPLPCRCCRAAGEEDKHKGEAAAAGAGAPPAAKAQVVGWPPVRSYRKNTLAANATKTKAENEGRSEAGCCYVKVSMDGAPYLRKVDLKTYSSYDNLSLELEKMFSCFITGKSSSCKTSTRDRLTDGSRADALQDQEYVLTYEDKDADWMLVGDLPWDLFTTTCRKLRIMRGSDAAGMAPR

SEQ ID NO: 254 - DNA, 1120 bp, Triticum aestivum
  misc_feature: Ceres CLONE ID no.618577
  misc_feature: Encodes the peptide sequence at SEQ ID NO. 255
atactcttttgtagccatcctcccgtctatttgtgctctgctcacaagccaaggccaagcagcagcagacacgcgaaagcaaactcacaaggagcgaagaagaaacccagctaggagcgtctggtgcattggagcaggagaccaatggcgggcctcgggttcgaggagacggagctccggctcggcctgccaggcggcggcaacgaggccgaggaggcggccgccgcggtgaggagctccggcaagaggggctacgccgagaccatcgacctcgtgctgaagctggagcctgcgtcggcggccgcgccgccgtctggggacgacgaggaagtggccgacggtgtcgcggaggcgcagccgccgtctccggctgctgtcgacgggcagttgaagcggtcgccgagccagagcagcgtggtcaccaccgcgcagccggacgcggaccccgagaagccgcgcgcgcccaaggcgcaggcggtggggtggccgccggtgcggtcgttccggaggaacatgctggcggcggcgctggtgaaggtgagcatggacggcgcgccctacctgcgcaaggtggacatgggcacctacaagagctaccaggagctggagaagatgttcagctccttcaccatcggcaacactccgactcaggggatgacgggcatgaacgagagcaagctggtggacctgctcagcggctccgactacgtgcccacctaccaggacaaggacggcgactggatgctcgtcggcgacgtcccctgggagatgttcgtcgcgtcgtgcaagcgcctccggataatgaaaggatcagaagccatcggcctcgcgccaagggcaatggagaaatgcaagagcaggagctgatcgacgtagtgtccattccaagactacgactctgcttgcccccactctgtaccataatatactactgctacttcgctacgatccggtcaaagttccgttatcgcctcgattagttcactactatctgtataagtacgtatgttccaacttgttgtcatttatacaatgtagtatagtatgtatacgtgagaaagatgtcatcggcatgtcactgtttacgcactacagtagtcaatatatgccttgtcatttc

SEQ ID NO: 255 - protein, 240 aa, Triticum aestivum
  misc_feature: Ceres CLONE ID no.618577
  misc_feature: Bit score of 260.8 for HMM based on sequences of FIGURE 3.
  misc_feature (4)..(232): Pfam Name: AUX_IAA Pfam Description: AUX/IAA family
  misc_feature: Functional Homolog Of Ceres SEEDLINE ID no. ME09503 at SEQ ID NO. 129
MAGLGFEETELRLGLPGGGNEAEEAAAAVRSSGKRGYAETIDLVLKLEPASAAAPPSGDDEEVADGVAEAQPPSPAAVDGQLKRSPSQSSVVTTAQPDADPEKPRAPKAQAVGWPPVRSFRRNMLAAALVKVSMDGAPYLRKVDMGTYKSYQELEKMFSSFTIGNTPTQGMTGMNESKLVDLLSGSDYVPTYQDKDGDWMLVGDVPWEMFVASCKRLRIMKGSEAIGLAPRAMEKCKSRS

SEQ ID NO: 256 - DNA, 1167 bp, Triticum aestivum
  misc_feature: Ceres CLONE ID no.935194
  misc_feature: Encodes the peptide sequence at SEQ ID NO. 257
ctccactcacccaccccaccccacccgctccaatgtcgccgcccctcgagccgcacgactacatcggcctctccgcccccacctcctcctcctcctgctcctcctcgcccagccccgccgccgaggccgggccccgcctcacgctccgcctcggcctcccgggatccgagtcccccgaccgcgacggctccgtcgacgtcgtcgcgccggcgctcaccctcggccccgcctcccacaaggccgcctccaagcgcgccttccccgacgcctccccccgccgcggatgctccgccaccgccagggccgaggagaagccgccctccgcagccccgccggccgccaaggcgcaggttgtgggatggccgcccgtgcgcaactaccggaagaacacgctggcggcgagcgcctccaaggccaagggggcagacgacggcgcgcctcactacgtgaaggtgagcatggatggcgccccgtacctcgtggacctcaagatgtattccagctacgaggatctctccatggcacttcagaagatgttcagctgcttcatcactggtcaaagctcgctgcgcaaaccatcaaccaaggacaggctcactaatcgttcaaatgttgattccctccaagatcaagagtatgtccttacatacgaagacaaggacgctgactggatgcttgtcggtgatcttccatgggatttgtttaccacaatatgcaggaaactgaaaatcatgagaggatctgatgcagctggaatagctccaagatccctagagcagacaggtcagaacaaataagattgaccttcttccggagtaaagaaaatgaaccgagctaagttgcgatgatgtcgatggtctaaattattcatgtcaagtacctcaaatatcccaaatgttagtgtagttacacgtgcttcttagtgtcaaatgtctgtaatgtgatctgctgaggtattgcaattatggttgccgtattttcacttggaagcttatgtgaggaagctctgcacttcctgaatgcaagctttccaccagtattatttcatatgtatattcaagtgttgcactacgtattatgctctcttgcaattatccaattgccaaaaactttatattggctactgtcaatgcaatgctctgttctgatccaaaaaaaaaaaaaaaa

SEQ ID NO: 257 - protein, 254 aa, Triticum aestivum
  misc_feature: Ceres CLONE ID no.935194
  misc_feature: Bit score of 253.0 for HMM based on sequences of FIGURE 3.
  misc_feature (38)..(246): Pfam Name: AUX_IAA Pfam Description: AUX/IAA family
  misc_feature: Functional Homolog Of Ceres SEEDLINE ID no. ME09503 at SEQ ID NO. 129
MSPPLEPHDYIGLSAPTSSSSCSSSPSPAAEAGPRLTLRLGLPGSESPDRDGSVDVVAPALTLGPASHKAASKRAFPDASPRRGCSATARAEEKPPSAAPPAAKAQVVGWPPVRNYRKNTLAASASKAKGADDGAPHYVKVSMDGAPYLVDLKMYSSYEDLSMALQKMFSCFITGQSSLRKPSTKDRLTNRSNVDSLQDQEYVLTYEDKDADWMLVGDLPWDLFTTICRKLKIMRGSDAAGIAPRSLEQTGQNK

SEQ ID NO: 258 - DNA, 1036 bp, Zea mays
  misc_feature: Ceres CLONE ID no.1557429
  misc_feature: Encodes the peptide sequence at SEQ ID NO. 259
aacctcttcaatcccagtcccacacaaagtttctcctcgatcctcatctcctccctctctcgagtcaagagcagagcagctaccaaacaagctctcctttcgcttccgatccatggagctcgacgccgacaacctgagcgccaccgagctccgcctcggcctgcctgggaccagcagcagcagcagcgacgactggcagaagaagccgtcgccctccgtcggggccaagcgcgctctggacgacggcaccaagagcgaggcctcggggaccagcccggccgccagagacctcgacttcgaccacgaccacgacaccgccgcgcctcccaaggcgcaagtggtcgggtggccgccggtgagggcgtacaggaagaacaccttccaggcggcggcggcggccaagaaggtcgagcagaagcagaagcagcagcagcagggaggcctgtacgtgaaggtgagcatggacggcgcgccgtacctcaggaaggtggacctccggatgtacaaggggtacagggagctcagggaggctctggacgcgctcttcaccaactccttctccgcggcggcagagggcggcggcgaccaccaccagcacgccatcgcctacgaagacaaggacggcgacctcatgctcgccggagacgtgccctgggatatgttcatctcttcgtgcaagaagctcaggataatgaagggctctgcctctgaggccaggtgatcgctgatccatacataaacagaggctacagacacgccacctgggaacgcggatccaagagcacacacggatcgtacttgacgaggaaggagggaggagcagtgtggcttgagctctccagtgttgtacaaagacatgtttctttctgaacccaaaagggagaaagatgtatgaagcgtgtatataagatcttagctagcagtttgttttcatttgtatgagcgatcgaaggctgtaaaaaatgaaaaagaaaaaagaaaagggaatgagaaattgactaaagctggtcatttttcctaaaaaaaaaaaaaaaaa

SEQ ID NO: 259 - protein, 202 aa, Zea mays
  misc_feature: Ceres CLONE ID no.1557429
  misc_feature: Bit score of 281.2 for HMM based on sequences of FIGURE 3.
  misc_feature (7)..(197): Pfam Name: AUX_IAA Pfam Description: AUX/IAA family
  misc_feature: Functional Homolog Of Ceres SEEDLINE ID no. ME09503 at SEQ ID NO. 129
MELDADNLSATELRLGLPGTSSSSSDDWQKKPSPSVGAKRALDDGTKSEASGTSPAARDLDFDHDHDTAAPPKAQVVGWPPVRAYRKNTFQAAAAAKKVEQKQKQQQQGGLYVKVSMDGAPYLRKVDLRMYKGYRELREALDALFTNSFSAAAEGGGDHHQHAIAYEDKDGDLMLAGDVPWDMFISSCKKLRIMKGSASEAR

SEQ ID NO: 260 - DNA, 1485 bp, Zea mays subsp. mays
  misc_feature: Ceres CLONE ID no.305337
  misc_feature: Encodes the peptide sequence at SEQ ID NO. 261
gacattattgccccctcttcccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtggtgggatggccaccggtccggtcgttccggaagaacatcatgtccgtgcagtccgacaagggcgccggcaaagacgccgccgccgccaacggcgacaagtcctcggcggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgacgtgccgtgggagatgttcgtcgaatcatgcaagcgccttcggatcatgaaaggatcagaagccattggcctggcgccaagggccatggagaaatgcaagaacagaagctgaggagaagacggacggacggaagcttgcatctcagcaccaccaggggtggatggatgcaagaagaacaaatctccatggcttttgcagctctgctcgtctctgtatcatactcgtcgtccctgcccttcaggcctctgtatctccctgatcaatgaagtcgttttggtgtgtcaactgttctctccgtgcccagcttgtcagtgaaagagtcagtcagtgtccatcaagtctcatcttgtcctatacagaagagagaagccatgcatgaacatgtacctgtcctataacaatgtctttttttgctacctgtttttttttctctctctctctttttttggcacaagatgcaaaggcaccctgctcctgatcaaagggccttttgcatcataagctgtttgattataattaccatggtgtgtcagtggaacaaataactgttgcaaggtgttaaaaaaaagttgtattgtaatatgagc

SEQ ID NO: 261 - protein, 275 aa, Zea mays subsp. mays
  misc_feature: Ceres CLONE ID no.305337
  misc_feature: Bit score of 301.8 for HMM based on sequences of FIGURE 3.
  misc_feature (7)..(267): Pfam Name: AUX_IAA Pfam Description: AUX/IAA family
  misc_feature: Functional Homolog Of Ceres SEEDLINE ID no. ME09503 at SEQ ID NO. 129
MATTTDLGFEATELRLGLPGGGGGGEPALGGEGRSSSSASGKRGFAETIDLKLKLEPAAVVEAEEEEEDHGVAVALEKEEEAGKMKRSPSQSSVAAAAAAVLADPAEKPRAAKAQVVGWPPVRSFRKNIMSVQSDKGAGKDAAAANGDKSSAAAGGGAAFVKVSLDGAPYLRKVDLKMYRSYQQLSKALENMFSSFTIGSCGSQGMNGMNESKLVDLLNGSEYVPTYEDKDGDWMLVGDVPWEMFVESCKRLRIMKGSEAIGLAPRAMEKCKNRS

SEQ ID NO: 262 - protein, 276 aa, Zea mays subsp. mays
  misc_feature: Ceres CLONE ID no.100872943
  misc_feature: Bit score of 301.6 for HMM based on sequences of FIGURE 3.
  misc_feature (7)..(268): Pfam Name: AUX_IAA Pfam Description: AUX/IAA family
  misc_feature: Functional Homolog Of Ceres SEEDLINE ID no. ME09503 at SEQ ID NO. 129
MATTTDLGFEATELRLGLPGGSGGGGGGELALGGEGRSSSSASGKRGFAETIDLKLKLEPAAVVEAEEEEEDHGVAVALEKEEEAGKMKRSPSQSSVAAAAVLADPAEKPRAAKAQVVGWPPVRSFRKNIMSVQSDKGAGKDAAAANGDKSSAAAGGGAAFVKVSLDGAPYLRKVDLKMYRSYQQLSKALENMFSSFTIGSCGSQGMNGMNESKLVDLLNGSEYVPTYEDKDGDWMLVGDVPWEMFVESCKRLRIMKGSEAIGLAPRAMEKCKNRS

SEQ ID NO: 263 - DNA, 1222 bp, Zea mays subsp. mays
  misc_feature: Ceres CLONE ID no.305454
  misc_feature: Encodes the peptide sequence at SEQ ID NO. 264
gtcctctcttcttccaccaccacctcctactccgctgcaaccccaaatctctccttcctcgcatacgcgcgcagcgraggagctgagaccaacgaagaagaagaagaacaaccgagcaagcacaagcttagctagcgtgtaggtgtccaaggcgacgacggccgccgcgccaggctagccaaccagctgctcatcgctcctagctgcggasccgatatggctggcgccgacgtcgacgtcgggacggagctccgtctcggcctgccgggaggaggcgccgatgcggccaaggctgccaagaggggcttcgaggacaccatcgacctcaagctgaagctgcccaccgccggcatggaggaagctgccgccgccgccgccgccgccgccaagcccgagccggcagccgagaaggccaagaggcccgccgaggcgccggccgctgatgccgagaagccacccgcacccaaggcacaagctgtgggttggccaccagtccggtcataccgcaggaacgtcatgaccgtccagtctgtgaagagcaagaaggaagaggagcctgagaagcagcagtccgctgccaacgccggcggcaacggctccgccttcgtgaaggtcagcatggacggcgcgccctacctgcgcaaggtggacctgaagatgtacaacagctacacggagctctccgttgctctgaagaagatgttcagcaccttcaccacatccgggaacaacatgaatgagggaaaactggttgatccggtcagcggtgctgatgtggtcactacttacgaagacaaggatggcgactggatgctcgttggcgacgtcccgtgggagatgtttgtcgagtcatgcaggcgtctgaggatcatgaagagttctgaagccataggtcttgcaccaagaacgaaggacaagtgcaagaacaggagctgaagaagatacagcgttaaagacgctgcccattgtgtcaaaagaatggtgcccttgcagtgtgctgcggtttttctagaaatataatgcgttttaattactagttggagggagacctgtcttgttcaatttgttcatggaccagaagcaataatctatctgtgtgtagctggattggtgttatgcgatgtcccctaccgtgtcccagaatctacttggtgattttatcccagtgttgttaatcaagcttgtgtgattgttaagtaaagggcatcaatgagactattac

SEQ ID NO: 264 - protein, 239 aa, Zea mays subsp. mays
  misc_feature: Ceres CLONE ID no.305454
  misc_feature: Bit score of 283.7 for HMM based on sequences of FIGURE 3.
  misc_feature (10)..(231): Pfam Name: AUX_IAA Pfam Description: AUX/IAA family
  misc_feature: Functional Homolog Of Ceres SEEDLINE ID no. ME09503 at SEQ ID NO. 129
MAGADVDVGTELRLGLPGGGADAAKAAKRGFEDTIDLKLKLPTAGMEEAAAAAAAAAKPEPAAEKAKRPAEAPAADAEKPPAPKAQAVGWPPVRSYRRNVMTVQSVKSKKEEEPEKQQSAANAGGNGSAFVKVSMDGAPYLRKVDLKMYNSYTELSVALKKMFSTFTTSGNNMNEGKLVDPVSGADVVTTYEDKDGDWMLVGDVPWEMFVESCRRLRIMKSSEAIGLAPRTKDKCKNRS

SEQ ID NO: 265 - DNA, 1297 bp, Zea mays
  misc_feature: Ceres CLONE ID no.1534670
  misc_feature: Encodes the peptide sequence at SEQ ID NO. 266
aagcgccaagggcaccaccagcaaggaccaagacagagcacagcgcagctcgtcggcctctcgacgccggttgctgcaaccaccgcctttattgcccacgcgggccgtgcggaagaagcaagaagacacgccaatggaggtcgccgcagcatcggcagcgggctacggattcaaggccgacgacgacgttgacagcctcagggcgacggagctcaggcttggcctgccgggcacggaggaggaggaggccgaggagtcccagaacaaggcgccgccgccgccgccgtcgacgcccagaggcaagaagcgcgacgtcgtcgccagcagcgggcccgaggatgcgcccaagaagcgcgactgcgagaccgacaccgatgccgcgccgccgccggccgccaaggctcagctggtgggatggccgccggtgaggtcgtacaggaagagctgcttccagcagcaggcggcggccaagaacaagccggcggcagcgctggcggaggaggccccggccgccggcgggctgttcgtgaaggtgagcatggacggcgccccctacctcaggaaggtggacctaaagatgtacaagggctaccgcgagctgcgggaggcgctggaggccatgttcctctgcttctccggcgccggcgccgccgacgcgcccgccgtcaacccctccgacttcgccgtcacctacgaggacaaggacggcgacctcatgctcgtcggcgacgtgcccttcggcatgttcatcagcacctgcaagaggctgaggatcatgaaagggtctgaagcgagagggctcggctcggccaagaacaactgatgatgaggcgtctatcgcatgcttgtgctgtgcgtgcgtgcatgcgccagcaaattcttttgttcttttggggtcttatttcttctccaaggcgtccctgcatgggtgtgggcgtgtggtgttgagtattatgtaccttctcccctagcattgtctgtgccaacaatggagcagcagctagcagcaaaccagagacatggcgaggcgaaagatgaagctgcttgcttggaaggagagagagagagagagagagagagagagagagagagggaagctttgtgcatgcgtggaatgatgtgtggtcgctttgttctttttcttttgtgccccttgtaggggtgtgtgtgtgtgtgtttagcaagacatgcaaaaggagtggagagtcgagttgaatctccatgatgcgtggttgtacaaagccaaagatcactcttctttcttgtctaaaaaaaaaaagaaaaaaaaaaaaaaaaa

SEQ ID NO: 266 - protein, 229 aa, Zea mays
  misc_feature: Ceres CLONE ID no.1534670
  misc_feature: Bit score of 295.7 for HMM based on sequences of FIGURE 3.
  misc_feature (21)..(227): Pfam Name: AUX_IAA Pfam Description: AUX/IAA family
  misc_feature: Functional Homolog Of Ceres SEEDLINE ID no. ME09503 at SEQ ID NO. 129
MEVAAASAAGYGFKADDDVDSLRATELRLGLPGTEEEEAEESQNKAPPPPPSTPRGKKRDVVASSGPEDAPKKRDCETDTDAAPPPAAKAQLVGWPPVRSYRKSCFQQQAAAKNKPAAALAEEAPAAGGLFVKVSMDGAPYLRKVDLKMYKGYRELREALEAMFLCFSGAGAADAPAVNPSDFAVTYEDKDGDLMLVGDVPFGMFISTCKRLRIMKGSEARGLGSAKNN

SEQ ID NO: 267 - DNA, 1339 bp, Zea mays
  misc_feature: Ceres CLONE ID no.207963
  misc_feature: Encodes the peptide sequence at SEQ ID NO. 268
agtgcaagccaagcattctcctcacacacgtacttccgccagcgcagctagctagctgttctcttcttgccatcatctctcgtctgtgatcgaacgccggcgcgcggccagcatggagatgatcgacgcggagctgcgtcttggcccgcccgggagcaacaacagcgacgtcgtcgtcaccgtcgtgccgcctgcagcggcgaggaagccggcggcgccggcgccggcgccggcttcggcggcgaaacggccgtcctcgtcggtggtgaagagcgacgcgtccgggacgggcgaccatgacgacgacgccgcaccggcctccaaggtgcgggcggtggggtggccgccggtaagagcgtaccggaagaacgcgttccacgcggcggcggaggcggcgaggaggaccaataataagggcgaggagctgcagggaggcggccgcctgtacgtgaaggtgagcatggacggggcgccctacctccgcaaggtcgacctgcggacctacggcggctaccgggagctgagggacgcgctggacgcgctcttcggctgcttctcctcctcctcctcctcggccgacggcggcagccagttcgccgtcgcctacgaggacaaggacggcgacctcatgctcgccggcgacgtgccctgggagatgttcatctgctcctgcaagaagctgaggatcatgagggggtccgaagcaagataaccaacgcagcgaggatgcaaagaacatgttggatgcatggcatgcatggaggtccagctagctatggtccgtccaactcatgcatgggacagagcacagagggagagagagagacagaaaaaaaagggaggtctttatatcggccatccaatggaattggaggcgcggcgtakggtatatacctgcacagggatcggaggccccatgcatgcatgcgcgcgtcgtcgtgttctacggccagcccagccggctcataccatacacaccatggacatgcacatgatcagatggagcatggaggtgatggttcaaggatcacggcggcgtagtacgcgtcacgccgtgtctcccgccatcagtcaggcggacgtgctgctgtggacggctgactgggacgtgcatgcatggcagatcggagattattcagccaagtagtagcatcggtgaaaagctactaccacctaggattttttttttttgtgctgtgcacgctagttagctcatatgctgtagtttcatagctagcttgtgcttgctagcctatctgtaactttgagttcctcttttgtaagtgacctgggcccatgtatattagttcattctaggggtacgtgcagccgcacccac

SEQ ID NO: 268 - protein, 199 aa, Zea mays
  misc_feature: Ceres CLONE ID no.207963
  misc_feature: Bit score of 225.9 for HMM based on sequences of FIGURE 3.
  misc_feature (63)..(199): Pfam Name: AUX_IAA Pfam Description: AUX/IAA family
  misc_feature: Functional Homolog Of Ceres SEEDLINE ID no. ME09503 at SEQ ID NO. 129
MEMIDAELRLGPPGSNNSDVVVTVVPPAAARKPAAPAPAPASAAKRPSSSVVKSDASGTGDHDDDAAPASKVRAVGWPPVRAYRKNAFHAAAEAARRTNNKGEELQGGGRLYVKVSMDGAPYLRKVDLRTYGGYRELRDALDALFGCFSSSSSSADGGSQFAVAYEDKDGDLMLAGDVPWEMFICSCKKLRIMRGSEAR

SEQ ID NO: 269 - DNA, 790 bp, Musa acuminata
  misc_feature: Ceres CLONE ID no.1731500
  misc_feature: Encodes the peptide sequence at SEQ ID NO. 270
acctttttctctcaccggagattcctcggccaccttcctcgagcaaacaaggtcttcctcggtcgagcagagaagatcttctgacttatcagagtaaagagagaggaagaaggaaatggacggtggagtgggctatgcagacatggacgccctcaaggcgacagagctgaggctcggtctccctggtagccacccaccggagaagccgctgccgacgacgacgacgaccgcgaggcctaccaaacgctcgctcgacgaggacagggcagcccggcgtgagacttcggagggcggccgagccacgtccacacgagcgaccaaggcacaagtcatcgggtggccgccgatccggtcgtacaggaagaacagcttccaggcgatgaaggcgactgcggaggccgccggactgtacgtgaaggtgagcatggatggcactccttacttgaggaagatcgatctcgaggtgtacaaggggtacagggaactcagagaggcgttggaggacatgttcaagtgcttcgaaggttgcaaaggatccgagtacgccatcacctatgaagacaaagatggggacttgatgctggttggagatgtgccatgggagatgttcacatcctcttgcaaaaagctgaggataataagaggagctgaagccattagaggcctgggatcgagtcagtgacgagaacagccaagttcctcaaggatggaagaagggaaaagcgaagacgccaagatgagacggatcaagcagtgtatatatttgtgtgtctctgtgtgtgtgtgcgag

SEQ ID NO: 270 - protein, 188 aa, Musa acuminata
  misc_feature: Ceres CLONE ID no.1731500
  misc_feature: Bit score of 415.1 for HMM based on sequences of FIGURE 3.
  misc_feature (12)..(188): Pfam Name: AUX_IAA Pfam Description: AUX/IAA family
  misc_feature: Functional Homolog Of Ceres SEEDLINE ID no. ME09503 at SEQ ID NO. 129
MDGGVGYADMDALKATELRLGLPGSHPPEKPLPTTTTTARPTKRSLDEDRAARRETSEGGRATSTRATKAQVIGWPPIRSYRKNSFQAMKATAEAAGLYVKVSMDGTPYLRKIDLEVYKGYRELREALEDMFKCFEGCKGSEYAITYEDKDGDLMLVGDVPWEMFTSSCKKLRIIRGAEAIRGLGSSQ

SEQ ID NO: 271 - protein, 351 aa, Zinnia elegans
  misc_feature: Public GI ID no.20257219
  misc_feature: Bit score of 289.4 for HMM based on sequences of FIGURE 3.
  misc_feature (65)..(343): Pfam Name: AUX_IAA Pfam Description: AUX/IAA family
  misc_feature (65)..(343): Pfam Name: AUX_IAA Pfam Description: AUX/IAA family
  misc_feature: Functional Homolog Of Ceres SEEDLINE ID no. ME09503 at SEQ ID NO. 129
MPPPLLGVEGDGLGNVSLMTSASTMESIFQKNAELTERNYLGLSDCSSFDSTAVSGISEVKRNNLNLKATELRLGLPGSQSPERDVDVDLVNSESLDEKPLFPLLPSKDGICSNSQKVFVSGNKRGFSDAIDEGKWMFGSSGTDSETSNMNGKISSGAQPVMIKDATSKVVTQEQTHATFGTNLNIVNTSNPPAAKAQVVGWPPVRSFRKNILATNSKTNDEVDGKPGPGALFVKVSMDGAPYLRKVDLRSYSTYQQLSSAIEKMFSCFTIGQCGSQGAPGRESLSESKLRDLLHGSEYVLTYEDKDGDWMLVGDVPWDMFIGSCKRLKIMKGSDAIGLAPRAMEKSKNRN

SEQ ID NO: 272 - DNA, 937 bp, Panicum virgatum
  misc_feature: Ceres CLONE ID no.1876818
  misc_feature: Encodes the peptide sequence at SEQ ID NO. 273
acacttcaattccactcaaaactttctctcttcctctgccaagaacaccggccggctagcagcttgtgtttgttgttcccatggagatcgacggcgacaacctcagcgccaccgagctccggctcggcctgcccgggagcagcagcggcgacgaccggccgaggaggccggcgccctccgtcggcgccaagcgagcgctcgaggacaccaggagcgaggcgtccggcaccacggccgccggcgacgaccacgacgacgccacgcctgctgccaaagcgcaagtggtggggtggccgccggtgagggcgtacaggaagaacaccttccaggcggcggcgaagaaggccgagcagccgggagggctgtacgtgaaggtgagcatggacggggcgccgtacctcaggaaggtggacctccggatgtacaaggggtaccgggagctcagggaggcgctggacgccctcttcaccaagtccttctccgccgccgccgccgccggagcggagggcggcgacggccagcacgccctcgcctacgaggacaaggacggcgacctcatgctcgtcggagacgtgccctgggacatgttcatctcttcgtgcaagaagctcaggataatgaagggttgtgaggccaggtgattgccgatacacaggcagaggctgcagactcatgggggatgaatcgaggagcacagatcgtgcaaaggagctgtgtggcttgggctctccagtgctgtacaaagagatggttgtttctgaaaccaagaaggagaaggatctatgaattgtgtatatagtcttaggctcttagctagccgccttgttttttgagttatgttttgtatgagcgaaggctgtaaaaaaatcaaaaagaaaaatgagaaatttgacttaagtttggtcattttcctctccaaaaaaaaaaaaaaaaaaaa

SEQ ID NO: 273 - protein, 186 aa, Panicum virgatum
  misc_feature: Ceres CLONE ID no.1876818
  misc_feature: Bit score of 306.0 for HMM based on sequences of FIGURE 3.
  misc_feature (7)..(186): Pfam Name: AUX_IAA Pfam Description: AUX/IAA family
  misc_feature: Functional Homolog Of Ceres SEEDLINE ID no. ME09503 at SEQ ID NO. 129
MEIDGDNLSATELRLGLPGSSSGDDRPRRPAPSVGAKRALEDTRSEASGTTAAGDDHDDATPAAKAQVVGWPPVRAYRKNTFQAAAKKAEQPGGLYVKVSMDGAPYLRKVDLRMYKGYRELREALDALFTKSFSAAAAAGAEGGDGQHALAYEDKDGDLMLVGDVPWDMFISSCKKLRIMKGCEAR

SEQ ID NO: 274 - DNA, 1455 bp, Panicum virgatum
  misc_feature: Ceres CLONE ID no.1817533
  misc_feature: Encodes the peptide sequence at SEQ ID NO. 275
attactcgtggcccctcgttagcttgccctcttcctcctctttatcagtttcccttccattgcatttgcatgcctttacattgcaatcgcaagcctcctcctaccacccttcctccctctcaaagcagccaagcaagaagccaaacagccagccagcgagcaagaagccgcgcgagctagcagagggagcaggaaggcgaggaggtgaggagcgaggtggctgcggcggcggcaatggcggcggacctggggttcgaggagaccgagctccggctgggcctgcccggtggcggcgggggaggggttggagacggcgaggggacaaggagcgcctccggcaagaggggcttcgccgagaccatcgacctcaagctgaagctggagccggcggcggcggccgtcgtggaagaggagaaggaggtagtggatgccgccaaggaggccgcggcggcgaccgaggagtccccggccgggaagatgaagcggtcgcccagccagagcagcgtcgtcaccgccgccgcctcgcagcccgaccccgccgagaagccgcgcgcccccaaggctcaggtggtcggatggccgccggtgcgctcgttccggaagaacatcatgtctgtgcagtccgagaagggcgccggcagcaaggacgccgacgccgacaagtcctcgccggcagccggcggcggcgccgcgttcgtgaaggtgagcctggacggcgcgccgtacctgcgcaaggtggacctcaagatgtacaagagctaccaggagctgtccaaggctctcgagaagatggtcagctccttcaccaatggaagctgtgggtcccaagggatgaacggcatgaacgagagcaagctggtggatctgcttaacggctccgagtacgtgctgacctacgaggacaaggacggcgactggatgctcgtcggcgacgtcccatgggagatgttcgtcgaatcgtgcaagcgccttcggatcatgaagggatcagaagccattggcctggcgccaagggccatggagaaatgcaagaacagaagctgaacacatgggccgccagccagatgcaaggaccaagtctctagctctgcagctctgctcgtctctgtatcatactcgtccctgttctccaagcctgtacctcctgatcagtgaagtcattttggtgtgtcaactgttctatcagttccagtgagtcagtcagccagccaggcagtcagtcagtcagtgttcaagtttcatcttgtcatatacaaaagagagaaaccatgaataacatgtatctgtcctataacaatgtctttttgctctacctgctctttttctttgttgggcacaaaatgcaaaggcaccctgctcctaatcaaggggcccttttgcatcttgtccaccaaaagttgtttaattatattaccatggtgtgtcaatggaacaaataattgttgcaaaaaaacg

SEQ ID NO: 275 - protein, 269 aa, Panicum virgatum
  misc_feature: Ceres CLONE ID no.1817533
  misc_feature: Bit score of 281.1 for HMM based on sequences of FIGURE 3.
  misc_feature (5)..(261): Pfam Name: AUX_IAA Pfam Description: AUX/IAA family
  misc_feature: Functional Homolog Of Ceres SEEDLINE ID no. ME09503 at SEQ ID NO. 129
MAADLGFEETELRLGLPGGGGGGVGDGEGTRSASGKRGFAETIDLKLKLEPAAAAVVEEEKEVVDAAKEAAAATEESPAGKMKRSPSQSSVVTAAASQPDPAEKPRAPKAQVVGWPPVRSFRKNIMSVQSEKGAGSKDADADKSSPAAGGGAAFVKVSLDGAPYLRKVDLKMYKSYQELSKALEKMVSSFTNGSCGSQGMNGMNESKLVDLLNGSEYVLTYEDKDGDWMLVGDVPWEMFVESCKRLRIMKGSEAIGLAPRAMEKCKNRS

SEQ ID NO: 276 - DNA, 1005 bp, Panicum virgatum
  misc_feature: Ceres CLONE ID no.1958631
  misc_feature: Encodes the peptide sequence at SEQ ID NO. 277
agcaaacacaccacctcatctcatctcatctcattctcagctagctgctgcagagagagacgtgttagcgacgacgcggatcggaggcagctgcaaccggagcaggaggatttcaaaagttgggagatggaaaccgtcgtgggcgacctcatggccaccgagctcaggctcggcctcccgggaaccatcgacgagatgaaggccgcggcgccgtcgacgcctaggggaaagaagcgcaccaccaccgacgccgtggagggcgccgccgccaaggaggccagcaagcgtgatgccgaggcagcacctcctgcagccaaggcccccgtcgtaggttggccgccggtgaggtcgtaccggaagagctgcttccaggcgagcagcaagcagagcaaggcgaccaaggaggaggcggcgcccagcagcaacgccgccgcgccatccgcggccgcgaacacctccaccaccgccggcgccttcgtcaaagtgagcatggacggcgcgccctacctgaggaaggtggacctgaggatgtacaagggctacagggagctccgggaggccctggaggccatgttcgtctcctccaacagcggcggcgccaacctgtccgagttcgccgtcacctacgaggacaaggacggcgacctgatgctcgtcggcgacgtgccattcgagatgttcactagcacttgcaagaagctgaggatcatgaagagatctgaagccacaggtctgggatcagcgagacaatgaagatggatctgagggccaggcagcttgtcatgagcttcttgtttctttctattatttttgttcttctggttggatccccaagccaaaggatgagcttggtgcatcaaagtgctcacatggatgtgagcggctttggttctgtaagacatttaggtcttttagcagcacaaaggagatgtgagactgcttcagttaactccccatgtgtttgtacaaacgaaacacagttatattgatcgttggttattactt

SEQ ID NO: 277 - protein, 208 aa, Panicum virgatum
  misc_feature: Ceres CLONE ID no.1958631
  misc_feature: Bit score of 292.5 for HMM based on sequences of FIGURE 3.
  misc_feature (7)..(207): Pfam Name: AUX_IAA Pfam Description: AUX/IAA family
  misc_feature: Functional Homolog Of Ceres SEEDLINE ID no. ME09503 at SEQ ID NO. 129
METVVGDLMATELRLGLPGTIDEMKAAAPSTPRGKKRTTTDAVEGAAAKEASKRDAEAAPPAAKAPVVGWPPVRSYRKSCFQASSKQSKATKEEAAPSSNAAAPSAAANTSTTAGAFVKVSMDGAPYLRKVDLRMYKGYRELREALEAMFVSSNSGGANLSEFAVTYEDKDGDLMLVGDVPFEMFTSTCKKLRIMKRSEATGLGSARQ

SEQ ID NO: 278 - DNA, 1329 bp, Panicum virgatum
  misc_feature: Ceres CLONE ID no.1963215
  misc_feature: Encodes the peptide sequence at SEQ ID NO. 279
agcttctttaaccacccaccgcccgccattatcatctcgctccatccccttcgcttctctctctccttgcatctcgccggccagccgtgtgctgctgctctctgtctctgcgtgcgcccgccgacaggccaaaagccgaagccttccgcagcagcctctggtgtgcgcattggagcggcggcgccggcgggggaattaattgatccatggcaggcctcgggtacgaggagaccgagctccggctcggcctgcccggcggcgggagcgacgccaccggggacgccgcggccgcgaggaagcggtgcttcgaggagaccatcgacctcaagctgaagctggaacagccggcgtcgtcgcccgcggcgcgcgtcgagaaggaagcagaggaggacggtgaggccgaggaggaggcggtggcggcggccgatgtcgtcgcggccgcgtcgccggcagcgtccgccaccggcggagctggaggtaacaatatgaagaggtcgccgagccagagcagcgtggtcaccgccgacgacgacgcgcagccggaccctgagaagcctcgcgcgcccaaggcgcaggcggtggggtggccgcccgtccggtcgtcccgcaagaacatcttctccgtgcagaaaaccggcggcggcaaggacgacgacggcaagtccggcgccggcgcggcggcggcgttcgtgaaggtgagcatggacggcgcgccgtacctgcgcaaggtggacctgaggatgtacgggagctaccaggagctgtccaaggcgctcgagaagatgttcagctccttcaccatcggcagctgcggcgggtcccaggggatgcagggtatgaacgagtccaagctggcggacctgctcagcggctccgagtacgtgcccacctacgaggacaaggacggcgactggatgctcgtcggcgacgtgccctgggagatgttcgtggagtcgtgcaagcgcctccggatcatgaaaggatcggaagccgtcggcctcgcgccgagggcgatggagaagtgcaagaacagttgctgaggaaggcacacatcatcgcaagcgtccggcctgtattaactgcaaggatgatggatacgcgtctgcccgtctctgtatcatattaatgttgttgttgatcgagtttactgccctgaaagcctgtgtcgatctctcatcgtcgtctcagtcaaggcgtgttcatgtattagtctgttctttctcgttcttttagggattccatgcttgtattgttgttgcggttaagtttcatcttgttatatgaagtatatatatacacacgtaacaaagatggtgtgattattgatcg

SEQ ID NO: 279 - protein, 277 aa, Panicum virgatum
  misc_feature: Ceres CLONE ID no.1963215
  misc_feature: Bit score of 275.4 for HMM based on sequences of FIGURE 3.
  misc_feature (4)..(269): Pfam Name: AUX_IAA Pfam Description: AUX/IAA family
  misc_feature: Functional Homolog Of Ceres SEEDLINE ID no. ME09503 at SEQ ID NO. 129
MAGLGYEETELRLGLPGGGSDATGDAAAARKRCFEETIDLKLKLEQPASSPAARVEKEAEEDGEAEEEAVAAADVVAAASPAASATGGAGGNNMKRSPSQSSVVTADDDAQPDPEKPRAPKAQAVGWPPVRSSRKNIFSVQKTGGGKDDDGKSGAGAAAAFVKVSMDGAPYLRKVDLRMYGSYQELSKALEKMFSSFTIGSCGGSQGMQGMNESKLADLLSGSEYVPTYEDKDGDWMLVGDVPWEMFVESCKRLRIMKGSEAVGLAPRAMEKCKNSC

SEQ ID NO: 280 - DNA, 986 bp, Panicum virgatum
  misc_feature: Ceres CLONE ID no.1770022
  misc_feature: Encodes the peptide sequence at SEQ ID NO. 281
accggcacacttcaattccactcaaaactttcctcctcctcctcatcttcgtcttcctctctctagctgctgtgggaatactctctctctctctctctctgccaagaacaccggccggctagcagcttgtgtttgttgttcccatggagatcgacggcgacaacctcagcgccaccgagctccggctcggcctgccggggaccagcagcggcgacgaccggccgaggaggccggcgccctccgtcggcgccaagcgcgcgctcgaggacaccaggagcgaggcgtccggcaccacggccgccggcgacgaccacgacgacgccacgcctgctgccaaagcgcaagtggtggggtggccgccggtgagggcgtacaggaagaacaccttccaggcggcggcgaagaaggccgagcagccgggagggctgtacatgaaggtgagcatggacggggcgccgtacctcaggaaggtggacctccggatgtacaaggggtaccgggagctcagggaggcgctggacgccctcttcaccaagtccttctccgccgccgccgccgcagcggagggcggcgacggccagcacgccctcgcctacgaggacaaggacggcgacctcatgctcgtcggagacgtgccctgggacatgttcatctcttcgtgcaagaagctcaggataatgaagggttgtgaggccaggtgattgccgatacacaggcagaggctgcagactcatgggggatgaatcgaggagcacagatcgtgcaaaggagctgtgtggcttgggctctccagtgctgtacaaagagatggttgtttctgaaaccaagaaggagaaggatctatgaattgtgtatatagttttaggctcttagctagccgccttgttttttgagttgtgttttgtatgagcgaaggctgtaaaaaaatcaaaaagaaaaatgagaaatttgacttaagtttggtcgaaaaaaaaaaaaaaaaaaaa

SEQ ID NO: 281 - protein, 185 aa, Panicum virgatum
  misc_feature: Ceres CLONE ID no.1770022
  misc_feature: Bit score of 306.2 for HMM based on sequences of FIGURE 3.
  misc_feature (7)..(185): Pfam Name: AUX_IAA Pfam Description: AUX/IAA family
  misc_feature: Functional Homolog Of Ceres SEEDLINE ID no. ME09503 at SEQ ID NO. 129
MEIDGDNLSATELRLGLPGTSSGDDRPRRPAPSVGAKRALEDTRSEASGTTAAGDDHDDATPAAKAQVVGWPPVRAYRKNTFQAAAKKAEQPGGLYMKVSMDGAPYLRKVDLRMYKGYRELREALDALFTKSFSAAAAAAEGGDGQHALAYEDKDGDLMLVGDVPWDMFISSCKKLRIMKGCEAR

SEQ ID NO: 282 - DNA, 1841 bp, Panicum virgatum
  misc_feature: Ceres CLONE ID no.1796223
  misc_feature: Encodes the peptide sequence at SEQ ID NO. 283
aacaaacacaccagctcatctcattctcagctagctgcagagagaccacagagcaactcgctcgatcgagagacgtgttactgcaaccggaccaggaggactcgccgtcgtggtcgtcgccggccgggcttactcaaaagttgggagatggaaaccgtcgtgggcgatctcatggccaccgagctcaggcttggcctcccgggaaccgtcgacgagatgaaggccacggtgccgtcggcgccgtcgacgcctaggggaaagaagcgcaccaccaccgatgccgtggaggacgccgccgccgccgaggaggccagttgccagcgtgatgtcgaggcagcacctcctgcagccaaggcccccgtcgtaggttggccgccggtgaggtcgtaccggaagagctgcttccaggcgagcagcaagcagagcaaggcgaccaaggaggaggcggcgcccagcagcaacgccgcgccatccgcggccgccaacaccaccaccgccggctccttcgtcaaagtgagcatggacggcgccccctacctgaggaaggtggacctgaggatgtacaagggctacagggagctccgggaggcgctggaggccatgttcgtctcctccaacagcggcggcgcgaacctgtccgagttcgccgtcacctacgaggacaaggacggcgacctgatgctcgtcggcgacgtgccattcgagatgttcactagcacttgcaagaagctgaggatcatgaagagatctgaagccacaggcctgggatcagcgagacaatgaagatggatctgagggccagacagcttatcatgagctttcttcttgtttctttttattatttttgttctttgtggttggatccccaagccaaaggatgagcttggtgcatcaaagcgctcacatggaggtgtgcggctttggttctgtaagacatttaggtcttttagcagcacaaaggagatgctgagattgcttcagttaactccccatgtgtttgtacaaacgacacacagtgatattgatcgttggttattaaaagcccaccgcagcgcaccgcgacgacgtcgggccccgaccccgagtggcaccggccagccagctcgagcacagctctcgccgcgcgacgacgccatggccccgaccgccccagccgccgccacgggcgcggcgagccccgccgcgccggccgtcgccaggagcgagggcagtggcaaggccgccgcgcgctccgtggggctcgacctgcccgcgctgccgggcctcggcctcggcctcgcggcgcagggacaggcgacccgcgccgcgtcctgcaagcggccggagcggaacgtggtggccatggctgccggggccgcgggggagccggcggcggcgccggtggtcgccaacgaggagatcaccgagtttgtcaacgccttgaaacaggagtgggacgggatcgagaacaagttcgcggtgaccacgctcgccgtcactgtcacgctcgtcatgtggagcgctggtggagtagtatcggcgattgacaggctccccgtagttccaggcctgatggaggttgttggaattggatacagtgggtggtttgcgtaccgctacctgctattcaagcctgacagggatgctttctttgcaaaggtcagggagttctacgaggatataatcagcggctaacagaatatgatgcaagctcatccaaatgaaggaagttcaatttgagaggggcatgctagtctgctgctgttcagttcttctctgtaatatatttcagtatagcatctaatttgattctcactcaatgtatggataatttggatgctaatcgtaaataacatttaatc

SEQ ID NO: 283 - protein, 211 aa, Panicum virgatum
  misc_feature: Ceres CLONE ID no.1796223
  misc_feature: Bit score of 294.4 for HMM based on sequences of FIGURE 3.
  misc_feature (7)..(210): Pfam Name: AUX_IAA Pfam Description: AUX/IAA family
  misc_feature: Functional Homolog Of Ceres SEEDLINE ID no. ME09503 at SEQ ID NO. 129
METVVGDLMATELRLGLPGTVDEMKATVPSAPSTPRGKKRTTTDAVEDAAAAEEASCQRDVEAAPPAAKAPVVGWPPVRSYRKSCFQASSKQSKATKEEAAPSSNAAPSAAANTTTAGSFVKVSMDGAPYLRKVDLRMYKGYRELREALEAMFVSSNSGGANLSEFAVTYEDKDGDLMLVGDVPFEMFTSTCKKLRIMKRSEATGLGSARQ

SEQ ID NO: 284 - DNA, 719 bp, Panicum virgatum
  misc_feature: Ceres CLONE ID no.2016695
  misc_feature: Encodes the peptide sequence at SEQ ID NO. 285
tcaccggcacacttcaattccacacaaaactttcctcctcatcatcatcttcgtcttcctctcctcatcctctctctgtggtcatactttctctctcttctcttcctctgccaagaacaccgaccggctagcagctcgtgctcccatggagatcgacgccgagaacctcagcgccaccgagctccgcctcggcctgccgggaaccagcagcggcgacgaccgccccaagaggccggcgccctccgtcggcgccaagcgcgcgctcgacgacacccggagcgaggcctcgggcaccagcccggccgccgggggcgaccacgacgccgccacgcctgccaaagcgcaagtggtggggtggccgccggtgagggcgtacaggaagaacaccttccaggcggcggcggcgaagaaggccgagcagcccggagggctgtacgtgaaggtgagcatggacggggcgccgtacctcaggaaggtggacctccggatgtacaaggggtaccgggagctcagggaggcgctggacgccctcttcaccaagtccttctccgcctccgccggagcagagggcggcgacggccagcacgccctcgcctacgaggacaaggacggcgacctcatgctcgtcggagatgtgccctgggacatgttcatctcttcgtgcaagaagctcaggataatgaatggttctgaggccaggtgaccactgatgcacaggc

SEQ ID NO: 285 - protein, 185 aa, Panicum virgatum
  misc_feature: Ceres CLONE ID no.2016695
  misc_feature: Bit score of 289.3 for HMM based on sequences of FIGURE 3.
  misc_feature (7)..(185): Pfam Name: AUX_IAA Pfam Description: AUX/IAA family
  misc_feature: Functional Homolog Of Ceres SEEDLINE ID no. ME09503 at SEQ ID NO. 129
MEIDAENLSATELRLGLPGTSSGDDRPKRPAPSVGAKRALDDTRSEASGTSPAAGGDHDAATPAKAQVVGWPPVRAYRKNTFQAAAAKKAEQPGGLYVKVSMDGAPYLRKVDLRMYKGYRELREALDALFTKSFSASAGAEGGDGQHALAYEDKDGDLMLVGDVPWDMFISSCKKLRIMNGSEAR

SEQ ID NO: 286 - DNA, 1003 bp, Panicum virgatum
  misc_feature: Ceres CLONE ID no.1757085
  misc_feature: Encodes the peptide sequence at SEQ ID NO. 287
accggcacacttcaattccactcaaaactttctctcttcctcctcatattcgtcttcctctctctagctgctgcggtcatactttctctccctctctctctcttcctctgccaagaacaccggccggctagcagcttgtgtttgttgttcccatggagatcgacggcgacaacctcagcgccaccgagctccggctcggcctgccggggaccagcagcggcgacgaccggccgaggaggccggcgccctccgtcggcgccaagcgcgcgctcgaggacaccagaagcgaggcgtccggcaccacggccgccggcgacgaccacgacgacgccacgcctgctgccaaagcgcaagtggtggggtggccgccggtgagggcgtacaggaagaacaccttccaggcggcggcgaagaaggccgagcagccgggagggctgtacgtgaaggtgagcatggacggggcgccgtacctcaggaaggtggacctccggatgtacaaggggtaccgggagctcagggaggcgctggacgccctcttcaccaagtccttctccgccgccgccgccgccgccgccggagcggagggcggcgacggccagcacgccctcgcctacgaggacaaggacggcgacctcatgctcgtcggagacgtgccctgggacatgttcatctcttcgtgcaagaagctcaggataatgaagggttgtgaggccaggtgattgccgatacacaggcagaggctgcagactcatgggggatgaatcgaggagcacagatcgtgcaaaggagctgtgtggcttgggctctccagtgctgtacaaagagatggttgtttctgaaaccaagaaggagaaggatctatgaattgtgtatatagtcttaggctcttagctagccgccttgttttttgagttatgttttgtatgagcgaaggctgtaaaaaaatcaaaaagaaaaatgagaaatttgacttaagtttggtcaaaaaaaaaaaaaaaaaaaa

SEQ ID NO: 287 - protein, 188 aa, Panicum virgatum
  misc_feature: Ceres CLONE ID no.1757085
  misc_feature: Bit score of 306.4 for HMM based on sequences of FIGURE 3.
  misc_feature (7)..(188): Pfam Name: AUX_IAA Pfam Description: AUX/IAA family
  misc_feature: Functional Homolog Of Ceres SEEDLINE ID no. ME09503 at SEQ ID NO. 129
MEIDGDNLSATELRLGLPGTSSGDDRPRRPAPSVGAKRALEDTRSEASGTTAAGDDHDDATPAAKAQVVGWPPVRAYRKNTFQAAAKKAEQPGGLYVKVSMDGAPYLRKVDLRMYKGYRELREALDALFTKSFSAAAAAAAGAEGGDGQHALAYEDKDGDLMLVGDVPWDMFISSCKKLRIMKGCEAR

SEQ ID NO: 288 - DNA, 1015 bp, Panicum virgatum
  misc_feature: Ceres CLONE ID no.1769256
  misc_feature: Encodes the peptide sequence at SEQ ID NO. 289
agtccccactcgcgaactcacgagctcagcagcagcgcccaaagacaaacctcgagcccatccctcctcttgacacctcactcccccaagaacccagtattccaggagttggtgatgctcgtggagtttggctagacatggcgcctccacaggagcgggattacatcgggctgtcgccggcgacggcggccaccgagctgcgtctggggctgccgggcacggaagaggcggagggccgcaacgcggtggcggggacgccgctcaccctcgagctgcttcccaagggcggggccaagcgcggattcgcggacgccatcgtgcggcgggacgcggctgcaacaggcaaggcgccggcggacgacgaggaggtggacaagaagaaggcgcaggctccgacggcaaaggcacaggtggtaggatggccaccaatccgcggctacagaaagaacaccatggcgatgaaccaggattgcctctatgtcaagattagcatagatggtgctccatacctcaggaaggtggaccttaagatgtacagcaactacaaagagctctcactggcgctggagaaaatgttcagctcctttactgttggtgatattgaatctaacgggaaatcaggaagagaaggattatctgattgccgactaatggatcataaaaatggcactgaacttgtgctcacatataaggacaaggatggagattggatgcttgttggtgatgtcccgtggagaatgttcacgggcagctgtagaaggctcaggatcatgaagggctcagatgcagtgggccttgcacccagagccactgagaagagcaagaacggtaactaggaaaaggatgaatgcgctctactccctacagccttatcctactcttacctgtaaggtctcattctcaaacccacaaggttaaaggacttaacatgtgagaaggggattacttatatcaatatgtacacctatggtttttgttttgcccccccccccccaaacccccccccccccccccc

SEQ ID NO: 289 - protein, 232 aa, Panicum virgatum
  misc_feature: Ceres CLONE ID no.1769256
  misc_feature: Bit score of 307.6 for HMM based on sequences of FIGURE 3.
  misc_feature (18)..(224): Pfam Name: AUX_IAA Pfam Description: AUX/IAA family
  misc_feature: Functional Homolog Of Ceres SEEDLINE ID no. ME09503 at SEQ ID NO. 129
MAPPQERDYIGLSPATAATELRLGLPGTEEAEGRNAVAGTPLTLELLPKGGAKRGFADAIVRRDAAATGKAPADDEEVDKKKAQAPTAKAQVVGWPPIRGYRKNTMAMNQDCLYVKISIDGAPYLRKVDLKMYSNYKELSLALEKMFSSFTVGDIESNGKSGREGLSDCRLMDHKNGTELVLTYKDKDGDWMLVGDVPWRMFTGSCRRLRIMKGSDAVGLAPRATEKSKNGN

SEQ ID NO: 290 - DNA, 1645 bp, Panicum virgatum
  misc_feature: Ceres CLONE ID no.1994871
  misc_feature: Encodes the peptide sequence at SEQ ID NO. 291
atcacacacctggctcaattggtaggcagacgttgcttggcggggcggccatagctagctagctgctttgcttcctcctcctgccgctgctgctctcgtttccctgcccggcgtctgctcgcccctgcaacgccctcaggtatctcgccctgcacttattccctagcctacctagcttctacagtactagctagcgcgcaggcagccagcgaccgagctgcgagctagagagagacagaggcagtgatcggagagacagatcagaggagctcgtcttctttccgtgcgacctacttggagctcacctgcagctttgaatgctcagagcctgaaagcactcgagcagccttgtcccttgctcgcaaacccttgccgccttttggtcacctcgggctgcgcgcggagcagcacctgtgctctgctctgcctgccctgtcctccgcctctcctgttcaccgctctccctcttctcggttctcgctgccctgccaggtagggagcagcctttcctcgccggtcgccgtcctcatttatgtgctcccctctgtccactgctcgcctctctccctactactctgtgctctgcttgtgtcgtgactcgtgagtgacccgtgaccgtgagctaggaggaggaggaggaaggcggcgaccatggcgtggcgcggccggctcggggaggccggggacagcggcctcgagctcagccttggcctcccggcctacttcgccaagccctcaggtttggacgccggcgaggagcccggtgacgctgctgcttttcctctccaagctggcaaagggaacaacgatgcttccaagacgagggccaggtcagcagctgctgctccggtggtggggtggccgccggtgcggtcgttcaggaggaacctggggtcctccaggcagtcgccccagtcgtcgtccgctcaacatcaggacggcggcggcggcgccaagggaggcggcgccggcgagggcgcgcgcaagggcggcctgttcgtgaaggtcaacatggacggcgtgccgatcggccggaaggtggacctcacggcgtacggcggctacgccgagctctccgccgccgtcggcaagctcttccgcggcctgctggccgcccagaaggacccgaccgccgccgcggtgggcaggcgctgcggcgagggggcggaggaggccgaggagcccgtgatcggcggcgagtacacgctggtgtacgaggacgaggagggcgaccgggtgctggtcggcgacgtcccctgggagatgttcgtggccaccgccaagaggctgcgcgtgctcaggagctccgacctgccggcctcgtcgctgagagcaggcgggggcaggaagagggctgcagccgactgctgaagctggaccatccatgctctgttctgttccgatcgccagcttggagaaaaggtcccgggtggaggagaacgggcgtggccttgcccctttttgatgtctttccgtgttgctgctaatagtaacttgctagtaagtagtatatgggagggagggaacaagccatgacggtattagggtcatgtaatgcagtagtgttaggtgttcatgaatctatcgcctttcttgcctgcttttgagtacatctcagtggtaaaaaaaatgcggaattgtatgc

SEQ ID NO: 291 - protein, 239 aa, Panicum virgatum
  misc_feature: Ceres CLONE ID no.1994871
  misc_feature: Bit score of 135.1 for HMM based on sequences of FIGURE 3.
  misc_feature (16)..(230): Pfam Name: AUX_IAA Pfam Description: AUX/IAA family
  misc_feature: Functional Homolog Of Ceres SEEDLINE ID no. ME09503 at SEQ ID NO. 129
MAWRGRLGEAGDSGLELSLGLPAYFAKPSGLDAGEEPGDAAAFPLQAGKGNNDASKTRARSAAAAPVVGWPPVRSFRRNLGSSRQSPQSSSAQHQDGGGGAKGGGAGEGARKGGLFVKVNMDGVPIGRKVDLTAYGGYAELSAAVGKLFRGLLAAQKDPTAAAVGRRCGEGAEEAEEPVIGGEYTLVYEDEEGDRVLVGDVPWEMFVATAKRLRVLRSSDLPASSLRAGGGRKRAAADC

SEQ ID NO: 292 - protein, 236 aa, Oryza sativa subsp. indica
  misc_feature: Public GI ID no.17154533
  misc_feature: Bit score of 283.0 for HMM based on sequences of FIGURE 3.
  misc_feature (10)..(228): Pfam Name: AUX_IAA Pfam Description: AUX/IAA family
  misc_feature: Functional Homolog Of Ceres SEEDLINE ID no. ME09503 at SEQ ID NO. 129
MAGADVDVGTELRLGLPGGGGGAAEAAAKAAKRGFEETIDLKLKLPTAGMEEAAAGKAEAPAAEKAKRPAEAAAADAEKPPAPKAQAVGWPPVRSFRRNIMTVQSVKSKKEEEADKQQQQPAANASGSNSSAFVKVSMDGAPYLRKVDLKMYNSYKDLSLALQKMFGTFTATGNNMNEVNGSDAGTTYEDKDGDWMLVGDVPWQMFVESCKRLRIMKGSEAIGLAPRAKDKYKNKS

SEQ ID NO: 293 - protein, 268 aa, Oryza sativa subsp. indica
  misc_feature: Public GI ID no.125557462
  misc_feature: Bit score of 270.3 for HMM based on sequences of FIGURE 3.
  misc_feature (79)..(216): Pfam Name: AUX_IAA Pfam Description: AUX/IAA family
  misc_feature: Functional Homolog Of Ceres SEEDLINE ID no. ME09503 at SEQ ID NO. 129
MASSSSLRSTSCLASAAETDADNLCLRLGPPGSSITTTTTIGGADPAAKRSLGAKRSLESTDSMASGTGNSAAGDEHDDDTAAPAKAQVVGWPPVRAYRRNTFHQVAAAATKKGGDEKQKQQQQGGGLYVKVSMDGAPYLRKVDLKMCKGYRELREALDLLFTKCFSATASDGCSDGQFAIAYEDKDGDLMLVGDVPWEMFISSCKKLRIMKGSEASTKPVFVRSEAIGSNSEEDKALAWLPAHTANQADADARMNQHKLRGRITSKK

SEQ ID NO: 294 - protein, 236 aa, Oryza sativa subsp. indica
  misc_feature: Public GI ID no.125524736
  misc_feature: Bit score of 153.8 for HMM based on sequences of FIGURE 3.
  misc_feature (69)..(216): Pfam Name: AUX_IAA Pfam Description: AUX/IAA family
  misc_feature: Functional Homolog Of Ceres SEEDLINE ID no. ME09503 at SEQ ID NO. 129
MAWRRGFGEEDGAAAAGESGLELCLGLPAYFSSSSSSKPSEGSTAAPAFALRSNGTNASKPRAAAAAPVVGWPPVRSFRRNLASSSSSSSKQAPPPPSSSPQNGDKASKDGGAEKGMFVKINMDGVPIGRKVDLTAYGGYAQLSAAVDKLFRGLLAAQSAAADGEADAAAAGEMVGGGEYTLVYEDDEGDRMLVGDVPWQMFIATAKRLRVLKSSDLPPPSLMRAAGSRKRAAADS

SEQ ID NO: 295 - protein, 335 aa, Oryza sativa subsp. indica
  misc_feature: Public GI ID no.125527656
  misc_feature: Bit score of 93.2 for HMM based on sequences of FIGURE 3.
  misc_feature (49)..(335): Pfam Name: AUX_IAA Pfam Description: AUX/IAA family
  misc_feature: Functional Homolog Of Ceres SEEDLINE ID no. ME09503 at SEQ ID NO. 129
MEEGSNKREGLPPQLLDLIPDEKEWKLREALGLGRSRNAGFDGEEDKKLDLKLGLPGFIEDDEAETLRDYRLQQECPSLSLGFFPKHSKTTSSTTTTTGAKRGFIDTVEDKTEGYNDQKQQARAGCGKELAVEEMIAAVSERKKGCCPPPPPPHGAPATPARNRPQTQGRGAAAPVVGWPPIRSFRRNLASSSSSKHSPEPQNDNANAKVTLTCKKNPLVKINMDGIPIGRKIDLAAYNSYDGLSSAVKQLFHGFLQAQKDQTNAQIAQQGADDKIFYQLLDGSGEYTLVYEDSEGDRMLVGDVPWKVFVSTAKRLRVLRSSELSHTLIGATARV

SEQ ID NO: 296 - protein, 275 aa, Oryza sativa subsp. japonica
  misc_feature: Public GI ID no.125599342
  misc_feature: Bit score of 274.5 for HMM based on sequences of FIGURE 3.
  misc_feature (79)..(218): Pfam Name: AUX_IAA Pfam Description: AUX/IAA family
  misc_feature: Functional Homolog Of Ceres SEEDLINE ID no. ME09503 at SEQ ID NO. 129
MASSSSLRSTSCLASAAETDADNLCLRLGPPGSSITTTTTTGGADPAAKRSLGAKRSLESTDSMASGTGTSAAGDEHDDDTAAPAKAQVVGWPPVRAYRRNTFHQAAAAAAATKKGGDEKQKQQQQGGGLYVKVSMDGAPYLRKVDLKMCKGYRELREALDLLFTKCFSATASDGCSDGQFAIAYEDKDGDLMLVGDVPWEMFISSCKKLRIMKGSEASKIYALKTNQVLNLQAIGSNSEEDKALAWLPAHTANQADADARMNQHKLRGRITSKK

SEQ ID NO: 297 - protein, 218 aa, Oryza sativa subsp. japonica
  misc_feature: Public GI ID no.125569626
  misc_feature: Bit score of 336.0 for HMM based on sequences of FIGURE 3.
  misc_feature (32)..(207): Pfam Name: AUX_IAA Pfam Description: AUX/IAA family
  misc_feature: Functional Homolog Of Ceres SEEDLINE ID no. ME09503 at SEQ ID NO. 129
MSPPLELDYIGLSPPPPPPSSSSAAAARADDVDLKGTELRLGLPGSESPDRRPAAIAAAAATATTLEAAARQGAQVVGWPPIRSYRKNTMATNQIKSNKEDVDAKQGQGFLYVKVSMDGAPYLRKVDLKTYKNYKDMSLGLEKMFIGFSTGKEGAENQKDGEYVLTYEDKDGDWMLVGDVPWEMFTDSCRRLRIMKGSDAIGLGCSQLRLVPLFVPKL

SEQ ID NO: 298 - protein, 281 aa, Oryza sativa subsp. japonica
  misc_feature: Public GI ID no.115465401
  misc_feature: Bit score of 271.8 for HMM based on sequences of FIGURE 3.
  misc_feature (40)..(273): Pfam Name: AUX_IAA Pfam Description: AUX/IAA family
  misc_feature: Functional Homolog Of Ceres SEEDLINE ID no. ME09503 at SEQ ID NO. 129
MPPPLEARDYIGLAASPASSSSSCCASTPVAEVVGAHLALRLGLPGSESPARAEAEAVVVDAALTLGPAPPPRGGAKRGFVDSLDRSEGRRAAATAGDDERGVREEEEEEKGLGEAAAGAPRAAKAQVVGWPPVRSYRKNTLAASATKTKGEDQGKSEVGCCYVKVSMDGAPYLRKVDLKTYSSYEDLSLALEKMFSCFITGRSSSHKTSKRDRLTDGSRADALKDQEYVLTYEDKDADWMLVGDLPWDLFTTSCRKLRIMRGSDAAGMAPRSLEQTGQNK

SEQ ID NO: 299 - protein, 224 aa, Oryza sativa subsp. japonica
  misc_feature: Public GI ID no.40539038
  misc_feature: Bit score of 191.2 for HMM based on sequences of FIGURE 3.
  misc_feature (10)..(204): Pfam Name: AUX_IAA Pfam Description: AUX/IAA family
  misc_feature: Functional Homolog Of Ceres SEEDLINE ID no. ME09503 at SEQ ID NO. 129
MAGADVDVGTELRLGLPGGGGGAAEAAAKAAKRGFEETIDLKLKLPTAGMEEAAAGKAEAPAAEKAKRPAEAAAADAEKPPAPKAQAVGWPPVRSFRRNIMTVQSVKSKKEEEADKQQQQPAANASGSNSSAFVKVSMDGAPYLRKVDLKMYNSYKDLSLALQKMFGTFTATGNNMNEVNGSDAVTTYEDKDGDWMLVGDVPWQYVTTSFLCPLNCFPYFPPHD

SEQ ID NO: 300 - protein, 204 aa, Populus tremula x Populus tremuloides
  misc_feature: Public GI ID no.20269063
  misc_feature: Bit score of 503.5 for HMM based on sequences of FIGURE 3.
  misc_feature (7)..(204): Pfam Name: AUX_IAA Pfam Description: AUX/IAA family
  misc_feature: Functional Homolog Of Ceres SEEDLINE ID no. ME09503 at SEQ ID NO. 129
MEFERDLNLDATELRLGLPGTATRQSEKQTPNSNLAKSNKRSLPDMNEDPAGSSRENSSTVSSNEEKSHDQETAPPPIKAQVVGWPPIRSYRKNCLQAKKQEAEAAGLYVKVSMDGAPYLRKIDLKVYKGYPELLKALEEMFKSKVGEYSEREGYNGSEHVPTYEDKDGDWMLVGDVPWDMFINSCKRLRIMKESEARGLGCAV

SEQ ID NO: 301 - protein, 277 aa, Populus tremula x Populus tremuloides
  misc_feature: Public GI ID no.20269059
  misc_feature: Bit score of 282.8 for HMM based on sequences of FIGURE 3.
  misc_feature (14)..(269): Pfam Name: AUX_IAA Pfam Description: AUX/IAA family
  misc_feature: Functional Homolog Of Ceres SEEDLINE ID no. ME09503 at SEQ ID NO. 129
MATATVLGTERADLNYKATELCLGLPGAVGVKNEVETPNKATGKRGFAETVDLKLNLQAKEGVMDLNENINNIASEDKNHLPSATIKDPAKPPAKAQVVGWPPVRSYRKNVLAQKNASEEGFGAQVEGWPPVRSYRKNVLVQKNASEEGEKASTGGCSAAFVKVCMDGAPYLRKVDLKMYKSYQELSDALAKMFSSLTMGNYGAQGMIDFMNESKLMDLLNSSEYVPSYEDKDGDWMLVGDVPWEMFVDSCKRPRIMKGSEAVGLAPRAMEKCKSRT

SEQ ID NO: 302 - protein, 211 aa, Elaeis guineensis
  misc_feature: Public GI ID no.50404477
  misc_feature: Bit score of 418.8 for HMM based on sequences of FIGURE 3.
  misc_feature (17)..(203): Pfam Name: AUX_IAA Pfam Description: AUX/IAA family
  misc_feature: Functional Homolog Of Ceres SEEDLINE ID no. ME09503 at SEQ ID NO. 129
MSTDTGRSSTESEVSGLDYEETELKLGLPGGSRTAGSETEKKRGFAETVDLSLGAESRSGDLGDRSTGDFGSGAGKPPAVKAQVVGWPPVRSFRKNALKSCTYVKVAVDGAPYLRKVDLEMYGGYQQFLTAIEDMFSCFTVRNCPNERRLVDPVNGTEYVPTYEDKDGDWMLVGDVPWKMFVASCKRLRLMKSSEAINLAPRTPQGSTRAR

SEQ ID NO: 303 - protein, 201 aa, Populus tomentosa
  misc_feature: Public GI ID no.62125392
  misc_feature: Bit score of 479.6 for HMM based on sequences of FIGURE 3.
  misc_feature (7)..(201): Pfam Name: AUX_IAA Pfam Description: AUX/IAA family
  misc_feature: Functional Homolog Of Ceres SEEDLINE ID no. ME09503 at SEQ ID NO. 129
MEFERDLNLEATELRLGLPGTATQQLEKQTPSSNVTKSNKRSLPDMNEDSAGRSESSSVSSNDKKSDEQETAPPTETRVVGWPPIRSYRKNCLQAKKLEAEAAGLYVKVSMDGAPYLRKIDLKVYKGYPELLEVVEEMFKFKVGEPSEREGYNGSEYVPTYEDKDGDWMLVGDVPWEMFINSCKRLRIMKESEARGLGCAV

SEQ ID NO: 304 - protein, 258 aa, Populus tomentosa
  misc_feature: Public GI ID no.110826446
  misc_feature: Bit score of 318.1 for HMM based on sequences of FIGURE 3.
  misc_feature (16)..(243): Pfam Name: AUX_IAA Pfam Description: AUX/IAA family
  misc_feature: Functional Homolog Of Ceres SEEDLINE ID no. ME09503 at SEQ ID NO. 129
MTSVMGAEPAGTYSMMNFEETELRLGLPGGVSNGNDPEAAKSNGKRGQRFSETVDLKLNLSTKDTGKDGSDQEKAAMKEKAVAPRPNDPAKPPSKAQVVGWPPIRSFRKNVMAVQKNSNDEGEKASSSGATGAAFVKVSMDGAPYLRKVDLKLYKSYRELSDALGKMFSSFTIGNCGSQGTKEFMNESKLIDLLNSSEYVPTYEDKDGDWMLVGDVPWGMFVDSCKRLRIMKGSEAIGLAPRAVEKCKNRSWSAFFPG

SEQ ID NO: 305 - DNA, 582 bp, Sorghum bicolor
  misc_feature: Ceres ANNOT ID no.6029073
  misc_feature: Encodes the peptide sequence at SEQ ID NO. 306
atggcggagtgcaaggacagcagcggccggtctccgtcgtcgtccatggatagcagcacgcacccggtgctctccaccacgtcgtcgggctgccggccggcggcgaggagggacgacctcagcaccgacctccagctagggctcagcctgtcgccggcgtcctcgtccctcctggtagcggagagcaagaggagcatcccttctacgccaaggaaccaagtactcccggattggcccccgatcaaaccgttccttagaagcgccttgacagcctcggcacgccgacggagcacattgttcgtgaaggtgtacatggaaggcgttccaatcggtcggaagctggacttgctcttgctggatgggtacgacagcctcctagccaaactccgccacatgttcaaggcctctatcacttatgctgatgttatggagtaccatcaaagagctcctcacgagaaggctgcacatgttctcacctatgaagaccaggatggagactggatgatggttggggatgtaccgtgggagctcttccttggaagtgtaaggaaactgaggattgcaagaacagataaatgctag

SEQ ID NO: 306 - protein, 193 aa, Sorghum bicolor
  misc_feature: Ceres ANNOT ID no.6029073
  misc_feature: Bit score of 81.8 for HMM based on sequences of FIGURE 3.
  misc_feature (99)..(187): Pfam Name: AUX_IAA Pfam Description: AUX/IAA family
  misc_feature: Functional Homolog Of Ceres SEEDLINE ID no. ME09503 at SEQ ID NO. 129
MAECKDSSGRSPSSSMDSSTHPVLSTTSSGCRPAARRDDLSTDLQLGLSLSPASSSLLVAESKRSIPSTPRNQVLPDWPPIKPFLRSALTASARRRSTLFVKVYMEGVPIGRKLDLLLLDGYDSLLAKLRHMFKASITYADVMEYHQRAPHEKAAHVLTYEDQDGDWMMVGDVPWELFLGSVRKLRIARTDKC

SEQ ID NO: 307 - DNA, 600 bp, Sorghum bicolor
  misc_feature: Ceres ANNOT ID no.6011329
  misc_feature: Encodes the peptide sequence at SEQ ID NO. 308
atggagatcgtcgacgccgacaacctgagcgccaccgagctccgcctcggcctgccgggaaccagcagcagcgacgactggcagaagaagccgtcgccctccgtcggggccaagcgcgctctggacgacaccaggagcgaggcctcggggaccagctcgccggccaccgccgcagacctcgacctcgaccacgaccacgacgccgcaccgcctcccaaggcgcaagtcgtcgggtggccgccggtgagggcgtacaggaagaacaccttccaggcggcggcggcggcggccaagaaggccgaccagcagcagcagcagcagggaggagggctgtatgtgaaggtgagcatggacggggcgccgtacctcaggaaggtggacctcagaatgtacaaggggtacagggagctcagggaggcgctggacgccctcttcaccaagtccttctcggccgccgcggcggagggcggcgaccaccagcacgccatcgcgtacgaggacaaggacggcgatctcatgctcgtcggagacgtgccctgggatatgttcatctcctcatgcaagaagctcaggataatgaagggctctgaggccaggtga

SEQ ID NO: 308 - protein, 199 aa, Sorghum bicolor
  misc_feature: Ceres ANNOT ID no.6011329
  misc_feature: Bit score of 304.2 for HMM based on sequences of FIGURE 3.
  misc_feature (8)..(199): Pfam Name: AUX_IAA Pfam Description: AUX/IAA family
  misc_feature: Functional Homolog Of Ceres SEEDLINE ID no. ME09503 at SEQ ID NO. 129
MEIVDADNLSATELRLGLPGTSSSDDWQKKPSPSVGAKRALDDTRSEASGTSSPATAADLDLDHDHDAAPPPKAQVVGWPPVRAYRKNTFQAAAAAAKKADQQQQQQGGGLYVKVSMDGAPYLRKVDLRMYKGYRELREALDALFTKSFSAAAAEGGDHQHAIAYEDKDGDLMLVGDVPWDMFISSCKKLRIMKGSEAR

SEQ ID NO: 309 - DNA, 708 bp, Sorghum bicolor
  misc_feature: Ceres ANNOT ID no.6034498
  misc_feature: Encodes the peptide sequence at SEQ ID NO. 310
atggctggcgccgacgtcgacgtcgggacggagctccggctcggcctgccgggaggaggcgccgaggcggccaaggccgcgaagaggggcttcgaggacaccatcgacctcaagctgaagctgcccaccgccggcatggaggaagctgccgccgccaagccggagccggcagccgagaaggccaagaggcccgccgaggcgccggcagctgatgccgagaagccacctgcacccaaggcacaagctgtgggttggccaccagtccgatcataccgcaggaacgtcatgaccgtccagtctgtgaagagcaagaaggaagaggaacctgagaagcagcagtcggccgctgccaacgccagcggcaacagctccgccttcgtgaaggtcagcatggacggcgcgccctacctgcgcaaggtggacctgaagatgtacaacagctacaaggacctctctattgctctgaagaagatgttcagcaccttcaccacatctgggaacaacatgaatgaggggaaattggttgatccagtcagcggtgctgatgtggtcactacttacgaagacaaggacggcgactggatgcttgttggtgacgtcccatgggagatgtttgtcgagtcatgcaagcgtctgaggatcatgaagagttctgaagccataggtcttgcaccaagaacgaaggacaagtgcaagaacaagagctga

SEQ ID NO: 310 - protein, 235 aa, Sorghum bicolor
  misc_feature: Ceres ANNOT ID no.6034498
  misc_feature: Bit score of 286.8 for HMM based on sequences of FIGURE 3.
  misc_feature (10)..(227): Pfam Name: AUX_IAA Pfam Description: AUX/IAA family
  misc_feature: Functional Homolog Of Ceres SEEDLINE ID no. ME09503 at SEQ ID NO. 129
MAGADVDVGTELRLGLPGGGAEAAKAAKRGFEDTIDLKLKLPTAGMEEAAAAKPEPAAEKAKRPAEAPAADAEKPPAPKAQAVGWPPVRSYRRNVMTVQSVKSKKEEEPEKQQSAAANASGNSSAFVKVSMDGAPYLRKVDLKMYNSYKDLSIALKKMFSTFTTSGNNMNEGKLVDPVSGADVVTTYEDKDGDWMLVGDVPWEMFVESCKRLRIMKSSEAIGLAPRTKDKCKNKS

SEQ ID NO: 311 - DNA, 795 bp, Sorghum bicolor
  misc_feature: Ceres ANNOT ID no.6095057
  misc_feature: Encodes the peptide sequence at SEQ ID NO. 312
atggcgggcctcgggttcgaggagaccgagctccggctcggcctgcccggcggcaacgacgccggggatgccgcggcggcgaggaagcggggtttcgaggagaccatcgacctcaagctgaagctggagcagccggcggcgccgcacttggagaaggaggaggaggctggcgctggcgacgccgtcgcccccggcgcggtcccactgtcgtcgcctccagcagccagcaccgccggcgcaggtacggccatgaagaggtcgccgagccagagcagcgtggtcaccgccgacgcgccgccggaccccgaaaagcctcgcgcccccaaggcacaggcggtgggctggccgcccgtccggtcgttccgcaagagcatcctggccgtccaatcccagagaagtggaggcgacgacaaggtcaacggcggcaagacgtcaccggcgttcgtgaaggtgagcatggacggcgcgccgtacctgcgcaaggtggacctgaggacgtacgggagctaccaggagctgtccaaggcgctccagaagatgttcagctccttcaccatcggcagctgcgggccgcaggggatgatgaacgaggagacgaagctgcaggcggacctagtgagcggctccgacgactacttgcccacgtacgaggacaaggacggcgactggatgctcgtcggcgacgtcccctgggagatgttcgtggagtcgtgcaagcgcctccggatcatgaaaggatcggaagccgtcggcctcgcacccagggcgatggacaagtgcaacaacagctgctga

SEQ ID NO: 312 - protein, 264 aa, Sorghum bicolor
  misc_feature: Ceres ANNOT ID no.6095057
  misc_feature: Bit score of 257.3 for HMM based on sequences of FIGURE 3.
  misc_feature (4)..(256): Pfam Name: AUX_IAA Pfam Description: AUX/IAA family
  misc_feature: Functional Homolog Of Ceres SEEDLINE ID no. ME09503 at SEQ ID NO. 129
MAGLGFEETELRLGLPGGNDAGDAAAARKRGFEETIDLKLKLEQPAAPHLEKEEEAGAGDAVAPGAVPLSSPPAASTAGAGTAMKRSPSQSSVVTADAPPDPEKPRAPKAQAVGWPPVRSFRKSILAVQSQRSGGDDKVNGGKTSPAFVKVSMDGAPYLRKVDLRTYGSYQELSKALQKMFSSFTIGSCGPQGMMNEETKLQADLVSGSDDYLPTYEDKDGDWMLVGDVPWEMFVESCKRLRIMKGSEAVGLAPRAMDKCNNSC

SEQ ID NO: 313 - DNA, 681 bp, Sorghum bicolor
  misc_feature: Ceres ANNOT ID no.6095058
  misc_feature: Encodes the peptide sequence at SEQ ID NO. 314
atggaaaccaccgttgtgggagacctcatggcgaccgagctgaggcttggactgccgggcaccgtcgacgacagctgcagcctgcagagccaggtgaaggcgacgacgcctaggggcaagaagcgcgccaccaccgatgccgccgtggaggacgccgccgccgccgaggaggcaacaaacaagcgtgacgacgccgaggcagcacccccagcagccaaggcgcccgtggtcggttggccgccggtgaggtcgtaccggaagagctgcttccagcaggcgatcagcagcaagcagcaggtcagcaagcaggcggccaaagatgaggcggcggcggcgtcgcccagctgcacggcgccatccgtagccgccgcgaacaccaccgccagcgtcggcggcggctcgttcgtcaaagtgagcatggacggcgccccgtacctgaggaaggtggacctgaggatgtacaagggctacagggagctccgggaggccctggaggccatgttcgtctcctccaacagcggcagcgccaacctgtccgagttcgccgtcacctacgaggacaaggacggcgacctcatgctcgtcggagacgtgccgttcgagatgttcactagcacttgcaagaagctgaggatcatgaagagatctgaagccacaggcctgggatcagcgaggcaatga

SEQ ID NO: 314 - protein, 226 aa, Sorghum bicolor
  misc_feature: Ceres ANNOT ID no.6095058
  misc_feature: Bit score of 287.0 for HMM based on sequences of FIGURE 3.
  misc_feature (8)..(225): Pfam Name: AUX_IAA Pfam Description: AUX/IAA family
  misc_feature: Functional Homolog Of Ceres SEEDLINE ID no. ME09503 at SEQ ID NO. 129
METTVVGDLMATELRLGLPGTVDDSCSLQSQVKATTPRGKKRATTDAAVEDAAAAEEATNKRDDAEAAPPAAKAPVVGWPPVRSYRKSCFQQAISSKQQVSKQAAKDEAAAASPSCTAPSVAAANTTASVGGGSFVKVSMDGAPYLRKVDLRMYKGYRELREALEAMFVSSNSGSANLSEFAVTYEDKDGDLMLVGDVPFEMFTSTCKKLRIMKRSEATGLGSARQ

SEQ ID NO: 315 - DNA, 2123 bp, Arabidopsis thaliana
  misc_feature: Ceres SEEDLINE ID no.ME10007
  misc_feature: Genomic Sequence
  misc_feature: Expected Sequence
  misc_feature: Encodes the peptide sequence at SEQ ID NO. 317
atggcgcttgagaatttctacaatggtaaattatggctttgttgtttgcatatgttcctttataccaagttgtatatgctttacaggtgtgatttggtttttctacagagcataagtatccgactgaagaaatgaagggcaagttagcagaggaagttggattaactgagaagcaagtttcaggttggttctgccatagaaggttaaaagacaaacgtcatgtaaaagaagatgggaatgccattgggagccaagatcggtcaagcgttgttcttcaggatcgtggaagtgggcttcgacaggattcatgtggtagtacaaagcaaacggattattggaaccccaagcctagggaagttgaaagtcaaaggctttatatgggaaatgctgatggtgaagatagtacatcttctgatcgtagctcatcattacgtaagaatcttgtctctagcaaagatggaattcgcgatgtggaaagttctagatatgttgcacataaagacgttattcagcatcctcagttcatgagaagctatgggtataataagccttcgggatacttgaaagtgaagggagagagtgagaattttgctatcactgccgtaaagagacaattaggaagacaataccaagaggatggtccacctctgggggttgaatttgatcctcttcctcccggtgcatttgagcctcagactaatcctatagttcacggtgagtcatgataaaatgtttcaactttacctttaattttctggtttatgatgttatgagtattgagtaagtggctcagagaagctaaaaccatcttcttcgtgtgtcagattgtgaatgcctttacccatgtccagtcggatttgattgctttttctatcaactgttttgtcagagccaatatatgttgggaatcagagacggcctcaccttccacatttacttggaacgaggaagagctttaatcctggtcctgtaagtgaacattttctgtatactacatacccatgaagataatataaactagaatcttagtctgccatcacattctttggctaaattatcttactttctttgaagtattattaatattttcgttttctgtcttaatgtctttatagagctatgaattagctcgtaaatcaaagttgcattcgccagatccagattcagaggatgatgagcatgatgatgatgacaacataatggttggaatggagcctggtctaagagataagaaaagttttggggaaccaagactgaaatccccttctaccagtttctataattctgtacctcgccacaaatcgtttaaagagacattcaaaggttcaccacgggaaatccctgtaactaacagcaagaagggttggataagttccaaaagttgggctgaagggtcgagaaaccatctggttgccaacgtccaaaatctttctggaagcaatattgaaaccaatcagtctcatgattatgataataatatatctaatggcggacgcaagacgggatatctcactaaatcttcgaagctgttacctccgagtagaagcagatcccctgagtcaatggatagaggtccatcttctgggatggtaaagatttgtctaatacttccatgtctacatgttcctttcttgcccttttatggaaatatgacttgtgttttgtgtgatatcttcttttaaaggcaggaatatatcacggggagaggaatcaaatgaaaatgcagagagagaaattgcattcgactgatgaaccaccggtgagtttgatggttaactatcttaaaaatatagatattgatgtatattttaacaaagtttagaggctctatcaagttcgtgttctgacctttaacgaatgttaataggttgccaaacgagtgaaacatgggtatattcagcaagtatatgcaccaaaatcatcatcatacagcgagattcttgaacgaaaaagccagataaatcggttagtaaccaaccattgtgtaatgcatttattgtcccaaagagatatcaaatcggcttattggatcatactgttatgtttgtaggtctggtgtggaactgccttctagtttaagcggggacgatgagactgacgaatctagctcgtcaatggattaa

SEQ ID NO: 316 - DNA, 1431 bp, Arabidopsis thaliana
  misc_feature: Ceres SEEDLINE ID no.ME10007
  misc_feature: Predicted Sequence
  misc_feature: Expected Sequence
  misc_feature: Encodes the peptide sequence at SEQ ID NO. 317
atggcgcttgagaatttctacaatgagcataagtatccgactgaagaaatgaagggcaagttagcagaggaagttggattaactgagaagcaagtttcaggttggttctgccatagaaggttaaaagacaaacgtcatgtaaaagaagatgggaatgccattgggagccaagatcggtcaagcgttgttcttcaggatcgtggaagtgggcttcgacaggattcatgtggtagtacaaagcaaacggattattggaaccccaagcctagggaagttgaaagtcaaaggctttatatgggaaatgctgatggtgaagatagtacatcttctgatcgtagctcatcattacgtaagaatcttgtctctagcaaagatggaattcgcgatgtggaaagttctagatatgttgcacataaagacgttattcagcatcctcagttcatgagaagctatgggtataataagccttcgggatacttgaaagtgaagggagagagtgagaattttgctatcactgccgtaaagagacaattaggaagacaataccaagaggatggtccacctctgggggttgaatttgatcctcttcctcccggtgcatttgagcctcagactaatcctatagttcacgagccaatatatgttgggaatcagagacggcctcaccttccacatttacttggaacgaggaagagctttaatcctggtcctagctatgaattagctcgtaaatcaaagttgcattcgccagatccagattcagaggatgatgagcatgatgatgatgacaacataatggttggaatggagcctggtctaagagataagaaaagttttggggaaccaagactgaaatccccttctaccagtttctataattctgtacctcgccacaaatcgtttaaagagacattcaaaggttcaccacgggaaatccctgtaactaacagcaagaagggttggataagttccaaaagttgggctgaagggtcgagaaaccatctggttgccaacgtccaaaatctttctggaagcaatattgaaaccaatcagtctcatgattatgataataatatatctaatggcggacgcaagacgggatatctcactaaatcttcgaagctgttacctccgagtagaagcagatcccctgagtcaatggatagaggtccatcttctgggatggcaggaatatatcacggggagaggaatcaaatgaaaatgcagagagagaaattgcattcgactgatgaaccaccggttgccaaacgagtgaaacatgggtatattcagcaagtatatgcaccaaaatcatcatcatacagcgagattcttgaacgaaaaagccagataaatcggtctggtgtggaactgccttctagtttaagcggggacgatgagactgacgaatctagctcgtcaatggattaa

SEQ ID NO: 317 - protein, 476 aa, Arabidopsis thaliana
  misc_feature: Ceres SEEDLINE ID no.ME10007
  misc_feature: Bit score of 1066.1 for HMM based on sequences of FIGURE 4.
  misc_feature (1)..(45): Pfam Name: Homeobox Pfam Description: Homeobox domain
MALENFYNEHKYPTEEMKGKLAEEVGLTEKQVSGWFCHRRLKDKRHVKEDGNAIGSQDRSSVVLQDRGSGLRQDSCGSTKQTDYWNPKPREVESQRLYMGNADGEDSTSSDRSSSLRKNLVSSKDGIRDVESSRYVAHKDVIQHPQFMRSYGYNKPSGYLKVKGESENFAITAVKRQLGRQYQEDGPPLGVEFDPLPPGAFEPQTNPIVHEPIYVGNQRRPHLPHLLGTRKSFNPGPSYELARKSKLHSPDPDSEDDEHDDDDNIMVGMEPGLRDKKSFGEPRLKSPSTSFYNSVPRHKSFKETFKGSPREIPVTNSKKGWISSKSWAEGSRNHLVANVQNLSGSNIETNQSHDYDNNISNGGRKTGYLTKSSKLLPPSRSRSPESMDRGPSSGMAGIYHGERNQMKMQREKLHSTDEPPVAKRVKHGYIQQVYAPKSSSYSEILERKSQINRSGVELPSSLSGDDETDESSSSMD

SEQ ID NO: 318 - DNA, 655 bp, Gossypium hirsutum
  misc_feature: Ceres CLONE ID no.1842125
  misc_feature: Encodes the peptide sequence at SEQ ID NO. 319
aaaaattttatgctcctttgaatttttttttttggatctgcttcaatggaggctggttcagaaggtgagaataatcggatcagcaatccgaataagaacattagtagttccaatgaaggtaacgctaagcctaaacgacagatgaagactccgtttcaactcgaagctctggagaaagcttatgctctggagacttatccatcggaagcgacgcgagcggaattatcggagaaattgggattatcggatcggcagttacagatgtggttttgtcaccggagattgaaagaaaagaaggataatcctacgaaaaaacagcgaaaaggtgctgctttaccaccggaatctccggtcgatgagttgcgggccgtgccaggtccggattatggatcggggtcaggttcggggtccagtccgtatatggacacaaggaagttggggggaagctcttctcggggaatgatggaggatgcgccgacagttaggaggtattatgagtcacagcagtcaataatggagctccgagcaattgcttgtgtggaggcacagttgggggagccattgcgagatgatggacctatgctcggcattgagttcgatccattgcctcccgatgctttcggagcaattcctgaaccacataataggactggac

SEQ ID NO: 319 - protein, 203 aa, Gossypium hirsutum
  misc_feature: Ceres CLONE ID no.1842125
  misc_feature: Bit score of 268.3 for HMM based on sequences of FIGURE 4.
  misc_feature (28)..(84): Pfam Name: Homeobox Pfam Description: Homeobox domain
  misc_feature: Functional Homolog Of Ceres SEEDLINE ID no. ME10007 at SEQ ID NO. 317
MEAGSEGENNRISNPNKNISSSNEGNAKPKRQMKTPFQLEALEKAYALETYPSEATRAELSEKLGLSDRQLQMWFCHRRLKEKKDNPTKKQRKGAALPPESPVDELRAVPGPDYGSGSGSGSSPYMDTRKLGGSSSRGMMEDAPTVRRYYESQQSIMELRAIACVEAQLGEPLRDDGPMLGIEFDPLPPDAFGAIPEPHNRTG

SEQ ID NO: 320 - DNA, 1980 bp, Populus balsamifera subsp. trichocarpa
  misc_feature: Ceres ANNOT ID no.1461360
  misc_feature: Encodes the peptide sequence at SEQ ID NO. 321
atggaagaatcaagtgaagtgcattttggagagaatagagtttctccagagaagaatttgaaaaggacagtcaagacaccagcccaggttgtcgctttggagaacttttataatgagcacaaatatcccacagaggaaatgaaatcagaacttgcagaccaaatagggttgacagaaaagcaaatatctagctggttttgccacagaaggctaaaagacaaaagattgagagatgaagtatgcactaatggacgacaagatcgatctagcggtattattcaggatcgagggagtgggttgaggcaagattcatgtggcagtaccaaacaaggtgattataggaatcttgatccaagggaagttgagagccagagactttatggtcgagattttcatcctgctgatctaacctatgaccgcacgagtcgctatacagggaatgttaccggcattgataatatatcttcaggaagtagctcatcgttgcaagataagtttgtttgtcaaagagaggatccttatgacgcagaaacctcaaagtacctagcacagaatggagctgccatgccattaattcccaagggtactgatagttttgggtataaaccatcaggatatttgaaagtgaagggtgaaattgagaatgctgctattactgctgtcaagatgcaattgggcaggcattataaggaggatggtccaccactaggtgttgaattccagccacttcctcctggtgcttttgcatccccaagtagagatccagtcagtggaccaatctatgtgggagatcttgctcagatgtgttctcctgatgtttctggggttcgaaagcaatccagtcttggcgcttttgaggctcaagttctgctggtccatgctggaaacctttatatcctccagctctccatcacttccaatgatgtctgccatcccatgtttatcaccactgtgactttcactttacttttattgccaatataccaccaatcatgcaccggcaccaccagcaattatgctcacaacatgtttccttcctcatttcggtatgttccaaagaaaggttcagttagacctgaaaatgttatggaacagggtatttttttatatgattcctcagactccattccaccatcttccatatcttgtacttcaaatgagtccctatatatactcgcagtgagatatgaagtatatagcaccaagatgagttctcatgattcatatacagagggagcaaattgtaatcccgagccctctgattctcatgatagaaaatctcatcaccatctagaacagaagcctacctataatggttccaattctaatgctggtgggaactctgccatggatatgcccgatgatcttgctggtgaaacatcagcctatgtaaacaaaagacattataggatgagctctaagcatggttttgaggagagaagatcggattctctttcaacccatcttggtcccagtggtaggagagttaatagtgaaaagacagaagcttggttgcatgactgtgataatgacaatcctaagatagttcaaaggaataattacacgtctaagcatccgcacttgatgcgtggatctggaaaatctcttgatacagaggagagagcacggtgtacgatcatggaaaaggaggacaaacttcatggagaaatgaaaagaatgaaaggctctcacgacccagttagagtaaagaggcatccaacggatgaaacaactgttgcaaaaagattcagagttgactttccacagcaagaacatgtggcaaaagcatcgttttctgaaatacgtcgaaggacaaatctgactaaacggttgaatccagagaacatggccacgggcattgctttcactgaagttgtaggagcattggatgtgccaatagacattgggaggtctgccatggagaggccatctagtttcagcgaggatgaaactccagaaaccagttcttcggcagaatga

SEQ ID NO: 321 - protein, 659 aa, Populus balsamifera subsp. trichocarpa
  misc_feature: Ceres ANNOT ID no.1461360
  misc_feature: Bit score of 1758.4 for HMM based on sequences of FIGURE 4.
  misc_feature (19)..(75): Pfam Name: Homeobox Pfam Description: Homeobox domain
  misc_feature: Functional Homolog Of Ceres SEEDLINE ID no. ME10007 at SEQ ID NO. 317
MEESSEVHFGENRVSPEKNLKRTVKTPAQVVALENFYNEHKYPTEEMKSELADQIGLTEKQISSWFCHRRLKDKRLRDEVCTNGRQDRSSGIIQDRGSGLRQDSCGSTKQGDYRNLDPREVESQRLYGRDFHPADLTYDRTSRYTGNVTGIDNISSGSSSSLQDKFVCQREDPYDAETSKYLAQNGAAMPLIPKGTDSFGYKPSGYLKVKGEIENAAITAVKMQLGRHYKEDGPPLGVEFQPLPPGAFASPSRDPVSGPIYVGDLAQMCSPDVSGVRKQSSLGAFEAQVLLVHAGNLYILQLSITSNDVCHPMFITTVTFTLLLLPIYHQSCTGTTSNYAHNMFPSSFRYVPKKGSVRPENVMEQGIFLYDSSDSIPPSSISCTSNESLYILAVRYEVYSTKMSSHDSYTEGANCNPEPSDSHDRKSHHHLEQKPTYNGSNSNAGGNSAMDMPDDLAGETSAYVNKRHYRMSSKHGFEERRSDSLSTHLGPSGRRVNSEKTEAWLHDCDNDNPKIVQRNNYTSKHPHLMRGSGKSLDTEERARCTIMEKEDKLHGEMKRMKGSHDPVRVKRHPTDETTVAKRFRVDFPQQEHVAKASFSEIRRRTNLTKRLNPENMATGIAFTEVVGALDVPIDIGRSAMERPSSFSEDETPETSSSAE

SEQ ID NO: 322 - DNA, 1569 bp, Populus balsamifera subsp. trichocarpa
  misc_feature: Ceres ANNOT ID no.1440334
  misc_feature: Encodes the peptide sequence at SEQ ID NO. 323
atgaaatcagaacttgcagaccgaattgggttgacagaaaagcaaatatctagctggttttgccacagaaggttaaaagacaaaagattgaaggatgaaggatacactaatggacgacaagatcggtctagcagtattcttcatgatcgtggtagtggattgaggcaagattcatgtggcagtactaaacaaggtgattataggaatatcgatccaagggaagttgaaagccagagactttatggtcaagattttcatactgctgatctaacgtatgaccgtacaagtcgctatacagggaatgttagcggcattgatgatatatcttcaggaagtagctcatcgttgcaagataagtttgtttctcaaagagaggatccttatgatacagaaacctcgaagtacctagcacagaatggagcttccatgccattaattcccaagggtgctgagagttttgggtataaaccatcaggatatttgaaagtgaagggcgaaattgagaatgctgctattaccgctgtcaagatgcaattgggcaggcattataaggaggatggtccacctcttggtgttgacttccagtcactccctcctagtgcatttgcatccccaagtagagatccagtcaatggaccaatctatgtaggagatcttgttgggatgcgttctcctgatgtttctggagttcgaaagcaacccagtctcagtggttttgaggctcaagttctgcaggcccatgctggaaacctctttgtcctccacctctccattattcccaaagagattgccatcccttgttcaacaccattgtggctttcactttacttttgctgccattttgccaccaaccatgcaccaccagcaattatgcttgcaacatatttccttcctcattttggtatgttccaaagaaaaggttcaagatatgaagtatatagcaccaagatgagttctcatgattcatatacggagggagcaaattgtaatcccgagcatggatccgattctcatgagagaaaatcccgtcaccatctagaacagaagtctacctataatgtttccaattctaatgcaggcgggaactctaccatggatatgcctgatgatcttgctgttgaaacgtcagtctatagaagcaaaagaaattataggacgagctctaagcatgattttgaagggagaagatcagattcttttgcaacccatcatggccctcgtggtaggagagaaaagacagaagcttggttgcatgattgtgataatgacaatcctaagatagctcgaaggaatgactacatgtctaagccttcacactcgattcttggacctggaaaatctcttgttacagaggagagagcaccatttacaaagacggaaaaggaggaaaagctttatggagaaatgaagagaatgaaaggctcgcatgattcagttagagtaaagaggcatccgagagatgaaacagctgttgcaaaaagattcagagctgactttccacgtcaagaacatgtgacaaaagcatcagtttctggtatgcgccgaagaacaaatctgactgaagggtag

SEQ ID NO: 323 - protein, 522 aa, Populus balsamifera subsp. trichocarpa
  misc_feature: Ceres ANNOT ID no.1440334
  misc_feature: Bit score of 847.2 for HMM based on sequences of FIGURE 4.
  misc_feature (1)..(29): Pfam Name: Homeobox Pfam Description: Homeobox domain
  misc_feature: Functional Homolog Of Ceres SEEDLINE ID no. ME10007 at SEQ ID NO. 317
MKSELADRIGLTEKQISSWFCHRRLKDKRLKDEGYTNGRQDRSSSILHDRGSGLRQDSCGSTKQGDYRNIDPREVESQRLYGQDFHTADLTYDRTSRYTGNVSGIDDISSGSSSSLQDKFVSQREDPYDTETSKYLAQNGASMPLIPKGAESFGYKPSGYLKVKGEIENAAITAVKMQLGRHYKEDGPPLGVDFQSLPPSAFASPSRDPVNGPIYVGDLVGMRSPDVSGVRKQPSLSGFEAQVLQAHAGNLFVLHLSIIPKEIAIPCSTPLWLSLYFCCHFATNHAPPAIMLATYFLPHFGMFQRKGSRYEVYSTKMSSHDSYTEGANCNPEHGSDSHERKSRHHLEQKSTYNVSNSNAGGNSTMDMPDDLAVETSVYRSKRNYRTSSKHDFEGRRSDSFATHHGPRGRREKTEAWLHDCDNDNPKIARRNDYMSKPSHSILGPGKSLVTEERAPFTKTEKEEKLYGEMKRMKGSHDSVRVKRHPRDETAVAKRFRADFPRQEHVTKASVSGMRRRTNLTEG

SEQ ID NO: 324 - DNA, 1563 bp, Populus balsamifera subsp. trichocarpa
  misc_feature: Ceres ANNOT ID no.1493205
  misc_feature: Encodes the peptide sequence at SEQ ID NO. 325
atgaaatcagaacttgcagaccgaattgggttgacagaaaagcaaatatctagctggttttgccacagaaggttaaaagacaaaagattgaaggatgaaggatacactaatggacgacaagatcggtctagcagtattcttcatgatcgtggtagtggattgaggcaagattcatgtggcagtactaaacaaggtgattataggaatatcgatccaagggaagttgaaagccagagactttatggtcaagattttcatactgctgatctaacgtatgaccgtacaagtcgctatacagggaatgttagcggcattgatgatatatcttcaggaagtagctcatcgttgcaagataagtttgtttctcaaagagaggatccttatgatacagaaacctcgaagtacctagcacagaatggagcttccatgccattaattcccaagggtgctgagagttttgggtataaaccatcaggatatttgaaagtgaagggcgaaattgagaatgctgctattaccgctgtcaagatgcaattgggcaggcattataaggaggatggtccacctcttggtgttgacttccagtcactccctcctagtgcatttgcatccccaagtagagatccagtcaatggaccaatctatgtaggagatcttgttgggatgcgttctcctgatgtttctggagttcgaaagcaacccagtctcagtggtgcccatgctggaaacctctttgtcctccacctctccattattcccaaagagattgccatcccttgttcaacaccattgtggctttcactttacttttgctgccattttgccaccaaccatgcaccaccagcaattatgcttgcaacatatttccttcctcattttggtatgttccaaagaaaaggttcaagatatgaagtatatagcaccaagatgagttctcatgattcatatacggagggagcaaattgtaatcccgagcatggatccgattctcatgagagaaaatcccgtcaccatctagaacagaagtctacctataatgtttccaattctaatgcaggcgggaactctaccatggatatgcctgatgatcttgctgttgaaacgtcagtctatagaagcaaaagaaattataggacgagctctaagcatgattttgaagggagaagatcagattcttttgcaacccatcatggccctcgtggtaggagagaaaagacagaagcttggttgcatgattgtgataatgacaatcctaagatagctcgaaggaatgactacatgtctaagccttcacactcgattcttggacctggaaaatctcttgttacagaggagagagcaccatttacaaagacggaaaaggaggaaaagctttatggagaaatgaagagaatgaaaggctcgcatgattcagttagagtaaagaggcatccgagagatgaaacagctgctacagagcttatagcattcttcatgctttgtgtattttgcaggtctgtcatggagaggccatctagtttcagcgaggatgaaactgcagaaaccatttcttcagcagaatga

SEQ ID NO: 325 - protein, 520 aa, Populus balsamifera subsp. trichocarpa
  misc_feature: Ceres ANNOT ID no.1493205
  misc_feature: Bit score of 821.1 for HMM based on sequences of FIGURE 4.
  misc_feature (1)..(29): Pfam Name: Homeobox Pfam Description: Homeobox domain
  misc_feature: Functional Homolog Of Ceres SEEDLINE ID no. ME10007 at SEQ ID NO. 317
MKSELADRIGLTEKQISSWFCHRRLKDKRLKDEGYTNGRQDRSSSILHDRGSGLRQDSCGSTKQGDYRNIDPREVESQRLYGQDFHTADLTYDRTSRYTGNVSGIDDISSGSSSSLQDKFVSQREDPYDTETSKYLAQNGASMPLIPKGAESFGYKPSGYLKVKGEIENAAITAVKMQLGRHYKEDGPPLGVDFQSLPPSAFASPSRDPVNGPIYVGDLVGMRSPDVSGVRKQPSLSGAHAGNLFVLHLSIIPKEIAIPCSTPLWLSLYFCCHFATNHAPPAIMLATYFLPHFGMFQRKGSRYEVYSTKMSSHDSYTEGANCNPEHGSDSHERKSRHHLEQKSTYNVSNSNAGGNSTMDMPDDLAVETSVYRSKRNYRTSSKHDFEGRRSDSFATHHGPRGRREKTEAWLHDCDNDNPKIARRNDYMSKPSHSILGPGKSLVTEERAPFTKTEKEEKLYGEMKRMKGSHDSVRVKRHPRDETAATELIAFFMLCVFCRSVMERPSSFSEDETAETISSAE

SEQ ID NO: 326 - DNA, 1979 bp, Glycine max
  misc_feature: Ceres CLONE ID no.480906
  misc_feature: Encodes the peptide sequence at SEQ ID NO. 327
attctggaaaaaataaagcacagtaaaattcaattcaacaattaaaaaagataaaaaaaaaaaattgatttccctgttcaatcagaaggtaaaaaaaaaataaaaatgtgaaaggtgatcggaggaagaagcaaatgaaataaaaaagagagagattgttcttctgtctctattggctttcaactttccccagaagttactttctctctttcttttctctaagatgaattaagggtctaaatgaatgaatcgcacatacccactgttaattttgcattttctcttggtttgggtcaaatgggtctcatttttctgagaagccagtgaaaaaagcttgcactttgactccaaaacttgcagagaagagggagattcaccacaattcctcacaaccatggaagaagtaactgagttgcagtctgaagaaaataaattgtctatggagaaaaataagaaaagaaggctcaaaacaccagcccagcttaaggccttggaagatttttataatgataacaaatatcccacggaggaaatgaaatcagaacttgccgatgagttagaattgacagaaaagcaaatatctggatggttttgccacagaagattgaaagataaaaaaatgttgaatgatgaagtatgtgctaatggacgacaagatcgttcaagtggtgtcattcaggatcgtggcagtggtctagtgcaggattcatgcggaagcactaaacatgttcactataggtatctggatcccaaagaggttgagagtcatggcctctataaccatggattttcagctgcagatataacctatggacacaaaaaccatcgttatgcagaaaatgatagtgcaacagataacacatcatctgagagtagctcatctttgcaagatcgattgctttgtcaaggacaggatccgtatgatatggagccttctagtcatgtaacacctaatggatctcttctgcctcccaataccaagggtgcaaataacatgggacataaaccatcaggatatttgaaagtgaagggagagatagagcatgctgctattactgctgttaaaaagcaattaggaaagcattatcgggaagatggtccactacttagtgttgaatttgatacaattcctcctgaggcatttgaatgtcaaattgcagatctagctaatgaagcatactatgctgcaaatcctgctcttccaaattctccagaagtctctgcagtgaaaaaacagtccagtctcagttctagatatgattcatattttaccaaaatcagttcccaagattcacaaatggtcagagactctactggggaagcatctgcttataataacactaaaaattgtagaaagggtactaagcatggttttgatgggacgagatatgactctggttctaaccccagtgatcactatgaagagaataacctagtggttaaccagacagattctctgctacatggctatgaaaacagcaacctgaagaatgtacaaaggggtgaatatgcgaaatctaaaccttcaaattcagtacataagtctcaagtttacttggatactggagaaagaagagggcttaataaaaggatggcaaaggaagagaagtttgatggggatagaaagataaaaaaacaatatcgtgatccagatgaagttagggtgcttacaaatgaaatgacggttgcaaagtgggctaaagttgatccacttgaacaatatgatgttaaacaatcatctgttgctgagttggaaccaagaaaaagtcaaaggtctgctgcagagatgccatctagctttagtgaggatgaaactgctgaaaccagttcctcagcggattaagtgttgttgtcagattccacagatatgatatttatagggtttctctatgccattggttttgtacagtctagagagacagatccattttgcacagtaacatctagaaagacacactaacatgactaacttgatttgc

SEQ ID NO: 327 - protein, 482 aa, Glycine max
  misc_feature: Ceres CLONE ID no.480906
  misc_feature: Bit score of 1171.6 for HMM based on sequences of FIGURE 4.
  misc_feature (19)..(75): Pfam Name: Homeobox Pfam Description: Homeobox domain
  misc_feature: Functional Homolog Of Ceres SEEDLINE ID no. ME10007 at SEQ ID NO. 317
MEEVTELQSEENKLSMEKNKKRRLKTPAQLKALEDFYNDNKYPTEEMKSELADELELTEKQISGWFCHRRLKDKKMLNDEVCANGRQDRSSGVIQDRGSGLVQDSCGSTKHVHYRYLDPKEVESHGLYNHGFSAADITYGHKNHRYAENDSATDNTSSESSSSLQDRLLCQGQDPYDMEPSSHVTPNGSLLPPNTKGANNMGHKPSGYLKVKGEIEHAAITAVKKQLGKHYREDGPLLSVEFDTIPPEAFECQIADLANEAYYAANPALPNSPEVSAVKKQSSLSSRYDSYFTKISSQDSQMVRDSTGEASAYNNTKNCRKGTKHGFDGTRYDSGSNPSDHYEENNLVVNQTDSLLHGYENSNLKNVQRGEYAKSKPSNSVHKSQVYLDTGERRGLNKRMAKEEKFDGDRKIKKQYRDPDEVRVLTNEMTVAKWAKVDPLEQYDVKQSSVAELEPRKSQRSAAEMPSSFSEDETAETSSSAD

SEQ ID NO: 328 - DNA, 1288 bp, Glycine max
  misc_feature: Ceres CLONE ID no.482271
  misc_feature: Encodes the peptide sequence at SEQ ID NO. 329
aggttttctcaaggtcaggatccgtatgatatggagccttctagacatcttacacctaatggagctcttccacccctaaatcccaaaggtgcagttaagatggggcacaaaccatcaggatatttgaaagtgaagggcgagatagagcatgctgctataactgctgttagaaagcaattaggaaggcattatctggaagatggtccactacttggtatagaattcgatccacttcctccaggggcatttgaatgccaaactgcagatacagctaatgaaccgtactctgttgcaaatcctctgctttcgaattctccagaaatctttgctgcaaaaagacaacccagtcttagctctgataaacaagataagaaagcatgtcagaacataaaacaaaggcaatctttatacggttataccaataattttcctggaaggaacactttcccagatttgtatgaagactctactggagaagcatctgcttataatagcaataagagtcatagaatgagcactaaacatggtgttgaggggatgcgatctgattctgcttctaaccatagtgatcactatgaagagaagcttacagttaagcagaaaaccttgatgctgcatggttatgataacatcaatccaaagaatatacaaaggagtgaacatgtaaaatctaaaccttctagttcaatccataattcccgtgttcctatggatactgaagaacgggggttatctgctaggatggcaaaggaagagatgtttaaggggaacaggaaagcaaaaaatacatactgcgatgtagagggagcagggatgctttcaaatgaaatcatggttgcaaaacgagctaaagttgacatgcttcaacaatacaatgtgaaaaatcacctgttgctgagatggaactaaagaaaattcagagatctgttgcagagatgccttctagctttagcgaggatgaaactgctgacaccagttcctcactggattattaagcgctgttgataaaatggtagcaagtttgtggggtttctctaagccattgggtatgtacagcctaaaaagacatacatttttctctgtaacgtgggaaccattgtttctggcaataatagcagcaactcgctccattgctgttttttgtgctcacctatttgcctttgtaaaagaaaaaaaatacaccccaggttattcttttgatgtaaaatctcatttcctgaagctacttgtggtaggtttaatgcagcttatatacttgtcacttgtcttttattgatttaattatggt

SEQ ID NO: 329 - protein, 292 aa, Glycine max
  misc_feature: Ceres CLONE ID no.482271
  misc_feature: Bit score of 237.7 for HMM based on sequences of FIGURE 4.
  misc_feature (54)..(132): Pfam Name: Homeobox Pfam Description: Homeobox domain
  misc_feature: Functional Homolog Of Ceres SEEDLINE ID no. ME10007 at SEQ ID NO. 317
MEPSRHLTPNGALPPLNPKGAVKMGHKPSGYLKVKGEIEHAAITAVRKQLGRHYLEDGPLLGIEFDPLPPGAFECQTADTANEPYSVANPLLSNSPEIFAAKRQPSLSSDKQDKKACQNIKQRQSLYGYTNNFPGRNTFPDLYEDSTGEASAYNSNKSHRMSTKHGVEGMRSDSASNHSDHYEEKLTVKQKTLMLHGYDNINPKNIQRSEHVKSKPSSSIHNSRVPMDTEERGLSARMAKEEMFKGNRKAKNTYCDVEGAGMLSNEIMVAKRAKVDMLQQYNVKNHLLLRWN

SEQ ID NO: 330 - protein, 544 aa, Medicago truncatula
  misc_feature: Public GI ID no.92889352
  misc_feature: Bit score of 1352.9 for HMM based on sequences of FIGURE 4.
  misc_feature (19)..(75): Pfam Name: Homeobox Pfam Description: Homeobox domain
  misc_feature: Functional Homolog Of Ceres SEEDLINE ID no. ME10007 at SEQ ID NO. 317
MEESSELQPEENKVSAEKFPKRKLKTPAQLKGLEKFYTEHKYPTEELKLAIAEELELTEKQVSGWFCHRRLKDKRLLKEEANANGRQDRSSGVIQDRGSGLGQDSCGSSKHGDYKYLDPKEVESNGLYNRDLSVADMTYGRRNHFSENVSGMDDDTSSESSSYLQERMYPQGQDPYEMEPSRYSKALPPLNPKGAINMGYKPSGYLKVKGEIEHAAITAVKKQLGRNYQEDGPLLGVEFDPLPPGAFECQTEEAVHEPYHIADPALLNSPEISTVKSRPGLSSRYDSYYTKHGSQDTHMEGVDFGSLHDVHVQDKQDKKALHGTKHRQTFQSNAGRFPGRNSSLDLYEDSTGEAAYNITKNHRKDAKRGVEGIRSDSTSNHSDRYEENLPVKHSDFLQYNYENTNQKNVQRSVHADILQYDYDNVNPKKAPRSEHIKSKPSNSIHNSRGSVDTEERGLSSRMTKDELFKGDRKSKKQYRDAGGAGMLSNETMVAKRLKANTFQPYNMKQVPVAEIEPRKTQRSAAEMPSSFSEDETADTSSSLD

SEQ ID NO: 331 - protein, 244 aa, Oryza sativa subsp. japonica
  misc_feature: Public GI ID no.56201850
  misc_feature: Bit score of 363.4 for HMM based on sequences of FIGURE 4.
  misc_feature (54)..(103): Pfam Name: Homeobox Pfam Description: Homeobox domain
  misc_feature: Functional Homolog Of Ceres SEEDLINE ID no. ME10007 at SEQ ID NO. 317
MDDGDGAAPAEGSAASTPPPAPPAAAAAAAAAVSAGSTGASGSGEKTVKRMMKSPYQLEVLEKTYAVEQYPSETLRAELSAKIGLSDRQLQMWFCHRRLKDRKPPTKRQRREEEAAAVPLMAPPPVLPPPALPLSSGELLIGASSPYDEPPLPPVHSRRGAGRSSAVPRLSAPDIGRRYYEPLPVMLPPPPVASMQLMPSELRVIHSVESQLGEPLRDDGPVLGIDFDPLPPGSFGAPIVVEIK

SEQ ID NO: 332 - protein, 244 aa, Oryza sativa subsp. japonica
  misc_feature: Public GI ID no.125571531
  misc_feature: Bit score of 358.0 for HMM based on sequences of FIGURE 4.
  misc_feature (54)..(103): Pfam Name: Homeobox Pfam Description: Homeobox domain
  misc_feature: Functional Homolog Of Ceres SEEDLINE ID no. ME10007 at SEQ ID NO. 317
MDDGDGASPAEGSAASTPPPAPPAAAAAAAAAVSAVSTGASGSGEKTVKRMMKSPYQLEVLEKTYAVEQYPSETLRAELSAKIGLSDRQLQMWFCHRRLKDRKPPTKRQRREEEAAAVPLMAPPPVLPPPALPLSSGELLIGASSPYDEPPLPPVHSRRGAGRSSAVPRLSAPDIGRRYYEPLPVMLPPPPVASMQLMPSELRVIHSVESQLGEPLRDDGPVLGIDFDPLPPGSFGAPIVVEIK

SEQ ID NO: 333 - DNA, 4572 bp, Sorghum bicolor
  misc_feature: Ceres ANNOT ID no.6042411
  misc_feature: Encodes the peptide sequence at SEQ ID NO. 334
atggacgccggcggagacggggacggggacggcgccgggaaggcgacgcaggaggcccccgccgaggccacgaccccgcctccggcgccagtggcggccccggtcccggtttcggcctctgcgactggggcgggcgcggggacctcggggtcgggggagaagccggtgaagcggatgatgaaaaccccctaccagcttgaggttttggagaagacctatgcggcggagcagtacccgtcggaagctatgcggctggagctgtcggccaaaatagggctgtcggacaggcagctgcagatgtggttctgccaccgccgcctcaaggatcgcaagccaccgacgaagcggcaacggcgggaggaagagtccgcactagcaccagtgatgcctccaccgccagtgttgccggcacctgtgtctgtgatgccactggcaagcagtgacctcatggtgggtgctcctgggccgtacgatgagccgttacatccagttcactcgcgaaggggtgctgggcggtcctcagcagtccccaggatctccatgccggatattgggaggaggtattacgagccaactccaattatgatagcgccggctatcccgtcgatgcagctcacacaatctgagctccgtgtgattaattctgtggagtcacagcttggggaaccattgagggaggatggtccagcgcttggcgttgaatttgatccccttcctcctggcgcctttggtgcaccgattgttccagagcaacaaaagcagcctgtgcgatcttatgatacaaagatattttctaggcatgatcaaaagctcttaaaggcttcagcatttttacctaccatggaatccccatttgttccaaactcatttactgggaagagaaaatcaacggttggtaatacacctatagttcaacctcatgttggatcacgggctgtccatgagtatcagttccttcctgagcaaccaagtgatacatatgagagggcaagccgatctcattactatgatactccagtggaagtttcaaattctaggatatcttctctcacatcaggatcacagcttctccatggatctgaggcggctgcgcctagttatgcttttcaaggccacacatctggttctagcctgatgccccagcccagcaggtctcaggtgtttccaggagcaccagcagattatgagacgacccagtctaatagcaaccttaattctgttcctgttgaaggccagtttgatatttctcaggttgctgcatttgaaaacccacttgtatcatctgaaagaagagcttatcatgatgaagatacttctcgagtggaaagaaaacgaaaacataatgaagaagcaaagattgcaaaggaagttgaagctcacgaaagacgaattagaaaggagcttgagaaacaagatatcttgaatagaaagagagaggagcaaaggcgcaaggaaatggagagacttgaccgcgagagaagaaaagaagaggagagattactgcgggagagacagagagaagaagagaggttccaaagagagcaaaggcgtgaacatgagcgtatggagaagcttttgcagaagcaatctagacgagcagagaaacaaaggcaaaaggaggaactccgaaaagagaaagaagcagcaaggcaaaaggcggccaatgaaagggctactgcacgcagaattgcacgggagtatatggaactggtggaagatgagcgtttggaactaatggaattagctgcacaaaacaaaggcttgccctcaatgttgcatcttgacagtgacacattgcagcagcttgattcttttcgaggcatgctaagtcaatttcctcctacaacggtgagactgaagttgccattttctataaagccttggactggatctgaggataatgttggaaagcttttgatggtgtggaaattcttcattacttttactgatgttctgggtctttgtccagttacacttgatgagtttgttcagtctcttcatgattatgattcaaggttgttgggggaactgcatgttgctctgctgaaatccattataaaggatattgaggatgttgctagaactcaatcaattgcactgggggtaaatccaggtggccatccacaaattgttgaaggggcatatgcctggggattcaatatacgtagctggcaacgccatcttaatcttcttacatggcctgagatattaagacagtttgctttatctgctggtttcggaccccaattaaagaaaaggacggtagaagattcttactatcgtaacgataatgagggtcatgatggtgagaatgttatatcgacacttcgaaatggttcagcagctgtgaatgctgctgctaagatgaaggaaagaggttacaccaatcgacgtagatcccgccaccgtctcactcctggaactgtaaaatttgccgctttccatgtgctttctcttgaagggagtaaaggtctcacaatattggaagtagcagaaaaaattcagaaatctggattgagagacctcacaacaagcaagacacctgaggcatccatagctgccgccttgtctagggacgcaaaactttttgagagaactgctccttcaacatattgtgtgaagtcgccttatagaaaagatccagctgattctgaagccgtgttgtcagcagcacgtgaaaaaattagggcttttcagaatgtgctttctgactctgaagctgaaaaggaggcagatgaagctgagagggatgatgattctgaatgtgatgatgctgatgatgaccctgatggtgatgatgtgaatactgaggtggaagatgacaaggatcctcctcttgctgtcaaggcacaagatgaagtaccgagtacaactacagttattggcataaggtctgagttagatagtgtgggtaatgcattgaactcatcaagtagttttactaagtcagcaaaaggcactcctctcccttctttaggcaagtccgatgcagcagatacttctaatgattcacctcttggaggctcatcagctaatcatgaagtagcccctggtgattctgaaaatacgcaaattgatgaaagcaatcaagttgagccttgggtacgtgcactagcagaaggtgactactgtgatcttagtgttgaagaacgccttaacgcattggttgccctcgttggtgttgccactgaagggaactctattcgtggtgtacttgaggaacgtttggagttagcaaatgccttaaagaagcaaatgtgggcagaagcgcaacttgacaagaggcgttccaaggaagaatttgctagcagagtacaatataactctgacatgggtttgaaggctgatttatatcaagaaaacaatgctacagagaatgatggacatgttgggacaatgaacagttgtgagatgcttgatcagcataatcagggtaattttggcagtatggcttatgagagaaatggcataggccaggaaatccttgcaaccccagatacttcatatgttcagcagtatgcttatgctgataaaacacgatctcagttgaaatcgtacattggtcaccgcgcagaacagctctatgtttacagatccctgcccctaggtcaggatcggaggcgaaacaggtattggcagtttacaacttcagcatcaccaaatgaccctggctcaggaagaatcttttttgaatccaaagatggatgttggagagttatcgactcagaggaggcctttgattctttagtggccgccctcgatacacgtggcagccgggaggcacagctgcattcaatgctgcaagtgatcgagcccacctttaaggaagctattaagaggagaagtgcaagtatagaactacctgctggaaggtatccaaagaatggagctactgacatgataagggcaaattatcatagtgaggttggaagctcaagcagtactccttttggtgctacatctgatattgtgacagcatattctgattcttttaaagtggagcttgggcgtaatgattttgagaagacagctatctcaaaaagggcagataaatttttaaaatggatgtggagggaatgctacaatcaggaattgacatgtgccatgaaatacgggaagaaaagatgctctgaattgttgcattcttgtaattgctgctatcagatttacttagccgaagaaaggcactgtccttcttgccataagactttcaaatccatttacaatttttctgatcatacaacacaatgtgaagagaaacggagaactgacccttactggaagatgcaaatcgctgattattctgttccaataggaatggtattactcaagctgcagttagttacgattgaggcatgtataccatcagaagcacttcaaccattttggactgatgtgtatcggaaatcttggagtgtgaagctgtacactaccaaatctattgctgaaacatttcaggttacgcatttttttcccaccattctggcttcccatcatttccttttcttgactgaaactctggttacatgcattcaagtttcatttgcctgtcagatgtatatattactttaa

SEQ ID NO: 334 - protein, 1523 aa, Sorghum bicolor
  misc_feature: Ceres ANNOT ID no.6042411
  misc_feature: Bit score of 207.3 for HMM based on sequences of FIGURE 4.
  misc_feature (55)..(111): Pfam Name: Homeobox Pfam Description: Homeobox domain
  misc_feature: Functional Homolog Of Ceres SEEDLINE ID no. ME10007 at SEQ ID NO. 317
MDAGGDGDGDGAGKATQEAPAEATTPPPAPVAAPVPVSASATGAGAGTSGSGEKPVKRMMKTPYQLEVLEKTYAAEQYPSEAMRLELSAKIGLSDRQLQMWFCHRRLKDRKPPTKRQRREEESALAPVMPPPPVLPAPVSVMPLASSDLMVGAPGPYDEPLHPVHSRRGAGRSSAVPRISMPDIGRRYYEPTPIMIAPAIPSMQLTQSELRVINSVESQLGEPLREDGPALGVEFDPLPPGAFGAPIVPEQQKQPVRSYDTKIFSRHDQKLLKASAFLPTMESPFVPNSFTGKRKSTVGNTPIVQPHVGSRAVHEYQFLPEQPSDTYERASRSHYYDTPVEVSNSRISSLTSGSQLLHGSEAAAPSYAFQGHTSGSSLMPQPSRSQVFPGAPADYETTQSNSNLNSVPVEGQFDISQVAAFENPLVSSERRAYHDEDTSRVERKRKHNEEAKIAKEVEAHERRIRKELEKQDILNRKREEQRRKEMERLDRERRKEEERLLRERQREEERFQREQRREHERMEKLLQKQSRRAEKQRQKEELRKEKEAARQKAANERATARRIAREYMELVEDERLELMELAAQNKGLPSMLHLDSDTLQQLDSFRGMLSQFPPTTVRLKLPFSIKPWTGSEDNVGKLLMVWKFFITFTDVLGLCPVTLDEFVQSLHDYDSRLLGELHVALLKSIIKDIEDVARTQSIALGVNPGGHPQIVEGAYAWGFNIRSWQRHLNLLTWPEILRQFALSAGFGPQLKKRTVEDSYYRNDNEGHDGENVISTLRNGSAAVNAAAKMKERGYTNRRRSRHRLTPGTVKFAAFHVLSLEGSKGLTILEVAEKIQKSGLRDLTTSKTPEASIAAALSRDAKLFERTAPSTYCVKSPYRKDPADSEAVLSAAREKIRAFQNVLSDSEAEKEADEAERDDDSECDDADDDPDGDDVNTEVEDDKDPPLAVKAQDEVPSTTTVIGIRSELDSVGNALNSSSSFTKSAKGTPLPSLGKSDAADTSNDSPLGGSSANHEVAPGDSENTQIDESNQVEPWVRALAEGDYCDLSVEERLNALVALVGVATEGNSIRGVLEERLELANALKKQMWAEAQLDKRRSKEEFASRVQYNSDMGLKADLYQENNATENDGHVGTMNSCEMLDQHNQGNFGSMAYERNGIGQEILATPDTSYVQQYAYADKTRSQLKSYIGHRAEQLYVYRSLPLGQDRRRNRYWQFTTSASPNDPGSGRIFFESKDGCWRVIDSEEAFDSLVAALDTRGSREAQLHSMLQVIEPTFKEAIKRRSASIELPAGRYPKNGATDMIRANYHSEVGSSSSTPFGATSDIVTAYSDSFKVELGRNDFEKTAISKRADKFLKWMWRECYNQELTCAMKYGKKRCSELLHSCNCCYQIYLAEERHCPSCHKTFKSIYNFSDHTTQCEEKRRTDPYWKMQIADYSVPIGMVLLKLQLVTIEACIPSEALQPFWTDVYRKSWSVKLYTTKSIAETFQVTHFFPTILASHHFLFLTETLVTCIQVSFACQMYILL

SEQ ID NO: 335 - DNA, 489 bp, Arabidopsis thaliana
  misc_feature: Ceres SEEDLINE ID no.ME10852
  misc_feature: Genomic Sequence
  misc_feature: Expected Sequence
  misc_feature: Encodes the peptide sequence at SEQ ID NO. 337
atgggtctatcaagtcttcctggtccatcagaaggaatgttatgtgtgatattagttaatacagcattatcgatctccattgtcaaaggcattgtaagatcattccttggcatagtaggaatcagtctctcgccgtcttcatcctcgccttcttcggtgacggtatcttcagagaattcatcaacttcagagtcatttgatttccgggtctgccaaccagagagttaccttgaggagttcaggaaccggactccgacactgaggtttgagagcttgtgcaggtgcaagaaacaggcagacaatgagtgttctgtgtgtttgtcgaaattccaaggggattcagagatcaacaagctcaagtgcggccatttgtttcacaaaacatgcttggagaaatggatagactattggaacatcacttgcccattgtgtaggactcctcttgttgttgtgccagaagaccatcagctttcttctaatgtttggtga

SEQ ID NO: 336 - DNA, 489 bp, Arabidopsis thaliana; identical to SEQ ID NO: 335
  misc_feature: Ceres SEEDLINE ID no.ME10852
  misc_feature: Predicted Sequence
  misc_feature: Encodes the peptide sequence at SEQ ID NO. 337

SEQ ID NO: 337 - protein, 162 aa, Arabidopsis thaliana
  misc_feature: Ceres SEEDLINE ID no.ME10852
  misc_feature: Bit score of 324.9 for HMM based on sequences of FIGURE 5.
  misc_feature (103)..(144): Pfam Name: zf-C3HC4 Pfam Description: Zinc finger, C3HC4 type (RING finger)
MGLSSLPGPSEGMLCVILVNTALSISIVKGIVRSFLGIVGISLSPSSSSPSSVTVSSENSSTSESFDFRVCQPESYLEEFRNRTPTLRFESLCRCKKQADNECSVCLSKFQGDSEINKLKCGHLFHKTCLEKWIDYWNITCPLCRTPLVVVPEDHQLSSNVW

SEQ ID NO: 338 - DNA, 903 bp, Brassica napus
  misc_feature: Ceres CLONE ID no.952050
  misc_feature: Encodes the peptide sequence at SEQ ID NO. 339
atccatctctcacttctcagattcccatcactattttcaacagaaactcaaaactttataataaagattcaatctttcgtttaattggtgatcatcgcctctcatacttgtctccagatcacatctctctgagaagaacaaagatctgatcggcttccgagaattacatattgtttgaaacatccaaaagagttgaaagatgggtctatcaagccttcctggtccatcagaaggaatgctatgcgtgatattagttaacacagcattgtcaatctccatcttcaaaggcattctcaggtcagtgcttcagctaataggaatccgcctctctccttcttcagcagcagcagcagctgcatcttcagagaatcaaacttcagattcttttgatttccgggtctgccagcctgagagtttccttgaggaattcaggaacaggacccccacagtgaagtttgagagcttgtgcaagtgcaagaaacaggcggacaacgagtgttctgtatgcctgtcgaaattcgaagaggattcagagatcaacaagctaaaatgtggccatttgtttcacaaaacatgcttggagaaatggatagactactggaacatcacttgcccactctgtaggactcctcttgttgttgtcgcagcagacgaccagctggtttcctctaatgtttggtgactacttttctttgtatagagttttccttggggttgggtgtgtttgttgttgtgtacagctactactactttttactatgaaattaggctgcgtcacggttgattctttatcagattcagaccggagatgggggtattctgatgtacatattctgtgagctgtttatgtatgtagacccatgtgtaatggaagctcttgtttgaacaaaaaaaaaaaaaaaa

SEQ ID NO: 339 - protein, 160 aa, Brassica napus
  misc_feature: Ceres CLONE ID no.952050
  misc_feature: Bit score of 322.7 for HMM based on sequences of FIGURE 5.
  misc_feature (100)..(141): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPGPSEGMLCVILVNTALSISIFKGILRSVLQLIGIRLSPSSAAAAAASSENQTSDSFDFRVCQPESFLEEFRNRTPTVKFESLCKCKKQADNECSVCLSKFEEDSEINKLKCGHLFHKTCLEKWIDYWNITCPLCRTPLVVVAADDQLVSSNVW

SEQ ID NO: 340 - DNA, 522 bp, Brassica napus
  misc_feature: Ceres CLONE ID no.1265097
  misc_feature: Encodes the peptide sequence at SEQ ID NO. 341
  misc_feature (254)..(254): n is a, c, t, g, unknown, or other
atctctcttctctcatatttgtttaacagttcctctttctaacggcgaagcaatgggttttccgttgggctattccgaactcctcctcccaaaaatctttcttcacgtactctctttcttaggtctaatacgaaaactaatctccacacttttctggttcattggtctacccgattttttggaagccgaaccggttacatcttcatggcccgacccaccaccaaactccaccacctcaagccaccatgactctnacttgttttcagcagcgctgctagctggggagatcttgcccattgtcaaattctcggatctaaaccgacccgaatccgaatgttgtgcggtgtgtctctacgatttcgagaacgaggatgagatccgacggctgacgaattgcaggcatatattccataaagaatgtttggaccgttggattatggattatagtcagatgacgtgtccactttgtcgtacgcagttcatacctgatgatcttcaaaggtcgtttaatcaaaagctttg

SEQ ID NO: 341 - protein, 156 aa, Brassica napus
  misc_feature: Ceres CLONE ID no.1265097
  misc_feature: Bit score of 128.1 for HMM based on sequences of FIGURE 5.
  misc_feature (96)..(139): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
  misc_feature (68)..(68): Xaa is any aa, unknown, or other
MGFPLGYSELLLPKIFLHVLSFLGLIRKLISTLFWFIGLPDFLEAEPVTSSWPDPPPNSTTSSHHDSXLFSAALLAGEILPIVKFSDLNRPESECCAVCLYDFENEDEIRRLTNCRHIFHKECLDRWIMDYSQMTCPLCRTQFIPDDLQRSFNQKL

SEQ ID NO: 342 - DNA, 752 bp, Brassica napus
  misc_feature: Ceres CLONE ID no.942980
  misc_feature: Encodes the peptide sequence at SEQ ID NO. 343
acaatccaaaactctctctctctctctctctctctcctgtatattatctttacttgttaccatttttctctctaacgacgagtcaatgggttttccggtgggctactccgagctccttctcccaagaatcttccttcatctactctctttcttaggtctgctccgaaaactaatctccactattttctggctcattggtttacccgatttcctagaacccgaaccggtttcatcttcatggcccgagcccccaccaacctcaagccaccaagactctcacttgttttcagcagcgcttctagctggagatatcttgcccgttgtaagattctcggatctaaacctacccgagtccgaatgttgtgcagtgtgtctctacgacttcgagaaccacgatgagatccgacggctgacgaattgcaggcatatattccataaaggatgtttggaccgttggatgatggattataatcagataacatgtccactgtgtcgtacacagtttatacctgatgatcttcaagtggcgtttaatcataagctttgggctgaatctagtgaagtttctgaacttcttgttgaatcattttaggacagttccttttctctatctttaaattgtaatataattttttagtatttgtttgatggatgtatataaaaagatagtgattactatttacaggctagtgaaagaagaagacgaaatttgtatcatctatccggaaaaaaggaaattaaaattttgaatt

SEQ ID NO: 343 - protein, 168 aa, Brassica napus
  misc_feature: Ceres CLONE ID no.942980
  misc_feature: Bit score of 146.9 for HMM based on sequences of FIGURE 5.
  misc_feature (93)..(136): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYSELLLPRIFLHLLSFLGLLRKLISTIFWLIGLPDFLEPEPVSSSWPEPPPTSSHQDSHLFSAALLAGDILPVVRFSDLNLPESECCAVCLYDFENHDEIRRLTNCRHIFHKGCLDRWMMDYNQITCPLCRTQFIPDDLQVAFNHKLWAESSEVSELLVESF

SEQ ID NO: 344 - protein, 156 aa, Hevea brasiliensis
  misc_feature: Public GI ID no.37901055
  misc_feature: Bit score of 213.9 for HMM based on sequences of FIGURE 5.
  misc_feature (100)..(141): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MCLSNLPASSEGVICVVVMNTALSISIFKGIVRSVLHIVDNRLAPFSSSSSSILFPDYSDTESFEFPLHSSDDCVRELRSRRPAKRFDAVSSCKQPQHDCPVCLIQFKPDSEINCLSCGHVFHKACLEKWLDYRKVTCPLCKSPVMPEEEDTSSSW

SEQ ID NO: 345 - DNA, 682 bp, Parthenium argentatum
  misc_feature: Ceres CLONE ID no.1609912
  misc_feature: Encodes the peptide sequence at SEQ ID NO. 346
atatacaaaccttcaattcctataaattcattcattcatttattttctgtaaattcatcaacaatgggattcccaattgggtatacagaggtctacttacctaaattcttaatatatattctaactcttctgggtttgattcgaaaactaatttccaacgtttttcgggtactcggtttaggggaatttttagaacccgagtttacaaccgacccgacccgaataacagagatgtcgggtaatcaagttcggtcgtctgatgctttgctgatccgtgagctgcttccggtggtgaagtattcggaccttgtggacccacccgagagctgtgcggtttgtttgtatgagtttgatgctggagatgagatccgacggttgacaaattgccgacatatattccaccggtgttgtttggaccgttggatggaccatgatcagaacacgtgtccgctttgtcggacgccttttatttctggtgatttgccagatgagtttaatgaacggttgtgggtggcttctggcgtcggtgattattacggcgagtcgtcggtgattagtatttagtggatacttaaacacggtttttttaacaacacgccgtagacaagagtctttaccaagtgagctagcatcggtcataagagtttgaattaaaataccttatttttatttatttgttttg

SEQ ID NO: 346 - protein, 166 aa, Parthenium argentatum
  misc_feature: Ceres CLONE ID no.1609912
  misc_feature: Bit score of 162.4 for HMM based on sequences of FIGURE 5.
  misc_feature (89)..(131): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPIGYTEVYLPKFLIYILTLLGLIRKLISNVFRVLGLGEFLEPEFTTDPTRITEMSGNQVRSSDALLIRELLPVVKYSDLVDPPESCAVCLYEFDAGDEIRRLTNCRHIFHRCCLDRWMDHDQNTCPLCRTPFISGDLPDEFNERLWVASGVGDYYGESSVISI

SEQ ID NO: 347 - protein, 158 aa, Poncirus trifoliata
  misc_feature: Public GI ID no.76446335
  misc_feature: Bit score of 234.8 for HMM based on sequences of FIGURE 5.
  misc_feature (101)..(142): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLASMPSASEGMLCLILMNTAMPISIVKGIFRSILKVVGFQLAESSSTPYSYFASPQVVSAEPYDVNLSPPLSYVEEFRNQNPAIKYETLLHCEDAEHDCSVCLTEFEPQSDINNLSCGHLFHKVCLEKWLDYLNVTCPLCRTPLIPEFEDDPSCFW

SEQ ID NO: 348 - protein, 176 aa, Oryza sativa subsp. indica
  misc_feature: Public GI ID no.125560204
  misc_feature: Bit score of 86.8 for HMM based on sequences of FIGURE 5.
  misc_feature (107)..(149): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPSVCYCVILPQPLVLVLQLLDLLRHAFLLCLSALGLAAPPPPDEHPAYAPPPPPPASMAALPADLVWAFQPAPEPVAIKARLPAVRYADFVRCRRAAAAAAASCAVCLGALEARHRVRELGNCAHAFHKACIDKWVDKGQATCPLCRAALLPSADDDDAAAIAATTRHHLPSF

SEQ ID NO: 349 - protein, 167 aa, Oryza sativa subsp. japonica
  misc_feature: Public GI ID no.115477050
  misc_feature: Bit score of 307.3 for HMM based on sequences of FIGURE 5.
  misc_feature (100)..(141): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPAPKDSVVAYLLYNTAVSIAILADMVRAALVFLGLPVPPSAWEDGDDQLAAIAAAAAAAAAAAGGPSLADRFRSRFRPARFGRRRGGGAGAADCRVCLARFEPESVVNRLPCGHLFHRACLEKWLDYDHATCPLCRHRLLPATTESPSPSPATATPHFARI

SEQ ID NO: 350 - protein, 153 aa, Oryza sativa subsp. japonica
  misc_feature: Public GI ID no.125606087
  misc_feature: Bit score of 233.2 for HMM based on sequences of FIGURE 5.
  misc_feature (103)..(144): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPAPKDSLVLYVLYNAVVSVAALAGVVRAALVFLGLPTPPSLLLLLGGEEGGEDAAVAVSVSAAAAAAGPSLADTFRARFRPARFGHRRCGGGATADCRVCLVRFEAEAVVNRVPCGHIFHRACLETWLDYDHATCPLCRSRLLADSY

SEQ ID NO: 351 - protein, 212 aa, Oryza sativa subsp. japonica
  misc_feature: Public GI ID no.115460088
  misc_feature: Bit score of 162.6 for HMM based on sequences of FIGURE 5.
  misc_feature (112)..(155): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVCCYSELLLPKQLLHLLLLLGYIRRFLLWAFHAVGLGDLLDLGDEQQAVLQDHAREHRAPAQALPPQQQHRRAEFRTVPAMVIEEVLPVVRFDELVAAAPAVCGGGDCAVCLSGIGGGDEVRRLSNCRHVFHRGCLDRWMEHDDQRTCPLCRAPLIPDEMASALWAAAGVPDASDFDFSYFGAPLTPMPTPTLLRPHELLLTGLGGYQ

SEQ ID NO: 352 - protein, 212 aa, Oryza sativa subsp. japonica
  misc_feature: Public GI ID no.125591385
  misc_feature: Bit score of 142.8 for HMM based on sequences of FIGURE 5.
  misc_feature (112)..(155): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVCCYPSCCSPKQLLHLLLLLGYIRRFLLWAFHAVGLGDLLDLGDEQQAVLQDHAREHRAPAQALPPQQQHRRAEFRTVPAMVIEEVLPVVRFDELVAAAPAVCGGGDCAVCLSGIGGGDEVRRLSNCRHVFHRGCLDRWMEHDDQRTCPLCRAPLIPDEMASALWAAAGVPDASDFDFSYFGAPLTPMPTPTLLRPHELLLTGLGGYQ

SEQ ID NO: 353 - protein, 212 aa, Oryza sativa subsp. japonica
  misc_feature: Public GI ID no.115447931
  misc_feature: Bit score of 150.4 for HMM based on sequences of FIGURE 5.
  misc_feature (116)..(158): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYSELLLPRLLLQVLLLLGHLHRFLLWAFHAVGLGDLIDNPPGLAATEQDLMLQGRGGGMAEGWASSSALQHRRPEFRAIPPMAIEEALPVVRFDELVASAPAAVCGGGDCAVCLSGICGRDEVRRLSNCRHVFHRGCLDRWMAHEQRTCPLCRAPLIPDELLPAASGLPDPSDYDLSYYPSPLPLAPTPTLLRPHELLLNGLGGFQ

SEQ ID NO: 354 - protein, 151 aa, Medicago truncatula
  misc_feature: Public GI ID no.92893514
  misc_feature: Bit score of 145.6 for HMM based on sequences of FIGURE 5.
  misc_feature (106)..(147): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSNFPYAAEGVVPVIVMNTVLSMVLLKNMFRSMLQVVGCTSTTNSSYSPNIMEELEEEQVYSQEISNSRERRVSITQYKFLCYNRSNIARSSSSCGWTSPMVECCVCLSGFEANQEVSELPCKHFFHRGCLDKWFDNKHSSCPLCRSMD

SEQ ID NO: 355 - protein, 180 aa, Medicago truncatula
  misc_feature: Public GI ID no.87162911
  misc_feature: Bit score of 347.8 for HMM based on sequences of FIGURE 5.
  misc_feature (90)..(132): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYPEVSVPNIFLYTLSLLSFLRSLTISFLSLLHLSDLLDTDFSTTTLPDSHIHRPTLSAILIRQFLPIITFNDLAEGDSSPPVGCAVCLNEFAGEEEIRCMANCRHMFHRTCVDRWIDHDQKTCPLCRTHFVPYHKMEDYNQRLWNDAASEDDIDDDVSLFSHRHDYYYIANASL

SEQ ID NO: 356 - DNA, 1051 bp, Panicum virgatum
  misc_feature: Ceres CLONE ID no.1790901
  misc_feature: Encodes the peptide sequence at SEQ ID NO. 357
aatccaccactatcatcccaatctttctcctcccgcatcgcacccacctcccctacccgaaaaacccccaaattgcaatcaggtcccaggcgggctcctccccaaatccgcaacccagctcgacgaaattggcgaattcatcgagggagcctgacggatcgggcggcgaggatgggcatctcgagcatgccgacgcccaaggacagcctgatggggttcgtgctgtacaacacggcggtgtcggtggcgatcctggcggggctggtgcgcgcggcgttggtgttcctgggcctggcggcgccgtcgccgtgggagggcctcgccgctgacgagcaccaccaccaccgccaggtggtgtcgtcgacctcgcccctggggccgagcctcgcggatcggttccggagccgggtccgcccgtcgcggttcgggcggcggcgcggcggcgccggcgccggcgcagactgccgcgtgtgcctggcccggttcgagccggagtcggtggtgaaccggctcccctgcgggcacctcttccaccgggcctgcctcgagacctggctggactacgaccacgccacctgcccgctctgccgcctccgcctcctcccccccgccgccgacgacgactacgcggccgtggcggcgggcctggccgcccggttttaggagggatctccaggaggccaccgggggccgcggccgggtcggtgcggccctgccgcgtgcgcgtaggaattcgagaggcaggcagaggctccgttagctctagtgctccgctcccaattagtagcgcctttccttttttttttttcatgtgtttttcctctccccccaccatttcgtgctcctttttttttccttctttcgttttcgtcgctcgcgcttgcagctgtaccgtttgtaaatattcgcagcgtgctccgatggtgttgcacttgcagtactgtgtacaggcttttcgaaagcgaagagatgagaagaagaaaaaaaatgggaaaaaattgatcaagaaaaagccgatccccttttgctttaaaaaaaaaaaaaaaaaaaa

SEQ ID NO: 357 - protein, 163 aa, Panicum virgatum
  misc_feature: Ceres CLONE ID no.1790901
  misc_feature: Bit score of 306.1 for HMM based on sequences of FIGURE 5.
  misc_feature (98)..(139): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPTPKDSLMGFVLYNTAVSVAILAGLVRAALVFLGLAAPSPWEGLAADEHHHHRQVVSSTSPLGPSLADRFRSRVRPSRFGRRRGGAGAGADCRVCLARFEPESVVNRLPCGHLFHRACLETWLDYDHATCPLCRLRLLPPAADDDYAAVAAGLAARF

SEQ ID NO: 358 - DNA, 684 bp, Panicum virgatum
  misc_feature: Ceres CLONE ID no.2019320
  misc_feature: Encodes the peptide sequence at SEQ ID NO. 359
accactatcatcccaatctttctcctcccgcatcgcacccacctcccctacccgaaaaacccccaaattgcaatcaggtcccaggcgggctcctccccaaatccgcaacccagctcgacgaaattggtgaattcctcgagggagcctgacggatcgggcggcgaggatgggcatctcgagcatgccgacgcccaaggacagcctgatggggttcgtgctgtacaacacggcggtgtcggtggcgatcctggcggggctggtgcgcgcggcgctggtgttcctgggcctggcggcgccgtcgccgtgggagggcctcgccgccgacgagcaccaccaccaccaccaccgccaggtggtgtcgtcgatctcgcccctggggccgagcctcgcggaccggttccggagccggttccgcccgtcgcggttcgggcgccggcgcggcggcgccggcgccggcgcggactgccgcgtgtgcctggcccggttcgagccggagtcggtggtgaaccggctcccctgcgggcacctcttccaccgggcctgcctcgagacctggctggactacgaccacgccacctgcccgctctgccgcctccgcctccgcctccttccccccgccgccgacgacgactacgcggccgtggcagcgggcctggccgcccggttttaggagagatctccagg

SEQ ID NO: 359 - protein, 167 aa, Panicum virgatum
  misc_feature: Ceres CLONE ID no.2019320
  misc_feature: Bit score of 292.6 for HMM based on sequences of FIGURE 5.
  misc_feature (100)..(141): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPTPKDSLMGFVLYNTAVSVAILAGLVRAALVFLGLAAPSPWEGLAADEHHHHHHRQVVSSISPLGPSLADRFRSRFRPSRFGRRRGGAGAGADCRVCLARFEPESVVNRLPCGHLFHRACLETWLDYDHATCPLCRLRLRLLPPAADDDYAAVAAGLAARF

SEQ ID NO: 360 - DNA, 682 bp, Panicum virgatum
  misc_feature: Ceres CLONE ID no.1890013
  misc_feature: Encodes the peptide sequence at SEQ ID NO. 361
gaatccaccactaccatcccaatctttctcctcccgcatcgcatcgcacccacctcccctacccggaaaacccccaaattgcaatcaggtcccaggcgggttcctcccccaaatccgcaacccagctcgaggaaattcgagaattcatcgacggagcctgacggatcgggcggcgaggatgggcatctcgagcatgccgacgcccaaagacagcctgatggggttcgtcctgtacaacacggcggtgtcggtggcgatcctggcggggctggtgcgcgcggcgctggtgttcctgggcctggcggcgccgtctccgtgggagggcttcgccgccgacgagcacccccaccaccaccgccgccgccgccaggtggtgtcgtcgatctcgcccctggggccgagcctcgcggaccggttccggagccggttccgcccgtcgcggttcgggcggcggcgcggcggcgccggcgcggactgccgcgtgtgcctggcccggttcgagccggagtcggtggtgaaccggctcccctgcgggcacctcttccaccgggcctgcctcgagacctggctggactacgaccacgccacctgcccgctctgccgcctccgcctcctcccccccgccgccgacgatgactacgcggccgtggcggcggcggcggccgtccggttttatgagaat

SEQ ID NO: 361 - protein, 168 aa, Panicum virgatum
  misc_feature: Ceres CLONE ID no.1890013
  misc_feature: Bit score of 284.9 for HMM based on sequences of FIGURE 5.
  misc_feature (100)..(141): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPTPKDSLMGFVLYNTAVSVAILAGLVRAALVFLGLAAPSPWEGFAADEHPHHHRRRRQVVSSISPLGPSLADRFRSRFRPSRFGRRRGGAGADCRVCLARFEPESVVNRLPCGHLFHRACLETWLDYDHATCPLCRLRLLPPAADDDYAAVAAAAAVRFYEN

SEQ ID NO: 362 - protein, 164 aa, Thellungiella halophila
  misc_feature: Public GI ID no.20340241
  misc_feature: Bit score of 304.7 for HMM based on sequences of FIGURE 5.
  misc_feature (102)..(143): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPGPSEGMLCVILVNTALSISIFKGIVRSVLHVLGIRLSQSSSSPSSVTASSEIPASEPFDFRVSHPESFLEEFRNKTPTLRYESLCRCKKHEDNECSVCLSKFEEDSEINKLKCGHLFHKTCLEKWIDYWNITCPLCRTPLVVVAAAEDQKQLSSNVW

SEQ ID NO: 363 - DNA, 762 bp, Arabidopsis thaliana
  misc_feature: Ceres CLONE ID no.25801
  misc_feature: Encodes the peptide sequence at SEQ ID NO. 364
aaactttttcaaaaaaagaaaaaaaacccagagctcactcattattatctctctaaaaaccctagctttctccatgggctttcccgtaggttacacagaggttttcttaccgaagcttttcgtacaaacgctttcgattctcggattcatcagaaccatcgtcttctctatcttccgcttcttgggtctctcagattttctcgaaatggatcaaacctggcccgattacacatcgtacccgacccgaatacccgaaacccgctcacctttctccgcactcctaattagagagatcctaccggttatcaaattcgaagagttaacgaattccggcgaagatctaccggaaaactgcgccgtttgtctatacgaattcgaaggagaacaagagatccggtggctgagaaattgcagacatatatttcaccggagctgtcttgaccgttggatggatcatgatcagaagacgtgtccactttgtagaacaccgtttgttccagatgagatgcaagaagagtttaatcaacggctatgggctgcttctggtgttcatgattttcactgtcccgtgaccgaattattatagaagaagccacgcttttctatctttttctgtgtcccttatgttcttttttgttttgactttcacccctctacttttgatgttgcttttttcacccctcttactgacatttagacttgccacgcttttatgtgtgtatatactccttacatatgaatgagagatgagcaataaatatc

SEQ ID NO: 364 - protein, 170 aa, Arabidopsis thaliana
  misc_feature: Ceres CLONE ID no.25801
  misc_feature: Bit score of 211.9 for HMM based on sequences of FIGURE 5.
  misc_feature (94)..(136): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYTEVFLPKLFVQTLSILGFIRTIVFSIFRFLGLSDFLEMDQTWPDYTSYPTRIPETRSPFSALLIREILPVIKFEELTNSGEDLPENCAVCLYEFEGEQEIRWLRNCRHIFHRSCLDRWMDHDQKTCPLCRTPFVPDEMQEEFNQRLWAASGVHDFHCPVTELL

SEQ ID NO: 365 - protein, 131 aa, Arabidopsis thaliana
  misc_feature: Public GI ID no.9743343
  misc_feature: Bit score of 141.8 for HMM based on sequences of FIGURE 5.
  misc_feature (85)..(127): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSHFPTASEGVLPLLVMNTVVSITLLKNMVRSVFQIVASETESSMEIDDEPEDDFVTRRISITQFKSLCENIEEEEEEKGVECCVCLCGFKEEEEVSELVSCKHFFHRACLDNWFGNNHTTCPLCRSIL

SEQ ID NO: 366 - protein, 176 aa, Arabidopsis thaliana
  misc_feature: Public GI ID no.15238072
  misc_feature: Bit score of 130.0 for HMM based on sequences of FIGURE 5.
  misc_feature (105)..(148): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGYPVGYTELLLPRIFLHLLSLLGLIRTLIDTGFRILGLPDFLESDPVSSSSSWLEPPYMSTAAHHHQESSFFFPVAARLAGEILPVIRFSELTRPGFGSGSDCCAVCLHEFENDDEIRRLTNCQHIFHRSCLDRWMMGYNQMTCPLCRTPFISDELQVAFNQRVWSESELLAESN

SEQ ID NO: 367 - protein, 166 aa, Arabidopsis thaliana
  misc_feature: Public GI ID no.15222553
  misc_feature: Bit score of 151.3 for HMM based on sequences of FIGURE 5.
  misc_feature (89)..(132): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYSELLLPKIFFYLLSFLGLIRKLISTMFKIIGLPDFLEPEPVSTSWPDPPPTLTKPDSAAILAGEMLPVVRFSDINRPESECCAVCLYDFENDDEIRRLTNCRHIFHRGCLDRWMMGYNQMTCPLCRTQFIPDHLQLEFNQRLWSQSSAVSSQLLDESSS

SEQ ID NO: 368 - protein, 176 aa, Arabidopsis thaliana
  misc_feature: Public GI ID no.21554155
  misc_feature: Bit score of 129.4 for HMM based on sequences of FIGURE 5.
  misc_feature (105)..(148): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGYPVGYTELLLPRIFLHLLSLLGLIRTLIDTGFRILGLPDFLESDPVLSSSSWLEPPYMSTAAHHHQESSFFFPVAARLAGEILPVIRFSELTRPGFGSGSDCCAVCLHEFENEDEIRRLTNCQHIFHRSCLDRWMMGYNQMTCPLCRTPFISDELQVAFNQRVWSESELLAESN

SEQ ID NO: 369 - DNA, 918 bp, Zea mays
  misc_feature: Ceres CLONE ID no.1460088
  misc_feature: Encodes the peptide sequence at SEQ ID NO. 370
actgtatccatcccaccacaccagcaccacagccgctcagaccaaaccgcccctgaaagaaggcgcaaattgcagacgggtccacggatcgatccccaatcctccaggccgccgcgatgggcatctccagcatgccggcgcccaaggagagcctcctgatctacctgctctaccacgccgtcgtctcgatcgccgccctggcgggcctcctccgcgccgcgctcgtcttcctcggcctgcccgcgccgccgtcgctgctggccggcgaggacgccgacggtgccgaccagctcacggcggccaccccggcgggccccagcctggccgagaggttcaggagcaggttccgccccgcgcggttcggccgcaggcggggcgcggcggcggtgcctgactgccgcgtctgcctggtgcgcttcgaggcggacgccgtggtgaaccgcctcccctgtggccacctcttccaccgtgcctgcctcgagacctggctggactacgaccacgccacctgcccgctctgccgctcccgcctcctcccggccgccgcggccgccgacgagtcgtggtcgccgccggcccccaccctgacggcctggatttagggacgagtgaagagaagagaagagaagagagattcgccccgtcgcgtcgcccccggctatgtgctagctccgtgtgtggcctctccgtgtgcgcgtaggaatttagatggatcctagcagagggctctgctcctcgcctttcgcatttgccttttggtttcgttttctgtacgcctcgtgccatcgctgtaccgtgtaaatatttttcagcagagagcgctcctacgggtgtagcgctttgtgtgatgagaaatttgtgtacggccttcggctttttttacgagaaacggaaaattgatgaaaaaaaaaaaaaaaa

SEQ ID NO: 370 - protein, 161 aa, Zea mays
  misc_feature: Ceres CLONE ID no.1460088
  misc_feature: Bit score of 313.6 for HMM based on sequences of FIGURE 5.
  misc_feature (94)..(135): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPAPKESLLIYLLYHAVVSIAALAGLLRAALVFLGLPAPPSLLAGEDADGADQLTAATPAGPSLAERFRSRFRPARFGRRRGAAAVPDCRVCLVRFEADAVVNRLPCGHLFHRACLETWLDYDHATCPLCRSRLLPAAAAADESWSPPAPTLTAWI

SEQ ID NO: 371 - DNA, 837 bp, Zea mays subsp. mays
  misc_feature: Ceres CLONE ID no.374439
  misc_feature: Encodes the peptide sequence at SEQ ID NO. 372
cttccactgcaggttcctaacccccacccacctcgcccaaattgcaaccttccccgagtgctccaggtcccgtggccggcccccagatcctctccaatcccaatccaagtatcgaacggatcccatcggtggcgctcgagcgagcgagtgcggccggaaccgagcgaagatgggcatctcgagcatgccggcgcccgaggacagcctgctggggttcgtgctgtacaacacggcggcgtcggtggcgatcctggcggggctggtgcgcgccgcgctgctgttcctgggcctggcggcggcggaggacgaggagccgcggcagcaggcggaggccgtgacggtcacggccgtggggcccagcctcgcggaccggttccggagcaggttccggccgtcgcgctacgggcggcgccggggcggggactgccgcgtgtgcctggtgcggttcgagacggagtcggtggtgcagcggctcccctgcggccacctcttccaccgcgcctgcctcgagacctggatcgactacgaccacgccacctgcccgctgtgccgccaccgcctcctgccccccgccgctgccgccgacgaggtgccccggattgcctgattagcgccctaggaattgagagtaggcgtagcactctgcacctcgcagcagcagtgtctctgtacaggtttttttttcttttcctttttgttcgggggagagagaggacagaacggagattgaaggaagaaaatggtggcaacaaagctgttccccctttcgtttctccgaagctctctgttgtctttattcattccaaaagtataatctactcgtatgaaccaagtacc

SEQ ID NO: 372 - protein, 145 aa, Zea mays subsp. mays
  misc_feature: Ceres CLONE ID no.374439
  misc_feature: Bit score of 237.7 for HMM based on sequences of FIGURE 5.
  misc_feature (86)..(127): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPAPEDSLLGFVLYNTAASVAILAGLVRAALLFLGLAAAEDEEPRQQAEAVTVTAVGPSLADRFRSRFRPSRYGRRRGGDCRVCLVRFETESVVQRLPCGHLFHRACLETWIDYDHATCPLCRHRLLPPAAAADEVPRIA

SEQ ID NO: 373 - DNA, 494 bp, Zea mays
  misc_feature: Ceres CLONE ID no.1465572
  misc_feature: Encodes the peptide sequence at SEQ ID NO. 374
atggggatctcgagcatgccggagccgcgggacagcctgctggggtacctggtgtacaacgcggtggtgtcgatcgcggcgctggcggggctggtgcgggcggcgctggtgttcctggacctgcaggccgcgcagctgcccgggggcgcgggcgcgggcgcggacgacgaccgtctcgcggcgtcgggccccggcctgggcctggcggagcggttcctgagggccttccggccggcgctgtacggggtgctggtgtccacggcgtgcggcgcggcggaggcggccgcgggcgacgacgactgcagcgtgtgcctggccgggttcgaggcggaggccgtggtgaaccggctcccctgcggccacctcttccaccgcgcctgcctcgagacctggctccggtacgagcgcgccacgtgcccgctctgccgcgcccacgtgcccctccccgccgacgagacgccggtgctccgctacccggagctcgagtgatccgg

SEQ ID NO: 374 - protein, 162 aa, Zea mays
  misc_feature: Ceres CLONE ID no.1465572
  misc_feature: Bit score of 171.0 for HMM based on sequences of FIGURE 5.
  misc_feature (101)..(142): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPEPRDSLLGYLVYNAVVSIAALAGLVRAALVFLDLQAAQLPGGAGAGADDDRLAASGPGLGLAERFLRAFRPALYGVLVSTACGAAEAAAGDDDCSVCLAGFEAEAVVNRLPCGHLFHRACLETWLRYERATCPLCRAHVPLPADETPVLRYPELE

SEQ ID NO: 375 - DNA, 1029 bp, Zea mays subsp. mays
  misc_feature: Ceres CLONE ID no.1565524
  misc_feature: Encodes the peptide sequence at SEQ ID NO. 376
agtgtgtgtgtgtgtgtgaccgtgcgtgaggcgtgagtccgtgaccattcccgtcggccgtcccaaaagaagcgcaaatttacaacccagtccaccacgggccacacaatcccaaatctaaccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccgactggcggcgtcgggcccgggactggcggagcggttcctcagggccttccggccggcgctgtacgaggtgctggcgtcgacggcgacgacgtgcgaggcggacggcggcgccgacggcgacgactgcagcgtgtgcctggccgggttccgggcgagggccgtggtgaaccgcctcccctgcggccacctcttccaccgcgcctgcctcgagacctggctccggtacgagcgcgccacgtgcccgctctgccgcgcccacgtgcccctccccgccgacgagacgccgctgctccgctacccggagttcgagtgatccggtaaaaaccaccccggccccccaccccccggcgagcggtgaccgcccccgtcgcgcgcgcctcggctgtgtgctgcaagttccgtgtggccttccgtgtacgcgtagcaaaccaaagaagaagaaaaaaaaaagagaaaaaaaaaaggtgtaggagcagtagtagactagtagtagtgcagggttgctgtcgcttgctttcccctttcgcttcttgtattccccctcccattctctttgcgttttccgttccgtgctgtcgcctgtagcgtgtaaatactccggttcgcacttggcagcagaggcagagtgtagagtgctcccgtggccgtggctgtggctgatggtgtagcactttttacgagctcagctcgtgtagtacattgcatccttcttctgttcaaaaaaaaaaaaaaaa

SEQ ID NO: 376 - protein, 157 aa, Zea mays subsp. mays
  misc_feature: Ceres CLONE ID no.1565524
  misc_feature: Bit score of 168.1 for HMM based on sequences of FIGURE 5.
  misc_feature (96)..(137): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPEPRDSLLGYLVYNTVISIAALAGLVRAALVFLDLQAALPPGDDGGDRLAASGPGLAERFLRAFRPALYEVLASTATTCEADGGADGDDCSVCLAGFRARAVVNRLPCGHLFHRACLETWLRYERATCPLCRAHVPLPADETPLLRYPEFE

SEQ ID NO: 377 - DNA, 993 bp, Zea mays subsp. mays
  misc_feature: Ceres CLONE ID no.322302
  misc_feature: Encodes the peptide sequence at SEQ ID NO. 378
ccccctcctccactcgcctgtgtgtgtctgtctgtccatccatccatcccgctgccagtcctcgcgccgcccaccccgaaataaccggaaattgcaacccggtccacgggtcggatcccccaaaccgaaccctcccgagctcgcccggcgatggggatctcgagcatgccggagccgcgggacagcctgctggggtacctggtgtacaacgcggtggtgtcgatcgcggcgctggcggggctggtgcgggcggcgctggtgttcctggacctgcaggccgcgcagctgcccgggggcgcgggcgcgggtgcggacgacgacggcggggaccgtctcgcggcgtcgggcccgggcctgggcctggcggagcggttcctgagggccttccggccggcgctgtacggggtgctggtgtccacggcgtgcggcgcggcggaggcggccgcgggcgacgacgactgcagcgtgtgcctggccgggttcgaggcggaggccgtggtgaaccggctcccctgcggccacctcttccaccgcgcctgcctcgagacctggctccggtacgagcgcgccacgtgcccgctctgccgcgcccacgtgcccctccccgccgacgagacgccggtgctccgctacccggagctcgagtgatccgggcctcggcggccgtcgcgcgcctcggctgtgtgctgcaagctccgtgtggccttccgtgtgcgcgtagcaaaaggaaaaaaggagtataggagctgtagtagtagagttgctgttgctttccctttctcgttttgtgttttgcggttgccctgcccccatgctcttgttgtttccgcgctgtcgctgtagcgtgtaaatactccggttcgcccttggcagcagagagtagtagagtgctcccgtggctgggccgatggtgtagcaccttttacgagctcagctcgtgtgtgtacatttgcatgctttsrattcagtttcccgagccaaaatatcgaggac

SEQ ID NO: 378 - protein, 165 aa, Zea mays subsp. mays
  misc_feature: Ceres CLONE ID no.322302
  misc_feature: Bit score of 170.8 for HMM based on sequences of FIGURE 5.
  misc_feature (104)..(145): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPEPRDSLLGYLVYNAVVSIAALAGLVRAALVFLDLQAAQLPGGAGAGADDDGGDRLAASGPGLGLAERFLRAFRPALYGVLVSTACGAAEAAAGDDDCSVCLAGFEAEAVVNRLPCGHLFHRACLETWLRYERATCPLCRAHVPLPADETPVLRYPELE

SEQ ID NO: 379 - protein, 157 aa, Zea mays
  misc_feature: Ceres CLONE ID no.101136485
  misc_feature: Bit score of 167.3 for HMM based on sequences of FIGURE 5.
  misc_feature (96)..(137): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPEPRDSLLGYLVYNTVISIAALAGLVRAALVFLDLQAALPPGDDGGDRLAASGPGLAERFLRAFRPALYEVLASTATTCEADGGGGGDDCSVCLAGFRARAVVNRLPCGHLFHRACLETWLRYERATCPLCRAHVPLPADETPLLRYPEFE

SEQ ID NO: 380 - DNA, 509 bp, Zea mays
  misc_feature: Ceres CLONE ID no.1376133
  misc_feature: Encodes the peptide sequence at SEQ ID NO. 381
aacctttattactcgcactctctctctagctccaatgggcttccccgtaggctacacagaggtcttcctcccgaagctcttcgtacaaacactctcaatcctcagtttcatcagaaccgtcgtcttctccctcttccgcttcttgggcctctccgacttcctcgaaatggaccaaacctggcccgactacacatctaacccgacccgaacacccgaactccgctcccccttctccgccctactcatccgcgagatcttacctgtcatcaagtttgaagacgtgacaacgacctccggagaagatctgccggagagctgcgcggtttgcctctacgagttcgaaggagagcaagagatccggtggctgagaaactgcagacatatattccaccggagctgtctcgaccgttggatggatcacgaccagaagacgtgtcctctctgtagaacgccgttcgttccagatgagatgcaagaagagtttaaatcacggctgtgggctgcttctg

SEQ ID NO: 381 - protein, 158 aa, Zea mays
  misc_feature: Ceres CLONE ID no.1376133
  misc_feature: Bit score of 186.4 for HMM based on sequences of FIGURE 5.
  misc_feature (95)..(137): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYTEVFLPKLFVQTLSILSFIRTVVFSLFRFLGLSDFLEMDQTWPDYTSNPTRTPELRSPFSALLIREILPVIKFEDVTTTSGEDLPESCAVCLYEFEGEQEIRWLRNCRHIFHRSCLDRWMDHDQKTCPLCRTPFVPDEMQEEFKSRLWAAS

SEQ ID NO: 382 - DNA, 744 bp, Zea mays
  misc_feature: Ceres CLONE ID no.1374381
  misc_feature: Encodes the peptide sequence at SEQ ID NO. 383
aacctttattaaaacagagctcactctctctctctctctctctctagctccaatgggcttccccgtaggctacacagaggtcttcctcccgaagctcttcgtacaaacactctcaatcctcagtctcatcagaaccgtcgtcttctccctcttccgcttcttgggcctctccgacttcctcgaaatggaccaaacctggcccgactacacatcttacccgacccgaacacccgagctccgctcccccttctccgccctcctcatccgcgagatcttacccgtcatcaagttcgaagacgtgacgacctcttccggcgaagatctgccggagagctgcgccgtctgcctctacgagttcgaaggagagcaagagatccggtggctgagaaactgcagacatatattccaccggagctgtctcgaccgttggatggatcacgatcagaagacgtgtcctctctgtagaacgccgtttgttccggacgagatgcaagaagagtttaatcaacggctgtgggctgcttctggtgttcatgattttcacagtgagtactgtcccgtgacggaactatagagagacagagagacagcttccttccctcctcctttgtgtctttttttttttgacttttcacccctgtacttttaaattttctttttttcaccccttgctaacattagatttgccacgcttttatgtgtgtatgtaaatatacatatgaatgagatgagcaataaacattg

SEQ ID NO: 383 - protein, 173 aa, Zea mays
  misc_feature: Ceres CLONE ID no.1374381
  misc_feature: Bit score of 196.9 for HMM based on sequences of FIGURE 5.
  misc_feature (95)..(137): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYTEVFLPKLFVQTLSILSLIRTVVFSLFRFLGLSDFLEMDQTWPDYTSYPTRTPELRSPFSALLIREILPVIKFEDVTTSSGEDLPESCAVCLYEFEGEQEIRWLRNCRHIFHRSCLDRWMDHDQKTCPLCRTPFVPDEMQEEFNQRLWAASGVHDFHSEYCPVTEL

SEQ ID NO: 384 - DNA, 730 bp, Zea mays
  misc_feature: Ceres CLONE ID no.1566473
  misc_feature: Encodes the peptide sequence at SEQ ID NO. 385
tccccgtctgccgtccaccacgcatcgccaagcgccatatctgcaggaagcaccgggccagacacgtcgcttcaccaccccaccccaccccaccccaccttccccttacaccaccaccgcaagccaagaggcacgtccacgcatgggtttcccggcgggctactcggagctggtgctcccgaagcagctgctccacctgctgctgctgctggggtacgtccgccgcttcctcctctgggcgttcgacgccgtgggcctcggcgacctgctggatctcggggacgaccaccaggcgccgccgccgccgcagcagccgcagccgcagcagcaccggcgggcggagttccgggcggccatgccggcgatggtcatcgaggaggccctccccgtggcgcggttcgacgagctggaggcgcgcgtcgtcggcggggactgcgcggtgtgcctcggcggcatcggcggcggcgacgaggtgcggcggctcggcaactgccgccacgccttccaccgcgcctgcctcgaccgctggatggagcacgaccagcgcacctgcccgctctgccgcgcgccgctcgtccccggcgcgctctggcccgccgacgcctccgacctggacttctcctacctcggcgcgcccgtgccctccccgacgctgctgcggccgcacgagctgctgctgctcgcgggcctgggcggatactgagctcaccgccccgactggcggggaagc

SEQ ID NO: 385 - protein, 186 aa, Zea mays
  misc_feature: Ceres CLONE ID no.1566473
  misc_feature: Bit score of 165.0 for HMM based on sequences of FIGURE 5.
  misc_feature (98)..(140): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPAGYSELVLPKQLLHLLLLLGYVRRFLLWAFDAVGLGDLLDLGDDHQAPPPPQQPQPQQHRRAEFRAAMPAMVIEEALPVARFDELEARVVGGDCAVCLGGIGGGDEVRRLGNCRHAFHRACLDRWMEHDQRTCPLCRAPLVPGALWPADASDLDFSYLGAPVPSPTLLRPHELLLLAGLGGY

SEQ ID NO: 386 - DNA, 1074 bp, Zea mays subsp. mays
  misc_feature: Ceres CLONE ID no.318088
  misc_feature: Encodes the peptide sequence at SEQ ID NO. 387
cccgtccacgcatcgccaccgcgccatatcggcatatccgcaagaagcacccggcacatcgcgtcgcccccaccttccccctcccaccaccgcaagcccggacacgcccagggcgcaaatccggacaagcgctgccccggtcgcggcaggcatgggtttcccggtgggctactcggagctggtgctcccgaagcagctgctccacctcctgctgctgctggggtacatccgccgcttcctcctctgggcgttcgacgccgtggggctcggcgacctgctggatctcggggacgaccaccaggcgctgctgcaggaccaccagcagcagcagcacggcgccgccgcgcaggggcgggacctgccgcagcaggcggcgatgctgcagcaccggcgcccggagttccgggcggtgccggcgatggtcatcgaggaggtcctccccgtggtgcggttcgacgagctggagctggagccggagcccggagactgcgcggtgtgcctgagcggcatcggcggccgcgacgaggtgcggcggctcagcaactgccgccacgtcttccaccgggcctgcctcgaccgctggatggagcacgaccagcgcacgtgcccgctctgccgcgcgccgctcatccccgacgagatggccggcgcgctctgggccgccgccgccggcgtccccgacgcctccgacttcgacttctcctacctcggcgcgccgctggcgcccgtgccctccccgacgctgctgcggccgcacgagctgctgctcaccggcctgggcggctaccagtgagagctcaccaccgcccgccacttcccccgtggggaatgcgcgtctgcctggatccatcgacgcttgcttgcttgcttccgttccgtgggagggacggggacggacagcagccgaggcagagaagaaacccaaggctctcgaattgtacataggcaaaatgagtaaagcggccacccccccaaaaaaaggctaggagattagatccctcttgtgcataggtagattccgtcttccaagtttgtggagttgtgaatctttgcgcggattaaatttttgtcgac

SEQ ID NO: 387 - protein, 213 aa, Zea mays subsp. mays
  misc_feature: Ceres CLONE ID no.318088
  misc_feature: Bit score of 176.0 for HMM based on sequences of FIGURE 5.
  misc_feature (113)..(155): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYSELVLPKQLLHLLLLLGYIRRFLLWAFDAVGLGDLLDLGDDHQALLQDHQQQQHGAAAQGRDLPQQAAMLQHRRPEFRAVPAMVIEEVLPVVRFDELELEPEPGDCAVCLSGIGGRDEVRRLSNCRHVFHRACLDRWMEHDQRTCPLCRAPLIPDEMAGALWAAAAGVPDASDFDFSYLGAPLAPVPSPTLLRPHELLLTGLGGYQ

SEQ ID NO: 388 - DNA, 1239 bp, Zea mays
  misc_feature: Ceres CLONE ID no.1452604
  misc_feature: Encodes the peptide sequence at SEQ ID NO. 389
agtcctcgacgcacgcccgcgcgcctcggcaaaccaccacgcccgccaccgccagccatactgagctccgccctggttccattccacccagagaggctccaagattgacgccgcgaccacgatgggcttccctgtggggtactcggactcggagacgctgctcccgcgcgtgctgctgcaggcgctcctcctcctgggccacctccaccgcttcctcctctgggccttccacgccgtggggctcggcgacctgatcgacctcggctgcaactacccgccgccgccgccctccgcgtccacggcggcggcggcgcaggagggccgcgacgtggcggccccgctgcggcactggcggccggagttcaggcccgtcccggcggtgcgcatcgaggaggcgctccccgtggtgcggttcgacgagcttgccgccgcggcgcgcggcgacggctacggcgactgtgactgtgactgcgcggtgtgcctcgacggcatcggcggcggcgacgaggtgcggcggctcggcaactgccgccacgccttccaccgcgcctgcctcgaccgctggatggcgcacggccagcgcacctgcccgctctgtcgcgcgccgctcgtccccggcgccgcggccgccggggatccctgggccgaagcgccgtggctcgacgcggccgactacgacgtgctgccctacccgtccacgcctctgctgatggtgcccaccccgacgctgctgcggcctcacgagctgctgctggtcgccggcctgggcggcggcttccagtgagcttctgcgtgtgcgtggctggtgtttgggcagcaggccacgcgaatccggtccgtggcaaggcgaaaaacgtcctcatgtcatgtgcggtgcggcacaccccgcccggtcggtcagacgcgtgaccgccgccatacctgctcgtccttcactcaacaactctgcagcagtcgtttgatcgtgtctccgtcggtgaaaagagaaaccaacggcagaggagggcgcgccctggtttttacagcggctgcggctcccaacttcccaacaagtgagaaaaaaagaagaagaggcgaaacatactaagaccagccctagaaaactagctagccaagtactatgttgatctgtaggccgctttggcgattccgtcttccaaacctgtggagttgtgaatccttttgcagattaaagtaaagttcgttagcaagaaaaaaaaaagaaaaaaaaaaaaaaaa

SEQ ID NO: 389 - protein, 220 aa, Zea mays
  misc_feature: Ceres CLONE ID no.1452604
  misc_feature: Bit score of 142.9 for HMM based on sequences of FIGURE 5.
  misc_feature (117)..(159): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYSDSETLLPRVLLQALLLLGHLHRFLLWAFHAVGLGDLIDLGCNYPPPPPSASTAAAAQEGRDVAAPLRHWRPEFRPVPAVRIEEALPVVRFDELAAAARGDGYGDCDCDCAVCLDGIGGGDEVRRLGNCRHAFHRACLDRWMAHGQRTCPLCRAPLVPGAAAAGDPWAEAPWLDAADYDVLPYPSTPLLMVPTPTLLRPHELLLVAGLGGGFQ

SEQ ID NO: 390 - DNA, 1120 bp, Zea mays
  misc_feature: Ceres CLONE ID no.337906
  misc_feature: Encodes the peptide sequence at SEQ ID NO. 391
actggcactgccctgtttgtttgctttttaatgcccggccaggccgccgcactcatctccttcctccatccgaaaccaactgacatcgccccgcagccaagaagctcggctcagctcagctcagttggttcctccattttgagtggaggactgactgtcctcccgtcgcccgtctcgcgatgctgatggggttccccgtggggtactcggagacgcccaagctgctgctgcacctcctcttcctcctcgaccacctgcgccgcctctcctcctggctgctccgcctcgcgggcgccgccgacgccgacgccgacaccgacgccggccaccctcgccacccctgcgccgccgcccagcgcctggaggagcactcccccgcggtgcgcttcgactcgctgtcgtgcggaagcggaggaggggtgacggcgccgcgcccgctgcccgagggctgctgcgtctgcctgggcgacttccacgccgccgccgaggtgcgccgcgcccggggctgccgccacgtcttccaccgcgcctgcctcgaccgctgggccgcgcacggccaccgcacctgcccgctctgccggacgccgctcctcccgccgctgccgctgcccctgcccctgcccctcccgctgccgccgtcgtagcgatccggattacctcctacctgttgggcctttgtgcaaaaaagtaaccttccactccactgggcttggtggtttgttatgatttttgagaaattacagggcgctccgtgtgaaaaggggctccctagtgtgctctgttctaggaaaaaggctcaagcctgaaagagggagcaaatatggtgatagacagacaataggttactagggcaaagttaaaacaggggaaacaaattacgttcttgttatatacacgtaggtaggtagaatcaatttggcaagagatgtgtctctgctcattttcttttttttctactctctataaaatatttttgttccttctttttttggtatgtgtgtgtttcctctccagtgtgggtgaagatgatgatgtatacatacatgccctctgattttcactgttttgtgggtcaaatttatataacaaagcattataacatgtattttatggcaatctc

SEQ ID NO: 391 - protein, 154 aa, Zea mays
  misc_feature: Ceres CLONE ID no.337906
  misc_feature: Bit score of 80.9 for HMM based on sequences of FIGURE 5.
  misc_feature (91)..(133): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MLMGFPVGYSETPKLLLHLLFLLDHLRRLSSWLLRLAGAADADADTDAGHPRHPCAAAQRLEEHSPAVRFDSLSCGSGGGVTAPRPLPEGCCVCLGDFHAAAEVRRARGCRHVFHRACLDRWAAHGHRTCPLCRTPLLPPLPLPLPLPLPLPPS

SEQ ID NO: 392 - DNA, 751 bp, Musa acuminata
  misc_feature: Ceres CLONE ID no.1734065
  misc_feature: Encodes the peptide sequence at SEQ ID NO. 393
atggggtttccggtcggctactcggagctgttgatgccgaggattgtcctccacatggccttgatcctcggctacgtgcggcggttcatcttccgggccttcgacgcggtcggccttggagacctcctcgacgccgacgtcccctggcccgagaacagcggccacagaaacctcgaccaccagcagctcctgcagccgccgcaatccccgtcggtgtcggcgatgctgctccgggaggcgctcccggtggtgcggtacgaggagctgggtgcggccgggcagcacgtcggggacagctgcgttgtctgcctgtacgagttcgaggcagcggaggaggtccgtcgcctgagcaactgcaggcacgtcttccaccgtggctgcctcgaccggtggctggagcaccaccagcggacgtgcccgctgtgccgcacgccgctcgtcccgggggagatgccggtcgccgtggacgatcaaatgtgggctgcggccggcgtcccggactcatactacgacgacttcttctcttttccctttgcctcggcctcgccgccgagtccaactctgctgcttccccaccagctcttctctgcctcttaggtagcaaatctaccagcatgaggaagttggatcgtccaaatttgtatatagaatagactggcagccacagagctgaacctgatatttgtcctgcagagtcgaagaaggacaaccttttattttcttctttcatttgcttgtagatagctcaagt

SEQ ID NO: 393 - protein, 198 aa, Musa acuminata
  misc_feature: Ceres CLONE ID no.1734065
  misc_feature: Bit score of 380.6 for HMM based on sequences of FIGURE 5.
  misc_feature (100)..(142): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYSELLMPRIVLHMALILGYVRRFIFRAFDAVGLGDLLDADVPWPENSGHRNLDHQQLLQPPQSPSVSAMLLREALPVVRYEELGAAGQHVGDSCVVCLYEFEAAEEVRRLSNCRHVFHRGCLDRWLEHHQRTCPLCRTPLVPGEMPVAVDDQMWAAAGVPDSYYDDFFSFPFASASPPSPTLLLPHQLFSAS

SEQ ID NO: 394 - DNA, 1225 bp, Glycine max
  misc_feature: Ceres CLONE ID no.473509
  misc_feature: Encodes the peptide sequence at SEQ ID NO. 395
gccttcgttttcaggtttcttcttttggtcatctaggaattttgtgtttatgttcaaaattgctagatcgtgtgttggggttggggtggtgttctgtggacatgtcagatattaaagaagaaaccaacagagtttccattctcggtatctcttctctgatcaggttgacaacttgacatagcaatcctgctttcttggttccccatttccatgtttgtggattcttcctgattcaaaggcaatccattgtgtcttcttagctcagttttgagcttcaaaagttacaacttgcaacacaaatttttatctgtaactttggtaatcctaaaggactcagcattgatcaaaatgggcctttcaagtctcccagcaccatctgaaggagtattatgtgtccttctggtgaacactgtattgtcaatttcaatattcaaaggcattgttaggacaatcctacacattgttggcatccatctttcatcatcatcctccacttcaccctcttcaccggatccctcgctaaccgcacctgagtcatttgaattccatcttagtccctctgagagttacattgaagagttcagaagccggacgccaacacttcggttcgacagtgtgtgctgctgtaaacaacctgagcatgactgctctgtatgcctcactcagtttgaaccggaatcggagataaaccgcttatcgtgcggccatctcttccacaaagtgtgcttagagaagtggctggactactggaacattacatgccctctttgcaggactcccttgatgcctgaagatgacacaccttgctttcagtaagcaaaaacaagggagcatggcaataagagagagtttcatgtacagtgtagtgtacatattcttgagggtttttgatgttcatgcatctgagttctgccacctttataagtttttaacctttttccttttatggtctgagtttgtggaggattttgtttttccctttttctgtctgtgctctttagcacacatgaggggtatactttttgcttgcatgttatgtttgttcacaatgcccacctggtttagacctccttaaattctatatttgggcattttgatcctaatttggaagcatggattgtagaatccatttgttttgcctttcaaactctcatcaccatgtgtatatatagtgtatgtgtgtaaatagctgtggtcggcaataaaattcagtcatcactaaacg

SEQ ID NO: 395 - protein, 155 aa, Glycine max
  misc_feature: Ceres CLONE ID no.473509
  misc_feature: Bit score of 313.7 for HMM based on sequences of FIGURE 5.
  misc_feature (100)..(141): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPAPSEGVLCVLLVNTVLSISIFKGIVRTILHIVGIHLSSSSSTSPSSPDPSLTAPESFEFHLSPSESYIEEFRSRTPTLRFDSVCCCKQPEHDCSVCLTQFEPESEINRLSCGHLFHKVCLEKWLDYWNITCPLCRTPLMPEDDTPCFQ

SEQ ID NO: 396 - DNA, 1234 bp, Glycine max
  misc_feature: Ceres CLONE ID no.1662513
  misc_feature: Encodes the peptide sequence at SEQ ID NO. 397
atcattccagaaccgtaatctccaaaccccacttcgtcagatactaaaaagaaaccaacagtttccatacttagtatttcttctctgactgactgatcaggttgacatcttgacattgcaatcctgccttttggttccccatttccatgtttgtggattcttcctgattcaaaggcaatatattgtgtcttcatagctcagtttttgagcctcatcagttgcaacttgcaacacaaactttatctataacttggtatctctaaaggactctcagcattgatcaaaatgggcctctctagtctcccagcaccatctgaaggagtattatgtgtccttctggtgaacactgtattgtcaatttccatattcaaaggcattgtaaggacaatcctgcacattgttggcatccatcttccatcatcctccacttcaccctcttcaccagatccctcccaagccgcacctgagtcatttgaattgcatcttagtccctcggagagttacattgaagagttcagaagccggacaccgacacttcggtttgacagtgtgtgctgctctaaacgacttgaacatgactgctctgtatgcctcactcagtttgaacccgaatcagagataaaccgcttatcgtgcggtcatctcttccacaaagtgtgcttggagaagtggctggactactggaacattacatgcccactttgccggactcccttgatgcccgaagatgacacaccttgctttcagtaagcaaaacaagtgagcatgccaataagagagagtttcatgtacagtgtagtgtacatattcttgagggtttttgatgttcatgcatttgagttytgccccctttttaagttttaacctttttgccttttatggtctagagtttgtggagggttttgctttccctttttctgtctgtgctctttagcacaaatgaggggtatactttttgcttgcatgttatgtttgttcacaatgccccccttgtttggacctcagagccttaattytatatttgggcattttgatcctaatttggaagcatggattgcagaatccatttgttttgcctttcaaactctcctccccatgtatatattgtgktgtaaatagctttggttgccacataatagagtatattttgtttaatttattttttaccccattaaaaaagkgtataatgagtatgtattgaaagaatgaaataattttagactwttattcaatt

SEQ ID NO: 397 - protein, 154 aa, Glycine max
  misc_feature: Ceres CLONE ID no.1662513
  misc_feature: Bit score of 302.0 for HMM based on sequences of FIGURE 5.
  misc_feature (99)..(140): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPAPSEGVLCVLLVNTVLSISIFKGIVRTILHIVGIHLPSSSTSPSSPDPSQAAPESFELHLSPSESYIEEFRSRTPTLRFDSVCCSKRLEHDCSVCLTQFEPESEINRLSCGHLFHKVCLEKWLDYWNITCPLCRTPLMPEDDTPCFQ

SEQ ID NO: 398 - DNA, 1601 bp, Glycine max
  misc_feature: Ceres CLONE ID no.1662527
  misc_feature: Encodes the peptide sequence at SEQ ID NO. 399
atgagtcatgagatacacttttcagttcatgaaacacaacagtaatcctcaaattctctctctgtaagttccaaaacaacattctttttcttttattttcttcagtgtgtttaatgtttttctcctgtctcaacatccaacatgacgattccatgaaatggtagattctaaattagcatcatgctctgtggatatgtctttttttatgattcttttttattttcattttaccttgatcagaagtattatggaccattttcttatgttcataaagttttgtttttggcagttcttgttcatgaaatccaatgcttctaatttaatccagattgctcaatttgcaaaatggaccctttggcttcaaatttaaacagtcttctttgatcctgttttcgatgttctttctattagttaatttgattatggggacgcagactttctttcaatttttctttctttgtagctgtttttctcccctagtaaaatatgactactttttagtctgaaccatcaaattcaatggtcccttttgtgtttaataagattgtaatcctatttccttatccaaacagaaatttaaactactaaatgaagaatctaaagaaaaccagttgtttagtctggattgaagcctaccctatttgtacaatcaattcccttgtcttgtttcaattttggtaagagtaccctttgatgtttctgcaggtaaataagagtttccattgatgaagttgacatagcaatttgttcattctgctggtttcagattcaaagagaaaaaatcatcatccacttgcaaccaacacaatttggtatcaaaatgggcctgtcaagtctcccagcaccatctgaaggagtgttatgtgtgcttcttgtaaacactgccttgtctatatccatattcaaaggcattgttaggacaattctacaaattgtcggtatccgcgtttcgtcgttgtctccttcaccagacatctcccgaaacccacctgagccattagaattcaacctcagcccctcggagggtttcattgaagagttcagaagcaggacaccaacacttaggtttggcagcatgtgtggcagtaaacaacctcaacatgaatgttgttgtgtgtgtctcacaaagtttgaaccagaatctgagataaactgtttatcatgtggccatatttttcacaaagtgtgcatggagaagtggttggactattggaacattacatgcccactttgcaggacttccttgatgcctgaagatgatgcatcttgcttttggtaaaaaaaacatgtacatataaaagaaaagagatatattcatgtacagtatatattgtatgtacatagttgtggcagtgttgatgttcccttggtcttggctctaacttttttaaccctttacttttttatgattgttaaagtgtgtggagggtcttgttttcctttgtttctctgtatctggtgttgccacatatgagtcgagggatctacttttttgggataattgtgtttgtccataatatcctcttgatatgtaaacagacatcatatacagacccttttgcttttgccaaaaaaaaaaaaaaaaaaaaaaaaaaaaaaaa

SEQ ID NO: 399 - protein, 152 aa, Glycine max
  misc_feature: Ceres CLONE ID no.1662527
  misc_feature: Bit score of 275.8 for HMM based on sequences of FIGURE 5.
  misc_feature (97)..(138): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPAPSEGVLCVLLVNTALSISIFKGIVRTILQIVGIRVSSLSPSPDISRNPPEPLEFNLSPSEGFIEEFRSRTPTLRFGSMCGSKQPQHECCCVCLTKFEPESEINCLSCGHIFHKVCMEKWLDYWNITCPLCRTSLMPEDDASCFW

SEQ ID NO: 400 - DNA, 746 bp, Glycine max
  misc_feature: Ceres CLONE ID no.849918
  misc_feature: Encodes the peptide sequence at SEQ ID NO. 401
atgtagtagtatttatcaggcaagtgggggttggtttgtgtttttttgttatatttgtatgttgttctgtgctgggtccttaatttgtggctgagaattaattattattatcaattatgggtctctcaaatttcccaagtgcatctgaaggggtgctacctgtgcttgtgataaacacggttctctcagtggcagtgttgaagaacatgtttagatccatgctccaagtagtacttggtggcagtgctgctgctaatggttcaaacattgaacatgatgaaagttcatcatcatcatgggaaaggagggtgtcaataactcagtacaagtcattgtgccacagccacgacataggaagaacaagtatggctatggtggagtgctgcgtttgtttgtgtcgttttgaagccaatcaagaggtcagtgagttgccttgcaagcattacttccacagaggttgcttggacaaatggtttgataacaaacacaccacttgtcccttgtgccgttccatcgactagacatgcagacatatacatacaaaggttgattaattaccattagagatatagctagctagttaattagttgttgctatatactgttaactggttatagtgaaaagaatcaatgcctcttttcatttctttactttagatttgtaaaactccttcaaccaactcagtttctctttgttttagtttttatggaacgtaatgagagatgacgttgcccaaaaaaaaaaa

SEQ ID NO: 401 - protein, 134 aa, Glycine max
  misc_feature: Ceres CLONE ID no.849918
  misc_feature: Bit score of 236.8 for HMM based on sequences of FIGURE 5.
  misc_feature (89)..(130): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSNFPSASEGVLPVLVINTVLSVAVLKNMFRSMLQVVLGGSAAANGSNIEHDESSSSSWERRVSITQYKSLCHSHDIGRTSMAMVECCVCLCRFEANQEVSELPCKHYFHRGCLDKWFDNKHTTCPLCRSID

SEQ ID NO: 402 - DNA, 672 bp, Glycine max
  misc_feature: Ceres CLONE ID no.571184
  misc_feature: Encodes the peptide sequence at SEQ ID NO. 403
acctcttgctcttgcttatactaactaactcttcttgagaaactctttctcacacgccaagagtaacatgggatttccagtggggtacacagagttgatgctgccgaaggtgtttctgcaggtgctatccgtattgggcttgataagaaaactcatcaccgtcctcttgtgctacatgggcttccacgatttcttcgaatccgacattgcgtggccggagagggcgccggaattccagtcggtgtgggcggtgctcataagggaaatcctaccggtggtgaagttctcggagatggagatggagatggcggaggcgccggagagctgcgcggtgtgtctgtacgagttcgagggagaggacgagatcagacggctgacgaactgccgccacatattccacagagggtgtctggaccgttggatgggatacgatcaaagaacgtgtcccctgtgtcggacacccttcataccccaccatatgcaagctgccttcaatgatagactttgggctgcttcagggattcctgatttctattacaatcatgaatgactctagggaaaaaaaatcctagatttggggacgggagtgttctgtttaggttgttgagtatgtgttcagtgttcaatgttcgtgtaaatattatacaaaatggaaagcggagaattgttgtt

SEQ ID NO: 403 - protein, 160 aa, Glycine max
  misc_feature: Ceres CLONE ID no.571184
  misc_feature: Bit score of 173.0 for HMM based on sequences of FIGURE 5.
  misc_feature (87)..(129): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYTELMLPKVFLQVLSVLGLIRKLITVLLCYMGFHDFFESDIAWPERAPEFQSVWAVLIREILPVVKFSEMEMEMAEAPESCAVCLYEFEGEDEIRRLTNCRHIFHRGCLDRWMGYDQRTCPLCRTPFIPHHMQAAFNDRLWAASGIPDFYYNHE

SEQ ID NO: 404 - DNA, 826 bp, Glycine max
  misc_feature: Ceres CLONE ID no.665689
  misc_feature: Encodes the peptide sequence at SEQ ID NO. 405
ataatcgaaaaactctttacaaagaacatctcttgctcttcccactttctctctctaaagaatataatactcaaaattcatccatttttattttatttttcttaaaaaacaaagcgcgtatagtctcacgcgcccgacgatgggttttcccgtagggtacccggagctgctggttccgaaaatgttcctccacgcgctctccctcctcgcgtggctgcgctccctcgtcttcgccctcttccgcctcctccgcatctccgacctcctcgacaccgattccgccgcctctgacctccctccgccgcctccgccacgcgagccgactctctccgccctcctcatccgcgagttcctccccgtggcggcgttccgcgacctggcagccgccgacggggatcctccgccgtcgggctgcgccgtgtgcctgagcgaattctcctcggaagaagaaatccggtgtatggcgaactgcaagcacattttccaccggtggtgcgtggaccgttgggtcgatcacgatcagaagacgtgtccgctctgcagaactccgtttgtgccgcatcacaagctcgaagaatacaatcagcgactgtgggcagcttctggagtttcacagttttactaccaagacgattacacggcttctctctgattttttttttctctttctttttccacttatatatttataattatatagcactatatctttttttcatattattattatggtgggggacttgacagctagtgtagcgaaatgtatatagctaattaaaacaaaaacattgtatcaataaaaaaaatcagaattttttggattggt

SEQ ID NO: 405 - protein, 170 aa, Glycine max
  misc_feature: Ceres CLONE ID no.665689
  misc_feature: Bit score of 208.5 for HMM based on sequences of FIGURE 5.
  misc_feature (92)..(134): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYPELLVPKMFLHALSLLAWLRSLVFALFRLLRISDLLDTDSAASDLPPPPPPREPTLSALLIREFLPVAAFRDLAAADGDPPPSGCAVCLSEFSSEEEIRCMANCKHIFHRWCVDRWVDHDQKTCPLCRTPFVPHHKLEEYNQRLWAASGVSQFYYQDDYTASL

SEQ ID NO: 406 - DNA, 782 bp, Glycine max
  misc_feature: Ceres CLONE ID no.1365853
  misc_feature: Encodes the peptide sequence at SEQ ID NO. 407
acaagaacttctcttcccactttctctctctaaagaatatataaaacaacaacaaaactcatccattttttttccctctaaaaaaactaagcgcgactaatctcacgcgccgacgatgggttttcccgtagggtacccggagctcctggttccgaaaatgttcctccacgcgctttccttcctcgcgtggctccgctccctcgttttcgccctcttccgcctcctccgcatctccgacctcctcgacactgaaccttccccctccgacctccctccgccggctccgccgcgcgagccgacgctatccgcacttctcatccgagagtttctccccgtggccgccttccgcgacctcgccagcgcctccggagtagatcctcctcagtcgggatgcgccgtgtgcctgagcgagttttccgaagaagaggaaatccggtgcatggcgaactgcaagcacattttccactgcgcgtgcgtggaccgttggatcgatcacgatcagaagacgtgtccgctgtgcagaagtacgttggtgccacatcagaagctcgtagaatacacccagcgactatgggcggcttctggagtttcgcagttttattaccaagacgattacacggcttccctctgaatttttctttttctttttccacttatataattatatatatctttttttattatggtggggggacttgacagctagtgtagccaaatgtatatagctaattaaaacaaaaatattgtatcaatcaaaaagtgagatttttttttggattcgc

SEQ ID NO: 407 - protein, 171 aa, Glycine max
  misc_feature: Ceres CLONE ID no.1365853
  misc_feature: Bit score of 187.5 for HMM based on sequences of FIGURE 5.
  misc_feature (93)..(135): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYPELLVPKMFLHALSFLAWLRSLVFALFRLLRISDLLDTEPSPSDLPPPAPPREPTLSALLIREFLPVAAFRDLASASGVDPPQSGCAVCLSEFSEEEEIRCMANCKHIFHCACVDRWIDHDQKTCPLCRSTLVPHQKLVEYTQRLWAASGVSQFYYQDDYTASL

SEQ ID NO: 408 - DNA, 971 bp, Triticum aestivum
  misc_feature: Ceres CLONE ID no.633470
  misc_feature: Encodes the peptide sequence at SEQ ID NO. 409
ctcactgtatccatcccaccacacccacaccgcaccgctccctcgcccagaccaccccgaaagaaggcgcaaattgcagacgggtccccggatcgatccccattcctcctccaggccgccgcgatgggcatctccagcatgccggcgcccaaggagagcctcctgatctacctgctctaccacgccgtcgtctcgatcgccgccctggcgggcctcctccgcgccgcgctcgtcttcctcggcctgcccgcgccgccctcgctgctggccggggaggacgccgacggcgccgaccagctcacggccgccaccccggcgggccccagcctggccgagaggttcaggagcaggttccgccccgcgcggttcggccggaggcggggcgcggcggcctcgccgacgcccgactgccgcgtctgccttgttcgcttcgaggcggacgccgtggtgaaccgcctgccctgtggccacctcttccaccgcgcctgcctcgagacctggctggactacgaccacgccacctgcccgctctgccgctcccggctcctcccggccgccaccaccgccgccgacgagtcgtggtcgccgccggcccccaccctgacggcctggatttagggacgagtggagggaagagaagagagagattcgccccgtcgcgtcgcccccggctatgtgctagctccgtgtgtggcctctccgtgtgcgcgtaggaatttagatggatcctagcagagggctcttatgcccctcgcctttcgcatttgccttttggtttcgttttctgtacgcctcgtgccatcgctgtaccctgtaaatatttttcagcagagagcgctcccaccgggtgtagcgctttgtgtgatgagaaatctgtgtacggctctcggctttttttacgagaaacggaaaattgatggaacaaggattgtgtgtcttatgaacaccagagggccggtgttcttgcttgc

SEQ ID NO: 409 - protein, 164 aa, Triticum aestivum
  misc_feature: Ceres CLONE ID no.633470
  misc_feature: Bit score of 319.5 for HMM based on sequences of FIGURE 5.
  misc_feature (96)..(137): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPAPKESLLIYLLYHAVVSIAALAGLLRAALVFLGLPAPPSLLAGEDADGADQLTAATPAGPSLAERFRSRFRPARFGRRRGAAASPTPDCRVCLVRFEADAVVNRLPCGHLFHRACLETWLDYDHATCPLCRSRLLPAATTAADESWSPPAPTLTAWI

SEQ ID NO: 410 - DNA, 741 bp, Triticum aestivum
  misc_feature: Ceres CLONE ID no.1052457
  misc_feature: Encodes the peptide sequence at SEQ ID NO. 411
aatcagagctcattctctctctctctctctatctctatctctatctctctctagctccaatgggctttcccgtaggctacacagaggtgtttctccctaagctcttcgtacaaacgctttcgatactcagtttcttcagaaccgtcgtcttctatctcttccgcttcttgggtctctccggcttcctcgaaacggatcaaacctggcccgactacacatcgtacccgacccgaatacccgaactccgctcacctttctccgccctactaatccgcgagatcttaccggttatcaaattcgaagacgtgacgagctccggcgaagaactaccaggaaactgcgccgtttgtctctacgagttcgaaggagaggaagagatccgacggctgagaaactgcagacatatattccaccggagctgtctcgaccgttggatggatcatgatcagaagacgtgtcctctttgtagaacaccgtttgttccagatgagatgcaagaagagtttaatcaacggttatgggctgcttctggtgttcatgacttccacatcgagtagagtcccttgtcgttactttagagaaagctacttttgtctccctccctccttgtgtcttttcttttctttttttactttttaccactgtacttttaattgtgctttttcacccttgctaacattagatttgccacttttatgtgtatatgaatgatatgagcaataaacacaaccaaatttaact

SEQ ID NO: 411 - protein, 165 aa, Triticum aestivum
  misc_feature: Ceres CLONE ID no.1052457
  misc_feature: Bit score of 205.3 for HMM based on sequences of FIGURE 5.
  misc_feature (94)..(136): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYTEVFLPKLFVQTLSILSFFRTVVFYLFRFLGLSGFLETDQTWPDYTSYPTRIPELRSPFSALLIREILPVIKFEDVTSSGEELPGNCAVCLYEFEGEEEIRRLRNCRHIFHRSCLDRWMDHDQKTCPLCRTPFVPDEMQEEFNQRLWAASGVHDFHIE

SEQ ID NO: 412 - DNA, 995 bp, Triticum aestivum
  misc_feature: Ceres CLONE ID no.579918
  misc_feature: Encodes the peptide sequence at SEQ ID NO. 413
cgcctgccaccaccaccagcacaccgtcgtcctcacacttgcctctcatcctccctgccgaggccgcagcggtcagcaggcggcgcggacgcttctcctgggcaaggacaggcaagcgacaggcatgggcttcccggtcggctactccgagcttctgctccccaagcagctgctccacctcctcctcctgctcggttacctccgccgcttcctcctctgggccttcgacgccgtcggcctcggcgacctgctggatctcggggacgagcacctgccgcaggaccacgcgcgcgccgaccacgccgccgcggcggcgcagctgctgcagcaccggcggcccgagttccggcccgtcacggccatggtcatcgaggaggtgctccccgtggtgcggttcgacgagctggaggccgcggcgtgcgtcgacggggactgcgccgtgtgcctcagcggcatcggcggcggcgacgaggtgcggcggctcagcaactgccgccacgccttccaccggggctgcctggaccgctggatggagcacgaccagcgcacctgcccgctctgccgcgcgccgctcatccccgacgagatggccggcgcgctctgggccgccgccgccggcgtgcccgacgcctccgacttcgacttcttctacctgggcgccgcctcggcgccggccaccccgacgctgctgcggccgcacgagctgctgctcaccggcctgggcggctaccagtgagccgagcccccgattcggtccaggcatccggccgccgccgccccgaatgcgcaattttacaggactgaattggtctccgcgtccggacgccggcgagctgcctggccccagccgtgtacatagggcgaaatgagtaaagtaaccgccccgaaaagggctaggagattagattcttgttatgtatagctagattccatcttccaagtttgcggagctgtggatcttcctttcttctgccaattaaatttgttgatgagct

SEQ ID NO: 413 - protein, 203 aa, Triticum aestivum
  misc_feature: Ceres CLONE ID no.579918
  misc_feature: Bit score of 190.5 for HMM based on sequences of FIGURE 5.
  misc_feature (104)..(146): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYSELLLPKQLLHLLLLLGYLRRFLLWAFDAVGLGDLLDLGDEHLPQDHARADHAAAAAQLLQHRRPEFRPVTAMVIEEVLPVVRFDELEAAACVDGDCAVCLSGIGGGDEVRRLSNCRHAFHRGCLDRWMEHDQRTCPLCRAPLIPDEMAGALWAAAAGVPDASDFDFFYLGAASAPATPTLLRPHELLLTGLGGYQ

SEQ ID NO: 414 - DNA, 1082 bp, Triticum aestivum
  misc_feature: Ceres CLONE ID no.863299
  misc_feature: Encodes the peptide sequence at SEQ ID NO. 415
tcgtcctcctgattcggctgtccggacagtccgtagatcaagaaatggggttcccggcggtgtactcggagatgcccaggctgctgctcaacctcctcttcctcctcggccacctgcgccgcctctcctcctggctgctccgcctcgtcggcgccggcgtcgacgacgaccacctcagcttcgactactcggacacctccgacttcgcctacttcgccgaccaccaccaggagcaataccaacaccagcaccacgaccacggcctggaggagctggaggagcactccccggccgtgcgcttcgacgcgctcccgtccgacggcgacgacgggacggcgccgctgctgccggagggctgcgcggtgtgcctcggcgacttccacggcgccgcccgggtgcgccggccgcgcgggtgccgccacgtcttccaccgcgggtgcctcgaccgctgggccgcccacggccaccgcacctgcccgctctgccgggcgccgctcctaccgccggcgccggcgtctctgagtcccgtcctcctgcccatgccgctgccggcgtcgtgattggcacagggcgagctcgttcggggtgctgtttgcatatatgttcggcgactattcttgcgggatcctgaggagagggtcccgaatttgtcgcttccggttgggtttttctgcaaaaacaatctcaaccggtgagagcgcggcaagggccaggccaaggaggcccattggcggagaggcgtcgaaatattttccgatcgccccctcgcatggagagattatcacaagacggtccccatggaaggggattagttcctggtttgagctttggttgatttgggtttggactccaatggagttggtctccagagcaaaatccatataccaagaaagaagaaatgaagaatacatatgtatgtacatcagacttagagtagtggaagtaaatagagggggtgaatccaaatatatgcagagcttttgctctgctcacttttcttttccttttcattcttgttataaggtttcactagacccagcatttttcatctttatactactccttctcaaggggttggagac

SEQ ID NO: 415 - protein, 171 aa, Triticum aestivum
  misc_feature: Ceres CLONE ID no.863299
  misc_feature: Bit score of 80.8 for HMM based on sequences of FIGURE 5.
  misc_feature (105)..(147): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPAVYSEMPRLLLNLLFLLGHLRRLSSWLLRLVGAGVDDDHLSFDYSDTSDFAYFADHHQEQYQHQHHDHGLEELEEHSPAVRFDALPSDGDDGTAPLLPEGCAVCLGDFHGAARVRRPRGCRHVFHRGCLDRWAAHGHRTCPLCRAPLLPPAPASLSPVLLPMPLPAS

SEQ ID NO: 416 - DNA, 883 bp, Gossypium hirsutum
  misc_feature: Ceres CLONE ID no.1808334
  misc_feature: Encodes the peptide sequence at SEQ ID NO. 417
attgccagaccttgaaaaatcttacaattttttttatataatttctgttagaaaaaaacccagttcacttttcagttcttggtaccttggctgaccatttttgtttgaattgcaggttaccagggtttagccattgcttttcatttgaagctctcctccccattgtttttaaggtcatatatttattatatattatcagcacaaaaagaaaaaaatgggtctctcaagtcttccagctccatcagaaggagtgttatgtatactcttggtaaacacagctttatctatatctatagttaaaggcataatccgatcgatccttcacgttgtcggtatccatctcccaccaccatcatcggattacactgaaaatctctcggaatcattcgatttccaccttaatactcctgaaagttacattgaggaattccggagtaggaccccaacaattcatttcggtgctgttgtatgtagctgcaaacggcctcagcacgactgtcaggtttgtctgactcagtttgagccaaaatccgagattaaccacttgtcgtgtggccatctctttcacaaggtgtgtttggaaaaatggttggattattggaatattacatgccctctttgcaggactcccttgttgcctgaagaagaagcttcttgctttttgtaagaagattattatcaagtatattattatgcagagttgaggaattcccgtgtacagcgcggtatataaaagtatactgttatctttatcgagtgttgtcgttacccgcaagtttgtaccttgctgtggtgatttgtgttatttgaatcaatgcacatattgttgtctgggttaatgatatgttattatatgcagtctcaaaaaaaaaaaaaaaaaaaa

SEQ ID NO: 417 - protein, 150 aa, Gossypium hirsutum
  misc_feature: Ceres CLONE ID no.1808334
  misc_feature: Bit score of 315.9 for HMM based on sequences of FIGURE 5.
  misc_feature (95)..(136): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPAPSEGVLCILLVNTALSISIVKGIIRSILHVVGIHLPPPSSDYTENLSESFDFHLNTPESYIEEFRSRTPTIHFGAVVCSCKRPQHDCQVCLTQFEPKSEINHLSCGHLFHKVCLEKWLDYWNITCPLCRTPLLPEEEASCFL

SEQ ID NO: 418 - DNA, 945 bp, Gossypium hirsutum
  misc_feature: Ceres CLONE ID no.1855611
  misc_feature: Encodes the peptide sequence at SEQ ID NO. 419
acagccgttacctgacttccaagaccaaacccaaatctcctttcttcatgtttcgttgatcccacgaaaagaaaaatcttgtgtagttcttgttctgggtattttctgcagagccaagttgacccctttttcttttttgtgtgtcttacacattatatgatcatttgttctgctaaaacttagattcatatacaagaaatgggtctctcaagtctgccatctccgtcagaaggaatgctttgtatactgttggtaaacacagctttatccatatctgtaattaaaggcatacttcgatccatccttcacgttgtcggtatccatctctcgtcgctatcaccatccccagattccatcgaaaatgaatcatttgatttccagttcagtacatctgaattttacattgaggagttccggagtaggacgccggcaattcaatttgacactttatgcagttgcaagcgagccgagaatgactgtccggtctgcctgtctgagtttgagcctaaatcggagattaaccgattgtcttgcggccatctctttcacaaggtgtgcttggaaaaatggttgaattatttgaaagttacttgccctctttgcaggactcctctgctgccggaagaagagagttgctgcttggggtgagaacattaagaagcatgatgagtatgaggaaatttgaatgtacagcgtgtttatggtatatgggtatataaattaaatgtgatgagcattggcttagtgctaagctacccgcaagttttaacttgatgtggtgatgtgctaatgaatgtacatgttctcgaggtttctaatgttatatgcgaatctcattctgtcttttccattctaagattgggtatattcactatttggaagatcataacctcatattcaaatatcagcgttggacacttaggttaaaaaaaaaaaaaaaaaaaa

SEQ ID NO: 419 - protein, 149 aa, Gossypium hirsutum
  misc_feature: Ceres CLONE ID no.1855611
  misc_feature: Bit score of 266.5 for HMM based on sequences of FIGURE 5.
  misc_feature (94)..(135): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPSPSEGMLCILLVNTALSISVIKGILRSILHVVGIHLSSLSPSPDSIENESFDFQFSTSEFYIEEFRSRTPAIQFDTLCSCKRAENDCPVCLSEFEPKSEINRLSCGHLFHKVCLEKWLNYLKVTCPLCRTPLLPEEESCCLG

SEQ ID NO: 420 - DNA, 688 bp, Gossypium hirsutum
  misc_feature: Ceres CLONE ID no.1845975
  misc_feature: Encodes the peptide sequence at SEQ ID NO. 421
ctgccagccgttacctgacttcaaaaaccaagcccaaatctcctttcttcatgtttcattgatctcacgaaaagaaagatcttgtttagttcttgttctgggtattttctgcagagcaaagttgaccccttttcctttggtcttacacattatatgatcatttgttcagctaaaacttagattcatatacaagaaatgggtctctcaagtctgccatctccgtcagaaggaatgctatgtataatcttggtaaacacagctttatccatatctgtaattaaaggcatacttcgatccatccttcacgttgtcggtatccatctctcgtcgttatcaccatccccggattccatcgaaaatgaatcatttgatttccagttcagtacatctgaattttacattgaggagttccggagtaggacgccggcaattcaatttgacactttatgcagttgcaagcgagctgagaatgactgtccggtctgcctgtctgagtttgagcctaaatcggagattaaccgattgtcttgcggccatctctttcacaaggtgtgcttggaaaaatggttgaattatttgaaagttacttgccctctttgcaggactctgctgctgccggaagaagagagttgctacttgggataagaatattaagaagcatgatgagtatgaggaaatttgaatgtac

SEQ ID NO: 421 - protein, 149 aa, Gossypium hirsutum
  misc_feature: Ceres CLONE ID no.1845975
  misc_feature: Bit score of 265.1 for HMM based on sequences of FIGURE 5.
  misc_feature (94)..(135): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPSPSEGMLCIILVNTALSISVIKGILRSILHVVGIHLSSLSPSPDSIENESFDFQFSTSEFYIEEFRSRTPAIQFDTLCSCKRAENDCPVCLSEFEPKSEINRLSCGHLFHKVCLEKWLNYLKVTCPLCRTLLLPEEESCYLG

SEQ ID NO: 422 - DNA, 886 bp, Gossypium hirsutum
  misc_feature: Ceres CLONE ID no.1808298
  misc_feature: Encodes the peptide sequence at SEQ ID NO. 423
acagcctgccagccgttacctgacttcaaaaaccaagcccaaatctcctttcttcatgtttcattgatctcacgaaaagaaagatcttgtttagttcttgttctgggtattttctgcagagcaaagttgaccccttttcctttggtcttacacattatatgatcatttgttcagctaaaacttagattcatatacaagaaatgggtctctcaagtctgccatctccgtcagaaggaatgctatgtataatcttggtaaacacagctttatccatatctgtaattaaagacatacttcgatccatccttcacgttgtcggtatccatctctcgtcgttatcaccatccccggattccatcgaaaatgaatcatttgatttccagttcagtacatctgaattttacattgaggagttccggagtaggacgccggcaattcaatttgacactttatgcagttgcaagcgagctgagaatgactgtccggtctgcctgtctgagtttgagcctaaatcggagattaaccgattgtcttgcggccatctctttcacaaggtgtgcttggaaaaatggttgaattatttgaaagttacttgccctctttgcaggactctgctgctgccggaagaagagagttgctacttgggataagaatattaagaagcatgatgagtatgaggaaatttgaatgtacagcgtgtttatggtatatgggtatataaattaaatgtaatgagcattggcctagtgctaagctacccgcaagttttaacttgatgtggtgatgtgctaatggatgtacatgttttcaaagtttctaatgttatatgcgaatctcaagtcttttccatttctaaaaaaaaaaaaaaaaaaaaaaaaaaaaaaaa

SEQ ID NO: 423 - protein, 149 aa, Gossypium hirsutum
  misc_feature: Ceres CLONE ID no.1808298
  misc_feature: Bit score of 263.7 for HMM based on sequences of FIGURE 5.
  misc_feature (94)..(135): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPSPSEGMLCIILVNTALSISVIKDILRSILHVVGIHLSSLSPSPDSIENESFDFQFSTSEFYIEEFRSRTPAIQFDTLCSCKRAENDCPVCLSEFEPKSEINRLSCGHLFHKVCLEKWLNYLKVTCPLCRTLLLPEEESCYLG

SEQ ID NO: 424 - DNA, 1083 bp, Gossypium hirsutum
  misc_feature: Ceres CLONE ID no.1841236
  misc_feature: Encodes the peptide sequence at SEQ ID NO. 425
attgccagaccttgaaaaagcttacaattttttttttatatataatttctgctggaaaaaaacccagttcccttttcagttcttggtaccttggctgaccatttttgtgttaccagggtttagccattacttttcatttgaagctgtcctccccattgtttttaaggtcatatattatatattatcagcacaaaaagaaaaaaatgggtctctcaagtcttccagctccatcagaaggagtgttatgtatactcttggtaaacacagctttatctatatctatagttaaaggcataatccgatcgatccttcacgttgtcggtatccatctcccacaaccaccatcggattacactgaaaatccctcggaagcgaatgatttccaccttaatactcctgaaagttacatcgaggaattccggagtaggaccccaacaattcatttcggtgctgttttatgtagctgcaaacggcctcagcacgactgtcgggtttgtctgactcagtttgagccaaaatccgagattaaccacttgtcgtgtggtcatctctttcacaaggtgtgtttggaaaaatggttggattattggaatattacatgccctctttgcaggactcctttgttgactgaagaagaagcttcttgcttttggtaagaagattattaccaagtatattattatgcagagttgaggaattcccgtgtacagcgcggtatataaaaatatactgttatctttatcattctgggttttgtgataggcaagcgagtgttgtcgttacccgcaagtttgtaccttgctgtggtgatttgtgttatttgaatcaatgcacatattgttgtctgggttaatgatatgttattatatgcagtctcacacttgtttcttgatcatccacatatatatagttcatggagattttgtttaattttttgcctttttatgcaatgggaaagattgaaaattgagttaggaagttgctgggactaaaatctgtttgacaggatctgccttgtaatgaacttagctgttctataaaaaaaaaaaaaaaaaaaaaaaaaaaaaaaaaaaaaaaaaaaaa

SEQ ID NO: 425 - protein, 150 aa, Gossypium hirsutum
  misc_feature: Ceres CLONE ID no.1841236
  misc_feature: Bit score of 299.2 for HMM based on sequences of FIGURE 5.
  misc_feature (95)..(136): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPAPSEGVLCILLVNTALSISIVKGIIRSILHVVGIHLPQPPSDYTENPSEANDFHLNTPESYIEEFRSRTPTIHFGAVLCSCKRPQHDCRVCLTQFEPKSEINHLSCGHLFHKVCLEKWLDYWNITCPLCRTPLLTEEEASCFW

SEQ ID NO: 426 - DNA, 1043 bp, Gossypium hirsutum
  misc_feature: Ceres CLONE ID no.1808269
  misc_feature: Encodes the peptide sequence at SEQ ID NO. 427
atcacctcacttcagaaaagcttacatgtttactttctgttaaaacccagttttcttttccttatgcttcactgatcccatgaaaatttgtcctctttttgtgtcatatatatctgcaagagagtgacatcatttatatccttaacttgttcatacaatcatttgttcgaatacacatagcttaatcttgatacaaaagaatgggtctctcaagtctcccagccccatcagaaggagtgctatgtgtactcttggtaaacacagctttatccatatctatggttaaaggcataattcgatcaatccttcacgttgtcggtatccatctctcctcctcctcgtcctcctcctcctcgtcatcatcatcatcaccgccatcctcggatcttattgaaatccctgcggtatcattcgacatcagcatcggtaatgctgatagttacattaaagagttccggagcaggatgccatcgacccggtacgatgcggtatgtagcggcagtcaaccggagcatgactgttcagtttgcctgactaggttcgaaccagaatcagagattaaccgcttgtcctgcggtcatctgtttcacaaggtatgcttggaaaagtggttgaactattggaatgtcacatgccctctttgcaggaacgctctgctgcccgaagatgatccggcctacttttggtgagcatgcggagattttcgaattttccatgtacagcgcgtttattgtacaggtattttaaatgaaacgatgccgccctcggattagcgttaagcggagtgtggttattacccgcgagatgtggtgatgtttttgttactgaatgtacatttacttttttcagggtttctgaacttgtatgctcatctcacttatgttcggttcatccagattttgttatgtctcctgttttcgattagtggaatcaaaatctggtgacagacaggattactgccttgtaatggctgtagctgttgttgtgtaatatgataatgtcaggtttctgatgttattttttaaaaaaaaaaaaaaaaaaaa

SEQ ID NO: 427 - protein, 162 aa, Gossypium hirsutum
  misc_feature: Ceres CLONE ID no.1808269
  misc_feature: Bit score of 274.8 for HMM based on sequences of FIGURE 5.
  misc_feature (107)..(148): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPAPSEGVLCVLLVNTALSISMVKGIIRSILHVVGIHLSSSSSSSSSSSSSSPPSSDLIEIPAVSFDISIGNADSYIKEFRSRMPSTRYDAVCSGSQPEHDCSVCLTRFEPESEINRLSCGHLFHKVCLEKWLNYWNVTCPLCRNALLPEDDPAYFW

SEQ ID NO: 428 - DNA, 925 bp, Gossypium hirsutum
  misc_feature: Ceres CLONE ID no.1850628
  misc_feature: Encodes the peptide sequence at SEQ ID NO. 429
atcactcacttcagaaaagcttacatgtttactttctgttaaaacccagttttcttttccttatgcatcactgatcccatgaaaatttgtcctctttttgtgtcatatatatctgcaagagagtgacatcatttatatccttaactagttcatataatcatttgttcgaataaacttagcttaatcttgatataaaagaatgggtctctcaagtctcccagccccatcagaaggagtgctatgtgtactcttggtaaacacagctttatccatatctatggttaaaggcataattcgatcaatccttcacattatcggtatccatctctcctcgtcctcgtcctcctcctcctcctcgtcatcatcatcatcatcatcatcatcgccatcctcggatcttattgaaatccctgcggtatcattcgacatcagcatcggtaatgctgatagttacattaaagagttccggagcaggatgccatcgacccggtacgatgcggtatgtagcggcagtcaaccggagcatgactgttcagtttgcctgactaggttcgagccagaatcagagattaaccgcttgtcctgcggtcatctgtttcacaaggtatgcttggaaaagtggttgaactattggaatgtcacatgccctctttgcaggaacgctctgctgcccgaagacgatccggcctacttttggtgagcgtgcggagattttcgaattttccatgtacagcgcgtttattgtacaggtattttaaatgaaacgatgccgccctcggattagcgttaagcggagtggggttattacccgcgagatgtggtgatgtttttgttactgaatgtacatatacttttttcagggtttctgaagttgtatgctcatctcacttatgttcggttcatccagattttgttatgtctcctg

SEQ ID NO: 429 - protein, 166 aa, Gossypium hirsutum
  misc_feature: Ceres CLONE ID no.1850628
  misc_feature: Bit score of 273.7 for HMM based on sequences of FIGURE 5.
  misc_feature (111)..(152): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPAPSEGVLCVLLVNTALSISMVKGIIRSILHIIGIHLSSSSSSSSSSSSSSSSSSSPSSDLIEIPAVSFDISIGNADSYIKEFRSRMPSTRYDAVCSGSQPEHDCSVCLTRFEPESEINRLSCGHLFHKVCLEKWLNYWNVTCPLCRNALLPEDDPAYFW

SEQ ID NO: 430 - DNA, 902 bp, Gossypium hirsutum
  misc_feature: Ceres CLONE ID no.1846911
  misc_feature: Encodes the peptide sequence at SEQ ID NO. 431
attctgtttttattttttaattctgttattactttttttttttgttcatcaatgggattccctgtggtttacacagacgttttcgtacccaaattcttcgttcacacgctatcgtttttgggtttcatcagaaacctaatcctctcactttttaattacctcggactctccgatttcctcgaaaccgacaccgattggccggaaaacccaacccgaaccacacctttgaaaccgccggtacccgctctcttgatccgtgaaatcctagccgtcgtaaagttcgaggaactcgcggtggtcggtggtagtgatccaccggagagttgcgccgtttgcttgtgcgagttcgaaggaaaggaagagatcaggtggttgaagaattgtaagcatgtttttcatagaacgtgtttggaccgctggatggatcacgatcaggtgacgtgtccgctttgtaggacatcgtttgtacctgatgagatgcaagctgaatttaatcaacggctctgggcagcttctggaatcgtcgatatttacagtgagtacggttccgttgccgggttgtaaattttgtgttatccatttagtttagtgaaaaaattgtacattataaatgtacacggatcaaaacagtatcccttttttaggcttaaattttatatattcgaaaagaattagataaattttaggttaaaaatatggcttttgggttcttaagaattcaataaaatccaccattttattttttcttactctttttatacctataattttgctcgcatttcattttctttattttttatacattattgattattctgtaccgaccgaaatttatatgttttgtttttttaaaacatataaaagaatacattaaaattaaccaaaaaaaaaaaaaaaaaaaa

SEQ ID NO: 431 - protein, 170 aa, Gossypium hirsutum
  misc_feature: Ceres CLONE ID no.1846911
  misc_feature: Bit score of 193.7 for HMM based on sequences of FIGURE 5.
  misc_feature (92)..(134): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVVYTDVFVPKFFVHTLSFLGFIRNLILSLFNYLGLSDFLETDTDWPENPTRTTPLKPPVPALLIREILAVVKFEELAVVGGSDPPESCAVCLCEFEGKEEIRWLKNCKHVFHRTCLDRWMDHDQVTCPLCRTSFVPDEMQAEFNQRLWAASGIVDIYSEYGSVAGL

SEQ ID NO: 432 - DNA, 660 bp, Gossypium hirsutum
  misc_feature: Ceres CLONE ID no.1916014
  misc_feature: Encodes the peptide sequence at SEQ ID NO. 433
attttatctaccactcaagtcggaaaccatagcttatctcacattgtatctaaagttagaacaaaaacatgggtttcccagtagcctactcagagcttcttcttccaagattgcttctccacacgctttctctccttgcttaccttcgcaaatttatttccactctcttcctctatttgggtctccccgatttcctcgaacccgacattccttggcgcgaatacgcccctgaaacccaccacgcttccgccgcccccgtctctgctctcctcatccgggaactcctacccgtcgtcaagttctccgacctcgtcgacccgccggagagctgcgccgtgtgcttgtacgacttcgaagggcaggatgagatcaggcggctgactaactgccgccatattttccatcggagctgtttggaccgttggatggggtatgatcagaaaacatgtccgctttgtagaacaagtattgttcctgatgatatgcaacaaacgtttaatgagaggctgtgggctgcctctgggatccctgaagtctttggtgattattctcaaattactgctttgtagttatacctgtgcttcccaacaaaaaaaaagaggcttttttgtttatcatcttataaggagttggtttgtatatatacatgaaaatccgggg

SEQ ID NO: 433 - protein, 166 aa, Gossypium hirsutum
  misc_feature: Ceres CLONE ID no.1916014
  misc_feature: Bit score of 194.7 for HMM based on sequences of FIGURE 5.
  misc_feature (88)..(130): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVAYSELLLPRLLLHTLSLLAYLRKFISTLFLYLGLPDFLEPDIPWREYAPETHHASAAPVSALLIRELLPVVKFSDLVDPPESCAVCLYDFEGQDEIRRLTNCRHIFHRSCLDRWMGYDQKTCPLCRTSIVPDDMQQTFNERLWAASGIPEVFGDYSQITAL

SEQ ID NO: 434 - DNA, 895 bp, Gossypium hirsutum
  misc_feature: Ceres CLONE ID no.1842594
  misc_feature: Encodes the peptide sequence at SEQ ID NO. 435
ttatttttggttttaaatgtaaggattttcttggtttcccattagaatgaaatagaaggtaacgggaaaaccgaaggaaccgcaagttaaaaacaagagaaagacgaggattccgtattcttttcttgggggagcagtgaaaaaaacacttcccggtatttcttgtcagttcttttatttttttatctatcactcaagaagaaagaaaacccaaagcgtcggaaaccatagcttatctcacattgtatctaaagttagaacaaaaacatgggtttcccagtagcctactccgagcttcttcttccaagattgcttctccacacgctttctctccttgcttaccttcgcaaattcatttccactctcttcctctatttgggtctccccgatttcctcgaacctgacattccttggggcgaatacgcccctgaaacccaccacgcttccgccgcccccgtatctgctctcctcatccgggaactcctacccgtcgtcaagttctccgacctcgttgacccgccggagagctgcgccgtgtgcttgtacgacttcgaagggcaggatgagatcaggcggctgaccaactgccgccatattttccatcggagctgtttagaccgttggatggggtatgatcagaaaacatgtccgctttgtagaacaagttttgttcctgatgatatgcaacaaacgtttaatgagaggctgtgggctgcctctgggatccctgaagtctttggtgattattctcaaattactgctttgtagttatacctgtctgcttcccaacaaaaaaaaatgaagcttttttgtttatcacctttttaaggagttggtttgtatatatacatgaaaatccgggaaattaccgccatgaaaaaaaaaaaaaaaaaaa

SEQ ID NO: 435 - protein, 166 aa, Gossypium hirsutum
  misc_feature: Ceres CLONE ID no.1842594
  misc_feature: Bit score of 197.4 for HMM based on sequences of FIGURE 5.
  misc_feature (88)..(130): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVAYSELLLPRLLLHTLSLLAYLRKFISTLFLYLGLPDFLEPDIPWGEYAPETHHASAAPVSALLIRELLPVVKFSDLVDPPESCAVCLYDFEGQDEIRRLTNCRHIFHRSCLDRWMGYDQKTCPLCRTSFVPDDMQQTFNERLWAASGIPEVFGDYSQITAL

SEQ ID NO: 436 - DNA, 462 bp, Populus balsamifera subsp. trichocarpa
  misc_feature: Ceres ANNOT ID no.1525600
  misc_feature: Encodes the peptide sequence at SEQ ID NO. 437
atgggtctatcaagtctgccagctccatctgaaggagtattatgtgtgcttttagtaaacactgccttgtcaatttccattgtcaaaggaatagtccgttcaatccttcatattgttggcatccgtttgtcaccatctgcatcactcccatcgtcagataatgctgaagacaccagagagtcgcttgaatttcgtttaagtcccccagagaattacattgaggagttccgaagcaggatgccatcaatccgattcaacacggtgtgcagctgtgaacagcctgaacatgactgctcggtttgcctgacccaatttgagccagaatcggagataaatagcctgtcatgtggccatatctttcataaaatgtgcttggagaagtggttggactattggaacattacatgccctctttgcaggactcctttgctgcctgaagaggatgcatcttgcttttggtga

SEQ ID NO: 437 - protein, 153 aa, Populus balsamifera subsp. trichocarpa
  misc_feature: Ceres ANNOT ID no.1525600
  misc_feature: Bit score of 324.5 for HMM based on sequences of FIGURE 5.
  misc_feature (98)..(139): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPAPSEGVLCVLLVNTALSISIVKGIVRSILHIVGIRLSPSASLPSSDNAEDTRESLEFRLSPPENYIEEFRSRMPSIRFNTVCSCEQPEHDCSVCLTQFEPESEINSLSCGHIFHKMCLEKWLDYWNITCPLCRTPLLPEEDASCFW

SEQ ID NO: 438 - DNA, 717 bp, Populus balsamifera subsp. trichocarpa
  misc_feature: Ceres ANNOT ID no.1472192
  misc_feature: Encodes the peptide sequence at SEQ ID NO. 439
atgggtctatcaagtctgccagctccatctgaaggagtattatgtgtgcttttagtaaacactgccttgtcaatttccattgtcaaaggaatagtccgttcaatccttcatattgttggcatccgtttgtcaccatctgcatcactcccatcgtcagataatgctgaagacaccagagagtcgcttgaatttcgtttaagtcccccagagaattacattgaggagttccgaagcaggatgccatcaatccgattcaacacggtgtgcagctgtgaacagcctgaacatgactgctcggtttgcctgacccaatttgagccagaatcggagataaatagcctgtcatgtggccatatctttcataaaatgtgcttggagaagtggttggactattggaacattacatgccctctttgcaggactcctttgctgcctgaagaggatgcatcttgcttttgcgtgtacatgtatttacgtgagtgcatcgggcagggcatagtggcaatgccagataaccagggttctttctactttatggcatggagtcaaaaacatcaatttagggccgtttcatctcccaataaaaactgggtctcatcttgtttcatcgagctgcttcccgacactgctcgtgctaatggagaacctggctggacttcccttcacaagaactgcgaagtaaggcatgacatcagaagatgtggaagctggtcctga

SEQ ID NO: 439 - protein, 238 aa, Populus balsamifera subsp. trichocarpa
  misc_feature: Ceres ANNOT ID no.1472192
  misc_feature: Bit score of 319.4 for HMM based on sequences of FIGURE 5.
  misc_feature (98)..(139): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSLPAPSEGVLCVLLVNTALSISIVKGIVRSILHIVGIRLSPSASLPSSDNAEDTRESLEFRLSPPENYIEEFRSRMPSIRFNTVCSCEQPEHDCSVCLTQFEPESEINSLSCGHIFHKMCLEKWLDYWNITCPLCRTPLLPEEDASCFCVYMYLRECIGQGIVAMPDNQGSFYFMAWSQKHQFRAVSSPNKNWVSSCFIELLPDTARANGEPGWTSLHKNCEVRHDIRRCGSWS

SEQ ID NO: 440 - DNA, 519 bp, Populus balsamifera subsp. trichocarpa
  misc_feature: Ceres ANNOT ID no.1447489
  misc_feature: Encodes the peptide sequence at SEQ ID NO. 441
atgggttttcctgtaggctattcagaaatagttctcccaaaactcctcctccacacactttctttcctgggtttcattagaaaactgataaacactctctttcactgcataggtctccctgactttcttgaaccgggcatttcttcctcttcttcaactgagaatacccccccatttcgtgtccctgactttcacagtcactctgtttctgcccttctgatacgcgagatccttcctgttgtcaagttttcggagcttgttgatccttctgctgatagctgtgctgtttgtctgtacgagtttgaagagtccgacgagatcagacggcttgcaaactgtcgccatatattccacaaatgctgtttggaccgttggatggggtatgatcagataacttgtccactttgtaggacacacgttattcccgatgatatgcaagagagtttcaatgaaaggctatgggctgcttctgctattactgatttttatggggagtattcacaaatccctggcttgtag

SEQ ID NO: 441 - protein, 172 aa, Populus balsamifera subsp. trichocarpa
  misc_feature: Ceres ANNOT ID no.1447489
  misc_feature: Bit score of 184.5 for HMM based on sequences of FIGURE 5.
  misc_feature (94)..(136): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYSEIVLPKLLLHTLSFLGFIRKLINTLFHCIGLPDFLEPGISSSSSTENTPPFRVPDFHSHSVSALLIREILPVVKFSELVDPSADSCAVCLYEFEESDEIRRLANCRHIFHKCCLDRWMGYDQITCPLCRTHVIPDDMQESFNERLWAASAITDFYGEYSQIPGL

SEQ ID NO: 442 - DNA, 420 bp, Populus balsamifera subsp. trichocarpa
  misc_feature: Ceres ANNOT ID no.1513000
  misc_feature: Encodes the peptide sequence at SEQ ID NO. 443
atggggctctcaagtttccctggtgcagcaggagtgctaccagagttactcatgaacacaatcttattagtggctctactgaaaaacacggtgaggtcagtgctgcaagtgatggcaggtgctaactggacacctccagattacgaggaagagccagatggacatccacaagaaaatgcaagagagagaagaatgtcaataacccagttcaagagcttgcagcagaatcatgatggcacaagctatagggttagtactgcaatggaatgttgtgtgtgtctgtgtggatttcaagctgaagaagaggtgagtgagctgcattgcaagcatttcttccacagaggttgtttagacaagtggtttgataacaaacaggctacttgccctctttgtcgatctatcattttattagattcataa

SEQ ID NO: 443 - protein, 139 aa, Populus balsamifera subsp. trichocarpa
  misc_feature: Ceres ANNOT ID no.1513000
  misc_feature: Bit score of 136.2 for HMM based on sequences of FIGURE 5.
  misc_feature (90)..(131): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGLSSFPGAAGVLPELLMNTILLVALLKNTVRSVLQVMAGANWTPPDYEEEPDGHPQENARERRMSITQFKSLQQNHDGTSYRVSTAMECCVCLCGFQAEEEVSELHCKHFFHRGCLDKWFDNKQATCPLCRSIILLDS

SEQ ID NO: 444 - DNA, 516 bp, Populus balsamifera subsp. trichocarpa
  misc_feature: Ceres ANNOT ID no.1438658
  misc_feature: Encodes the peptide sequence at SEQ ID NO. 445
atgggttttcctgttggctattcagaactacttctcccaaaactccttctccacgcactttctgttctgggtttcttcagaaaactaataaacactctctttcactacctaggcctccctgactttcttgaacccaatacctcttcctcttcaaccaacaatatccctccatttggtgtccctgaattccacaaccactcagtctccgcccttctcatccgtgagatccttcctgttgtcaagttttcagaacttgttgatccttctgctgactgctgtgctgtttgtctttatgagtttaaagaggttgatgagatcagacggcttgcaaactgtcgccatatatttcacaagtgctgtttggaccgttggatggggtacgatcagataacttgtccactttgtaggacaccagtaattcctgatgatatgcaggagagtttcaacgaaaggttatgggctgcttctggtattcctgatttttatggggagtattcacaaactcctgacttttag

SEQ ID NO: 445 - protein, 171 aa, Populus balsamifera subsp. trichocarpa
  misc_feature: Ceres ANNOT ID no.1438658
  misc_feature: Bit score of 173.1 for HMM based on sequences of FIGURE 5.
  misc_feature (93)..(135): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYSELLLPKLLLHALSVLGFFRKLINTLFHYLGLPDFLEPNTSSSSTNNIPPFGVPEFHNHSVSALLIREILPVVKFSELVDPSADCCAVCLYEFKEVDEIRRLANCRHIFHKCCLDRWMGYDQITCPLCRTPVIPDDMQESFNERLWAASGIPDFYGEYSQTPDF

SEQ ID NO: 446 - DNA, 498 bp, Populus balsamifera subsp. trichocarpa
  misc_feature: Ceres ANNOT ID no.1497255
  misc_feature: Encodes the peptide sequence at SEQ ID NO. 447
atggggtttccagttgggtattcagaggttttcttaccaaagttgtttgtacacatactttcctttctgggttttatcagaaacctcattctgtgtcttttcaactatctggggttgtcaggttttcttgaaacagacaatatttggcccgacaacccgatccgaatgtcctgctacccgcctctatcagctgcccttctccgggaaatcttgcctgtcatcaagttcgaggatttggttactggggatggtggttgttgtgacttgccggagagttgtgctgtttgtttgtatgagtttgagggagaggatgagatcaggtggttgaagaattgtaagcacatttttcacaggacttgtttggaccgttggatggatcatgataggaaaacgtgtccactttgcaggaactcgtttgtgcctgatgagatgcaggaagagtttaatcaacggttatgggctgcaaataatgatgttagtgatttttactgtgagtag

SEQ ID NO: 447 - protein, 165 aa, Populus balsamifera subsp. trichocarpa
  misc_feature: Ceres ANNOT ID no.1497255
  misc_feature: Bit score of 180.7 for HMM based on sequences of FIGURE 5.
  misc_feature (93)..(135): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYSEVFLPKLFVHILSFLGFIRNLILCLFNYLGLSGFLETDNIWPDNPIRMSCYPPLSAALLREILPVIKFEDLVTGDGGCCDLPESCAVCLYEFEGEDEIRWLKNCKHIFHRTCLDRWMDHDRKTCPLCRNSFVPDEMQEEFNQRLWAANNDVSDFYCE

SEQ ID NO: 448 - DNA, 504 bp, Sorghum bicolor
  misc_feature: Ceres ANNOT ID no.6092104
  misc_feature: Encodes the peptide sequence at SEQ ID NO. 449
atgggcatctcgagcatgccggcgcccaaggacagcctgctggggttcgtgctgtacaacgcggcggcgtccgtcgcgatcctgtcgggtctggtgcgcgccgcgctgctcttcctgggcgtggcggcggcgccgtcgtcgtccccgtgggaagcgccggaggaggagcggcggcagcagcagcagggggcggtgagggtcacgcccgtggggcccaccctcgcggaccggttccggagcaggttccgtccgtcgcgcttcgggcggcgccgcggctgcggcggttcgggggactgccgcgtgtgcctggtgcggttcgagccggagtcggtggtcaaccggctcccctgcggccacctcttccaccgcgcatgcctcgagacctggctcgactacgaccacgccacctgcccgctctgccgtcaccgcctcctgccccccgccgcagacgacgacgagctcccccggatcgtcgcggcgccccgccgcctcgtccggttctag

SEQ ID NO: 449 - protein, 167 aa, Sorghum bicolor
  misc_feature: Ceres ANNOT ID no.6092104
  misc_feature: Bit score of 258.2 for HMM based on sequences of FIGURE 5.
  misc_feature (99)..(140): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPAPKDSLLGFVLYNAAASVAILSGLVRAALLFLGVAAAPSSSPWEAPEEERRQQQQGAVRVTPVGPTLADRFRSRFRPSRFGRRRGCGGSGDCRVCLVRFEPESVVNRLPCGHLFHRACLETWLDYDHATCPLCRHRLLPPAADDDELPRIVAAPRRLVRF

SEQ ID NO: 450 - DNA, 462 bp, Sorghum bicolor
  misc_feature: Ceres ANNOT ID no.6041700
  misc_feature: Encodes the peptide sequence at SEQ ID NO. 451
atggggatctcgagcatgccggagccgcgggacagcctgctgtggtacctggtggtcaacacggtgatctcgatcacggcgctggcggggctggtgcgcaaggcgctggtgttcctggacctccaggacgacgacgccggggaccgcctcgtggcgtcagcgcccggcctgggcctggcggaccggttcctgagggcgttccggccggcgctgtacggggtgctggtgtcgacgtcgacgacgtgcagcgcggcggaggcggacggcgacgactgcagcgtgtgcctgtccggtttcgtggccaaggccgtggtgaaccgcctcccctgcggccacctcttccaccgcgcctgcctcgagacctggctccggtacgagcgcgccacgtgcccgctctgccgcgccaacgtgcccctcccgcccgaagagacgcccgtgctccgctacccggagctcgagtga

SEQ ID NO: 451 - protein, 153 aa, Sorghum bicolor
  misc_feature: Ceres ANNOT ID no.6041700
  misc_feature: Bit score of 148.0 for HMM based on sequences of FIGURE 5.
  misc_feature (92)..(133): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGISSMPEPRDSLLWYLVVNTVISITALAGLVRKALVFLDLQDDDAGDRLVASAPGLGLADRFLRAFRPALYGVLVSTSTTCSAAEADGDDCSVCLSGFVAKAVVNRLPCGHLFHRACLETWLRYERATCPLCRANVPLPPEETPVLRYPELE

SEQ ID NO: 452 - DNA, 669 bp, Sorghum bicolor
  misc_feature: Ceres ANNOT ID no.6007297
  misc_feature: Encodes the peptide sequence at SEQ ID NO. 453
atgggtttcccggtgggttactcggagctggtgctcccgaagcagctgctccacctcctcctgctcctggggtacatccgccgcttcctcctctgggcgttcgacgccgtggggctcggcgacctgctggatctcggggacgaccaccaccaggcgctgctgcagcaggaccaccaccacggcgacgcgcaggggcgggaccaccacggcgcgctggcgctgccgcatcaggcggcggcgatgctgctgcagcagcaccgacggccggagttccgggcggtgccggcgatggtcatcgaggaggtcctccccgtggtgcggttcgacgagctggaggaggcgcgcgtcggcggggactgcgccgtttgcctcagcggcatcggaggccgcgacgaggtgcgccggctcagcaactgccgccacgtcttccaccgcgcctgcctggaccgctggatggagcacgaccagcgcacctgcccgctctgccgcgcgccgctcatccccgacgagatggccggcgcgctctgggccgccgccgcgggcgtccccgacgcctccgacttcgacttctcctacttcggcgcgacgccgctgacgacgcccgtgccctccccgacgctgctgcggccgcacgagctgctgctcaccggcctgggcggataccagtga

SEQ ID NO: 453 - protein, 222 aa, Sorghum bicolor
  misc_feature: Ceres ANNOT ID no.6007297
  misc_feature: Bit score of 180.4 for HMM based on sequences of FIGURE 5.
  misc_feature (120)..(162): Pfam Name: zf-C3HC4 Pfam Description: Zinc finger, C3HC4 type (RING finger)
  misc_feature: Functional Homolog Of Ceres SEEDLINE ID no. ME10852 at SEQ ID NO. 337
MGFPVGYSELVLPKQLLHLLLLLGYIRRFLLWAFDAVGLGDLLDLGDDHHQALLQQDHHHGDAQGRDHHGALALPHQAAAMLLQQHRRPEFRAVPAMVIEEVLPVVRFDELEEARVGGDCAVCLSGIGGRDEVRRLSNCRHVFHRACLDRWMEHDQRTCPLCRAPLIPDEMAGALWAAAAGVPDASDFDFSYFGATPLTTPVPSPTLLRPHELLLTGLGGYQ

SEQ ID NO: 454 - DNA, 1505 bp, Arabidopsis thaliana
  misc_feature: Ceres SEEDLINE ID no.ME11939
  misc_feature: Genomic Sequence
  misc_feature: Expected Sequence
  misc_feature: Encodes the peptide sequence at SEQ ID NO. 456
atgtgtagcaacaaagcaagtccggtcgtcggagaagaaaaacagagtacgagatcatcgaagaggatcaagaagagaaaaaacagagaagctaccaccaccatggaggataagtcttcttccaatcttgacgcgtctcgtaagatcagaacaaaaacgaaaaaacccaaatttctcagtctcaagctcgagctcaacacttctcacgagatcaacgagaatcccagaagcaagaagagcaagaagaagaacaacaacaaaaaacagagcaagaagaaagaaccggatacgacgccgtttaaggagaagaagagagcagagactactactacactggggggaggagagaaagaagaagagcaatacgacaccgttgcagcttacctcttcaattccgccaccgacagtacaatttcttcgatccacgatctcctcccttcctccgcggccaccgatgtagattgcggcggagaaaggaataatctttctccgtatgatcgtcaagaccacggatcgtcgtcgtcttcccttctaaggacggcgatgaggaaaggagcgagcgaggaggaggagacgacggaggagcggtgggtgagttattcagaggttgtggaggaagtgatgagtcggagcgggactccacgttgttgcggcggaggcgatggaaacgatggccggccttcgttggctctgaagcttgattatgagcagatcatggaggcttggtcggataaaggtacgctttatgtcgacggagaaccgccgcagacagtgccggacttgcatgcttccgctgatgtaagcaaaccatctctctatttgtctttttctctggtattatataatcataatcaatgcttaaattgactaattaatttgacatatgtaaaaccggtgaaatattgaatgagtcacgagttcttttgccactgtaatgatgataatcttattaatgtattgtttttcacttctgagatacttgtaatatttaagctttgactagaaagttgtaacggcagactgaaatacttaaattgcgaaaacgcttaaattatacacattgttgctagtaattaagcaagatttgatagtagagttgtgttggtggtcttaggggtttaatgacggcggagaggcggggaatttatgggcagtgccggagatggaaacgacggagaggttatggagagggcatagagaagccagcttgctccggtataaagagaaacggcaaaaccgtcttttctctaagcggattcgatatcaagttcgtaaactcaatgccgagaaacgtcctcgtgttaaagtaagcttttcttctagtagtttgtttttttaaacaattttcacacacatttgagtccaatacatgacgtagaattatatttaaatgattgaactcgctgagagaactagaattggttgatacgtggagttgctgataattaataataagtcattggtttttttttcagggccggtttgtaaaaagagaggattcataa

SEQ ID NO: 455 - DNA, 1020 bp, Arabidopsis thaliana
  misc_feature: Ceres SEEDLINE ID no.ME11939
  misc_feature: Predicted Sequence
  misc_feature: Encodes the peptide sequence at SEQ ID NO. 456
atgtgtagcaacaaagcaagtccggtcgtcggagaagaaaaacagagtacgagatcatcgaagaggatcaagaagagaaaaaacagagaagctaccaccaccatggaggataagtcttcttccaatcttgacgcgtctcgtaagatcagaacaaaaacgaaaaaacccaaatttctcagtctcaagctcgagctcaacacttctcacgagatcaacgagaatcccagaagcaagaagagcaagaagaagaacaacaacaaaaaacagagcaagaagaaagaaccggatacgacgccgtttaaggagaagaagagagcagagactactactacactggggggaggagagaaagaagaagagcaatacgacaccgttgcagcttacctcttcaattccgccaccgacagtacaatttcttcgatccacgatctcctcccttcctccgcggccaccgatgtagattgcggcggagaaaggaataatctttctccgtatgatcgtcaagaccacggatcgtcgtcgtcttcccttctaaggacggcgatgaggaaaggagcgagcgaggaggaggagacgacggaggagcggtgggtgagttattcagaggttgtggaggaagtgatgagtcggagcgggactccacgttgttgcggcggaggcgatggaaacgatggccggccttcgttggctctgaagcttgattatgagcagatcatggaggcttggtcggataaaggtacgctttatgtcgacggagaaccgccgcagacagtgccggacttgcatgcttccgctgatgggtttaatgacggcggagaggcggggaatttatgggcagtgccggagatggaaacgacggagaggttatggagagggcatagagaagccagcttgctccggtataaagagaaacggcaaaaccgtcttttctctaagcggattcgatatcaagttcgtaaactcaatgccgagaaacgtcctcgtgttaaaggccggtttgtaaaaagagaggattcataa

SEQ ID NO: 456 - protein, 339 aa, Arabidopsis thaliana
  misc_feature: Ceres SEEDLINE ID no.ME11939
  misc_feature: Bit score of 503.4 for HMM based on sequences of FIGURE 6.
  misc_feature (294)..(338): Pfam Name: CCT Pfam Description: CCT motif
  misc_feature (81)..(228): Pfam Name: zf-B_box Pfam Description: B-box zinc finger
MCSNKASPVVGEEKQSTRSSKRIKKRKNREATTTMEDKSSSNLDASRKIRTKTKKPKFLSLKLELNTSHEINENPRSKKSKKKNNNKKQSKKKEPDTTPFKEKKRAETTTTLGGGEKEEEQYDTVAAYLFNSATDSTISSIHDLLPSSAATDVDCGGERNNLSPYDRQDHGSSSSSLLRTAMRKGASEEEETTEERWVSYSEVVEEVMSRSGTPRCCGGGDGNDGRPSLALKLDYEQIMEAWSDKGTLYVDGEPPQTVPDLHASADGFNDGGEAGNLWAVPEMETTERLWRGHREASLLRYKEKRQNRLFSKRIRYQVRKLNAEKRPRVKGRFVKREDS

SEQ ID NO: 457 - protein, 358 aa, Physcomitrella patens
  misc_feature: Public GI ID no.58430585
  misc_feature: Bit score of 603.4 for HMM based on sequences of FIGURE 6.
  misc_feature (295)..(339): Pfam Name: CCT Pfam Description: CCT motif
  misc_feature (43)..(90): Pfam Name: zf-B_box Pfam Description: B-box zinc finger
  misc_feature: Functional Homolog Of Ceres SEEDLINE ID no. ME11939 at SEQ ID NO. 456
MPKPCDACHVSSAAVFCRADAAYLCVGCDGKVHGANKLASRHERVWMCEVCEVAPAVVTCKADAASLCVACDTDIHSANPLAQRHERVPVTPLFESASPLRGPDFCVLVSENGCHDLLKGCEDASVVEAVSWLLPHPKISTNSIIRGSAAADEMGSSPFHDRPFSPKPKKQKVELPADIFSDVDPFLDLDDATVTGIQPDSLVPVHMPECSEDTDSLAHSMDPSFTKFPLSAKSGYSYGTSTLTQSISCSSLDAAVVPDSSLSDISTPYLDSQSSQDMSARLPHQTGGPIDTVDREARVLRYKEKRQKRKFEKTIRYASRKAYAESRPRIKGRFAKRTDSDMEQFGSVDSSFGVVPSF

SEQ ID NO: 458 - protein, 364 aa, Physcomitrella patens
  misc_feature: Public GI ID no.66841018
  misc_feature: Bit score of 539.4 for HMM based on sequences of FIGURE 6.
  misc_feature (298)..(342): Pfam Name: CCT Pfam Description: CCT motif
  misc_feature (43)..(90): Pfam Name: zf-B_box Pfam Description: B-box zinc finger
  misc_feature: Functional Homolog Of Ceres SEEDLINE ID no. ME11939 at SEQ ID NO. 456
MPKSCDACHISSAVVYCRADAAYLCAGCDGKVHGANKLASRHERVWMCEVCEVAVAVVTCKADAASLCVSCDTDIHSANPLAQRHERVPVQPLFDCASSAREAHISVPFPESECHETLKGVEDSCVAEAGSWLLPHPKIPTNAIIRGSAAADEAPDSPFRARPFSPKLKKQKVDLAADIFSDVDPFLELDDATVTGIQPDSLVPVHIPEGSEDSPSLAHSMEPSFTTDFHLSEKSGYSFGTSTLTHSISCSSVDAAVVPDSSLSDISTPYPLDSQGAQELSGTRMPQQVSGPIDTVDREARVMRYKEKRQKRKFEKTIRYASRKAYAESRPRIKGRFAKRTDSDVEQLFSSCSMDSSFGVVPSF

SEQ ID NO: 459 - protein, 368 aa, Physcomitrella patens
  misc_feature: Public GI ID no.66841020
  misc_feature: Bit score of 466.3 for HMM based on sequences of FIGURE 6.
  misc_feature (301)..(345): Pfam Name: CCT Pfam Description: CCT motif
  misc_feature (43)..(90): Pfam Name: zf-B_box Pfam Description: B-box zinc finger
  misc_feature: Functional Homolog Of Ceres SEEDLINE ID no. ME11939 at SEQ ID NO. 456
MPKSCDACQASSAVVYCRADAAYLCLGCDGKVHGANKLASRHERLWMCEVCEVAAAVVTCKADAASLCVSCDTDIHSANPLAQRHERVPVQPLFDCVSQFRGTHFSVLAPKNECNNNLLKGDEDPAVAEAVSWLLPHPKTLSSAILRGIAAADEAPAFPFRERPFSPKLKKLKVEQAADIYSDVDPFLVLDGGNGTGFQPDSLVPVHIPEGPDDSPSLANSTAPSSAINFRASQKSGCSYGTSTLTHSMSCSSVDAAVVPDSSLSDISTPYSKALDSQDSQDLSGALVPHQASKPIDTVDREARVMRCKEKRQKRKFEKTIRYASRKAYAESRPRIKGRFTKRTDSDVEQMFSSCTADSGFGVVPSSC

SEQ ID NO: 460 - protein, 410 aa, Picea abies
  misc_feature: Public GI ID no.108859343
  misc_feature: Bit score of 410.8 for HMM based on sequences of FIGURE 6.
  misc_feature (343)..(387): Pfam Name: CCT Pfam Description: CCT motif
  misc_feature (45)..(92): Pfam Name: zf-B_box Pfam Description: B-box zinc finger
  misc_feature: Functional Homolog Of Ceres SEEDLINE ID no. ME11939 at SEQ ID NO. 456
  misc_feature (293)..(293): Xaa is any aa, unknown, or other
MSMPKLCDVCQVSNSVLYCRAHTAQLCLVCDVKIHGGSKASLCHERVWVCEVCEQAPAVVTCKADAAALCVACDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNXCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 461 - DNA, 1310 bp, Gossypium hirsutum
  misc_feature: Ceres CLONE ID no.1937613
  misc_feature: Encodes the peptide sequence at SEQ ID NO. 462
agacacagagaaagaaaaggagaaagacggtagatttgtttaaccccagcaactcgttgaaatggcgtccaagttgtgtgactcatgcaaatcagcgacggccactctgttctgccgtcctgactcggcttttctttgccccaactgcgactccaaaatccatgccgccaacaagctagcctcccgtcacgctcgggtcttggtctgtgaagtttgcgaacaagcaccggctcacgtcacctgcaaggctgacgcagccgctctttgcgtcacttgtgaccgtgacatccactccgctaaccctctcgctcgccggcacgagcgggttcctttggctcccttttacgattccgtcaagcccaacacagcgtttaacttcctggacgaccgttacttatccgacgttgatggagacgctgacagcagcagggaagaagcggaggcagcttcgtggttgcttcctaaccctaaccacaaagcacatgaaagcccggacgtgaacacggggcagtacgtgtttcccgagatggatccgtatctagatctggattacggtcatgtggatccgaaaatggaaacccaggaccaggagcagaacagttctggaactgatggagtggtccctgtccaaagcaacaccgtccaagctccgatggtcaacgatcactgtttcgacatggagttcactacaccaaaagccttcccttatggctacaactacaactgtaactacaaccttcactgtcttagccacagtgtatcatcttcttctctggatgttggggtagttccagatggcggtagtacgattacggacatatcagtcccgtgcgcgaaagtgacggagacgactcatcaggcggtgcaactctcatcggcggagagagaagcgagggtgctgaggtacagagagaagaggaagaacagaaaattcgagaaaacgatacgttacgcttctaggaaagcttacgcggaggtgcggccgaggattaaaggaagatttgcaaagcgcagtgatgttgaagtcgaagtcgacggcggtaacatgtttggatttggcgtcgttccgtcgttttgaaattaactaaggtagccgtgtagtaatattctacgttaaattttggaactgtaattttctaagtgtttttttttcttcttttctttcctttttacttcattgctcactaaattaataggtaaagaagatgaaggtagggtgatttgtataatccaaataactatggaatctggaccattgattttgtacaagtctcatttttatgttattaatactctgttaatatttgtat

SEQ ID NO: 462 - protein, 338 aa, Gossypium hirsutum
  misc_feature: Ceres CLONE ID no.1937613
  misc_feature: Bit score of 574.8 for HMM based on sequences of FIGURE 6.
  misc_feature (1)..(48): Pfam Name: zf-B_box Pfam Description: B-box zinc finger
  misc_feature (275)..(319): Pfam Name: CCT Pfam Description: CCT motif
  misc_feature: Functional Homolog Of Ceres SEEDLINE ID no. ME11939 at SEQ ID NO. 456
MASKLCDSCKSATATLFCRPDSAFLCPNCDSKIHAANKLASRHARVLVCEVCEQAPAHVTCKADAAALCVTCDRDIHSANPLARRHERVPLAPFYDSVKPNTAFNFLDDRYLSDVDGDADSSREEAEAASWLLPNPNHKAHESPDVNTGQYVFPEMDPYLDLDYGHVDPKMETQDQEQNSSGTDGVVPVQSNTVQAPMVNDHCFDMEFTTPKAFPYGYNYNCNYNLHCLSHSVSSSSLDVGVVPDGGSTITDISVPCAKVTETTHQAVQLSSAEREARVLRYREKRKNRKFEKTIRYASRKAYAEVRPRIKGRFAKRSDVEVEVDGGNMFGFGVVPSF

SEQ ID NO: 463 - DNA, 1352 bp, Gossypium hirsutum
  misc_feature: Ceres CLONE ID no.1834027
  misc_feature: Encodes the peptide sequence at SEQ ID NO. 464
ttaaaatcaataacaaacacttcaaaccctccacgtttgatccaaacataatatttttttatttccattgctttgatttgattcgcgattatgggaatcgaaataagcggcggcacgatcattccaggaggttggggggccgccgccatggctgtcgcggctaagacatgcgacgcatgtaaatcatcggcggcagctatcttttgtcgtactgattgggtctttttatgcttgaattgtgattccaatttccattccggtcacgaaagggtgtctatgtgtgaagtttgcgaacaagctccggcggctgtcacttgtaaagccgacgcggcggctctttgtgtcacttgcgacgccgatatccattcagcgaacccactggctcgccgtcacgaacgtgtacccatcgaacctttctacgactccgctgattccatcgtcaaatcttccccttttagcttccttgtgccgacgacggatcataatggtactaattgtaaacaagaaattgaatctaacaaaggggatttttttttcacagaaatggatcggtttatcgatttcgggtacccgaattcatctcaacatcttcatgatgccgccatggatagcgttgttccagttcaaactccaaaaccagtcattccactgatcaacgatggaagctgtttcgatactttcagctatcaaactcaatcatctctcagtcatagcgtttcatcatcgtcgcttgaagtagaaacagttccagatgggaattaccacgcaacacaagtgggtggttcaatcgatcgagaagctagggttttaaggtacaaagagaagagaaagaacaggaaattcgagaagacaatacgatacgcttcaagaaaggcttacgctgaatcaagaccaagaatcaaaggtcgatttgctaaaagaacagaaacccacaacgatgatgttgatcacatgttcaataactcttctttcgctgttggtcctgctggtttcatggcggaaacagactatggtgtcgttccatcgttttgaatgttgatgttttatgtttggtttaatctgtaatgtattaaattatttaatccaatttccagcaaagtagaaataaccttatggccattgaaaatcaaggaagaaagatgcttagttctttgattaatcattaaagtttctgatgtataaaaaacagtgtatcggtggagttcgtcgtatgttcgccatggttgatttgcaggattcctgcaagggagatatattagttttcataaaaatgtttatttcaatctctgaataaaaccagatatatggtaagtaaatgcttcaatttagttcaaaaaaaaaaaaaaaaaaaa

SEQ ID NO: 464 - protein, 313 aa, Gossypium hirsutum
  misc_feature: Ceres CLONE ID no.1834027
  misc_feature: Bit score of 421.4 for HMM based on sequences of FIGURE 6.
  misc_feature (235)..(279): Pfam Name: CCT Pfam Description: CCT motif
  misc_feature (64)..(106): Pfam Name: zf-B_box Pfam Description: B-box zinc finger
  misc_feature: Functional Homolog Of Ceres SEEDLINE ID no. ME11939 at SEQ ID NO. 456
MGIEISGGTIIPGGWGAAAMAVAAKTCDACKSSAAAIFCRTDWVFLCLNCDSNFHSGHERVSMCEVCEQAPAAVTCKADAAALCVTCDADIHSANPLARRHERVPIEPFYDSADSIVKSSPFSFLVPTTDHNGTNCKQEIESNKGDFFFTEMDRFIDFGYPNSSQHLHDAAMDSVVPVQTPKPVIPLINDGSCFDTFSYQTQSSLSHSVSSSSLEVETVPDGNYHATQVGGSIDREARVLRYKEKRKNRKFEKTIRYASRKAYAESRPRIKGRFAKRTETHNDDVDHMFNNSSFAVGPAGFMAETDYGVVPSF

SEQ ID NO: 465 - DNA, 1561 bp, Gossypium hirsutum
  misc_feature: Ceres CLONE ID no.1842825
  misc_feature: Encodes the peptide sequence at SEQ ID NO. 466
aagagcaaactgtggcactactccatgtatactcccaaaatctctaaaaagggaaatactagtcctttcgagggcaactgaaagaggagaaaaaaaaatctattggttttgatttgtgaggatggtaatcgatacaaccaacgtcaagggacttacgggacgctggggcatggcagcaaagacatgcgacacatgtaaatcagcggcagcggctattttctgtcgttctgattccgcttttatgtgcctcagctgcgattccaggatccactctgctaatgacaagcttgtttcttgtcgtcacgagagggtgtggatgtgtgaggtgtgcgagcaggccccagctgccgtcacttgcaaggccgacgccgctgccctttgcgtcgcctgcgattccgacatccactctgctaatcctttggctcgtcgccacgagcgtgtccctgtccagcctttctttgactctgctgattccatcgtcaaatcttcttctttcagcttccttgtgccgactgatcctaatactggttctaattgtcaacaagaagatgtagagacaggttcttggctgttgcccaatcccaaactcaccatggaaactaaccaagtcaaaacaggggattttttcttctccgacatggatccgtttattgattttgagtaccaggattcgtttcaacagcatgacggagctatggacagcgtagttccagttcagaccaaaccagctacaatttcaatgatcaacaatgaaaattgtttcgatgttgatttctgtcgatccaagttccctactttcagctaccagacaaagtctcaaagccatagtgtttcatcatcgtcgctcgaggtaggagtagttccagatgggaactccgtgtcggatatctcatatactttgggacggaccatgggtgacccaagcgcaccaatctgggcagctacagccaataaccaagcaccacctcaggcccaagtcggtggaatggatcgagaagctagagttctaaggtacagagagaagagaaagaacagaaaatttgagaaaacaatccgctacgcttcgagaaaggcatacgccgagtcaaggccaaggatcaaaggccgtttcgccaaaagaaatgaaaccgacaacgaagttgaccacatgtataactcggcttcttccgctgctaccgcagcagctttcatgtacgataaccagtacggcatcgtcccatccttttgaggatgtcatgaatgaatctgattcagatggaaacaagaattgttggctgtaatattcaactgtgatatatatatccagcaagtagaatcaactaccctaaggaaaacaaatgatgtagcttttaattatggttattgatgtaaaaatagtgtatccatgagctattgatttgcagggattcattcaagttgattaactgcagaataagatggaaaagtcctgcaaaatctgaaacaaagcccttccactttttctctagagggcttcttctgtgattctgttatctagaagtaaaagtttttcttggtttttcaaaaaaaaaaaaaaaaaaaa

SEQ ID NO: 466 - protein, 368 aa, Gossypium hirsutum
  misc_feature: Ceres CLONE ID no.1842825
  misc_feature: Bit score of 707.6 for HMM based on sequences of FIGURE 6.
  misc_feature (291)..(335): Pfam Name: CCT Pfam Description: CCT motif
  misc_feature (62)..(109): Pfam Name: zf-B_box Pfam Description: B-box zinc finger
  misc_feature: Functional Homolog Of Ceres SEEDLINE ID no. ME11939 at SEQ ID NO. 456
MVIDTTNVKGLTGRWGMAAKTCDTCKSAAAAIFCRSDSAFMCLSCDSRIHSANDKLVSCRHERVWMCEVCEQAPAAVTCKADAAALCVACDSDIHSANPLARRHERVPVQPFFDSADSIVKSSSFSFLVPTDPNTGSNCQQEDVETGSWLLPNPKLTMETNQVKTGDFFFSDMDPFIDFEYQDSFQQHDGAMDSVVPVQTKPATISMINNENCFDVDFCRSKFPTFSYQTKSQSHSVSSSSLEVGVVPDGNSVSDISYTLGRTMGDPSAPIWAATANNQAPPQAQVGGMDREARVLRYREKRKNRKFEKTIRYASRKAYAESRPRIKGRFAKRNETDNEVDHMYNSASSAATAAAFMYDNQYGIVPSF

SEQ ID NO: 467 - DNA, 1053 bp, Populus balsamifera subsp. trichocarpa
  misc_feature: Ceres ANNOT ID no.1477832
  misc_feature: Encodes the peptide sequence at SEQ ID NO. 468
atggcttcaaagctctgtgactcatgcaagtcagcaacagcaacgttgttttgtcgagctgactcagcttttctatgcatcagctgcgactccaaaatccacgcggcaaacaagcttgcctctcgccacgcgcgtgtctcggtctgcgaagtctgtgagcaagccccagcccatttcacctgcaaggcagacgcggctgctctctgtgttacctgtgaccgtgacatccactcagcaaaccctctagctagtcggcacgagcgtgtccctatcactccgtttttcgactcatcctccactgtgcacggcggtggggaagccgtgaacttgttggaggatcggtactttgatgaagtggatggtggtcgtggtgatgttagcagggaggaggcagaggcggagtcgtggctgttgcctaacccgggtggggggactactaagggggtggatagtatggatctgaataccggtcagtatgtgtttggttcggaaatggatccgtatttggatttggatccgtatgtggatccaaaagtggaagtgcaagagcagaacagttcagggactactgatggggtggtgcctgtgcaaagtaacaaactaggatttcaatctcctgctttggtcaatgatcattgctgctatgagttggatttctctactggatccaagtcttttggtggtggctatggctataactccttgagccagagtgtttcttcttcatctcttgatgttggagtggtaccagatggaagtggaagtaccttgacagacatatctaacccatactgtagtagatcagtgtgcaacggaatggagtcagcaaaccagacagtgcaactatcggcagttgaccgtgaagcaagggtgttgaggtacagagagaagaggaagaacagaaaattcgagaagacaattcgatacgcatcaagaaaagcctatgccgaaacaaggccacgaatcaaaggaaggttcgctaaacgtacagatactgaagtcgaggttgatcgaagcagtctttatggattcggtgtcgttccatcgttctaa

SEQ ID NO: 468 - protein, 186 aa, Populus balsamifera subsp. trichocarpa
  misc_feature: Ceres ANNOT ID no.1477832
  misc_feature: Bit score of 83.7 for HMM based on sequences of FIGURE 6.
  misc_feature (123)..(167): Pfam Name: CCT Pfam Description: CCT motif
  misc_feature (1)..(48): Pfam Name: zf-B_box Pfam Description: B-box zinc finger
  misc_feature: Functional Homolog Of Ceres SEEDLINE ID no. ME11939 at SEQ ID NO. 456
MDPYLDLDPYVDPKVEVQEQNSSGTTDGVVPVQSNKLGFQSPALVNDHCCYELDFSTGSKSFGGGYGYNSLSQSVSSSSLDVGVVPDGSGSTLTDISNPYCSRSVCNGMESANQTVQLSAVDREARVLRYREKRKNRKFEKTIRYASRKAYAETRPRIKGRFAKRTDTEVEVDRSSLYGFGVVPSF

SEQ ID NO: 469 - DNA, 1155 bp, Populus balsamifera subsp. trichocarpa
  misc_feature: Ceres ANNOT ID no.1482536
  misc_feature: Encodes the peptide sequence at SEQ ID NO. 470
atgggaattgaagttgagagcttaaagaacttgaccggaggatggagtgttgcggctaaacgttgcgactcgtgcaaaacggcagctgcagctgcgttttgccgggcggactctgcttttttgtgtctgaattgtgacaccaagattcaccatagtggggtgaacagcaagatcatgtcaaggcacgagcgtgtgtggatgtgtgaggtttgcgagcaagcacccgctgcggttacctgtaaggctgatgcagctgctctttgtgttacttgtgatgctgacatccactctgctaaccctcttgctcgccgtcatgaacgagtccccgtggagcctttttatgactctgctgaatcaattgttaagacttcctcggcgtttaattttctagtgcctggtgatcaaaatggtgtgtctgcatatgatcataacgatgagatcgagggtgtttcgtggttgttgcacggtaatcacacaacacatgaccttaataccaagatcaacatcgagaatcctgttgtcaagactggagatatgtttttctgtgaaatggatccctttcttgattttgagtatcagaattcgatggatgggaggtacaagcagagtcatggtgggggtggtgctggagctgatagcgttgtgcctgtgcaaaacaaaccagctccgcttcccgtgatcgatcataaaaactgctttgatattgatttctgtagatcgaaactcacctctttcagcagctacccctctcagtcccttagccacagcgtttcttcgtcttccctcgatgttggtgttgttcctgatgggaattctatgtccgatatttcgtatcccttcggccgaagcatgaatacttataccgatccaagcatgcccatctcaggttccactacaaatcaagcagcagctcagttagctgggattgaccgcgaagctagagttttgaggtacagagagaaaagaaagaaccgtaaattcgaaaaaaccatacggtatgcttcacgtaaagcttacgcagaaaccaggccaagaatcaaaggccgattcgcgaagcgaaccgaaatggaatccgatatggacaccctatataactctccgagctctgtccctttcctggccgatactcattacggtgtcgttccctcgttttga

SEQ ID NO: 470 - protein, 318 aa, Populus balsamifera subsp. trichocarpa
  misc_feature: Ceres ANNOT ID no.1482536
  misc_feature: Bit score of 420.1 for HMM based on sequences of FIGURE 6.
  misc_feature (1)..(44): Pfam Name: zf-B_box Pfam Description: B-box zinc finger
  misc_feature (245)..(289): Pfam Name: CCT Pfam Description: CCT motif
  misc_feature: Functional Homolog Of Ceres SEEDLINE ID no. ME11939 at SEQ ID NO. 456
MCEVCEQAPAAVTCKADAAALCVTCDADIHSANPLARRHERVPVEPFYDSAESIVKTSSAFNFLVPGDQNGVSAYDHNDEIEGVSWLLHGNHTTHDLNTKINIENPVVKTGDMFFCEMDPFLDFEYQNSMDGRYKQSHGGGGAGADSVVPVQNKPAPLPVIDHKNCFDIDFCRSKLTSFSSYPSQSLSHSVSSSSLDVGVVPDGNSMSDISYPFGRSMNTYTDPSMPISGSTTNQAAAQLAGIDREARVLRYREKRKNRKFEKTIRYASRKAYAETRPRIKGRFAKRTEMESDMDTLYNSPSSVPFLADTHYGVVPSF

SEQ ID NO: 471 - DNA, 1143 bp, Populus balsamifera subsp. trichocarpa
  misc_feature: Ceres ANNOT ID no.1478227
  misc_feature: Encodes the peptide sequence at SEQ ID NO. 472
atgggaattgaagtcgagagcttaaagaacttaaccggaggatggagtgttgcggctaaacgttgtgactcgtgcaaaaccgcggctgcagctgcgttttgcagggccgactctgcttttttgtgtctgaattgtgataccaagattcaccatagccaggtgaatagcaaaatcatgtccaggcatgagcgtgtgtggatgtgtgaggtctgcgagcaagcaccagctgcggttacttgcaaagctgatgcagctgctctttgtgtcacttgtgacgctgacatccactctgctaaccctcttgctcgccgtcatgaacgagtcccaatcgagcccttttataactctgctgaatcaattgttaagacttccacggcgtttaatattctaatacctggtgaaaatggtgtgtctggatatgatcagaacgatgatgtagagggtgtttcgtggctattacagagtaatcacacaacacacgaccataattcaaagctccaaatcgagaatcctgttgtgaagactggagacatgtttttctctgaaattgatccgtttcttgaattggagtatcagaattccattgatgcgagctatgagaagattcatggtggtgctggtgctgatagcgttgtgcctgtgcaaaccaaaccagctccgcttccggtgatcaatcatgaaagttgctttgacattgatttctgtagatctaaactcacttctttcagctactcatctcagtctcttagccacagcgtttcttcttcttccctagatgttggtgttgttcctgatgggaattctatgtccgacatatcctatcctttcagccgaagcatgaatactactaccgatccaagcatgcccctctcaggctggactgcgaatcaagcagcaactcaattagctgggattgaccgtgaagctagagttttgaggtacagagagagaaggaagaaccgaaagttcgaaaagaccatacggtatgcttcccgaaaagcttacgctgaaaccagaccgagaatcaaaggccgattcgcaaaacgaaccgaaatggaatccgatatggacaacctatataactctccgagctctgtccctttcatggccgatacccaatacggtgtcgttccctcgttttga

SEQ ID NO: 472 - protein, 314 aa, Populus balsamifera subsp. trichocarpa
  misc_feature: Ceres ANNOT ID no.1478227
  misc_feature: Bit score of 426.0 for HMM based on sequences of FIGURE 6.
  misc_feature (1)..(44): Pfam Name: zf-B_box Pfam Description: B-box zinc finger
  misc_feature (241)..(285): Pfam Name: CCT Pfam Description: CCT motif
  misc_feature: Functional Homolog Of Ceres SEEDLINE ID no. ME11939 at SEQ ID NO. 456
MCEVCEQAPAAVTCKADAAALCVTCDADIHSANPLARRHERVPIEPFYNSAESIVKTSTAFNILIPGENGVSGYDQNDDVEGVSWLLQSNHTTHDHNSKLQIENPVVKTGDMFFSEIDPFLELEYQNSIDASYEKIHGGAGADSVVPVQTKPAPLPVINHESCFDIDFCRSKLTSFSYSSQSLSHSVSSSSLDVGVVPDGNSMSDISYPFSRSMNTTTDPSMPLSGWTANQAATQLAGIDREARVLRYRERRKNRKFEKTIRYASRKAYAETRPRIKGRFAKRTEMESDMDNLYNSPSSVPFMADTQYGVVPSF

SEQ ID NO: 473 - DNA, 1110 bp, Populus balsamifera subsp. trichocarpa
  misc_feature: Ceres ANNOT ID no.1449721
  misc_feature: Encodes the peptide sequence at SEQ ID NO. 474
atgttgaagcaagagagtagtggtggcggaggtggtgacaacagggctcgtgtatgtgacacgtgtcgtgcagcaccttgcactgtgtactgcagggctgactcggcatacttgtgtgccgggtgtgatgcccgtgtgcacgcagccaatcgtgtggcatcacgccatgagcgcgtatcggtgtgcgaggcgtgtgagcgtgctccggctgccttgttatgcaaggcggatgcggcgtctctctgcactgcctgtgacgcagatatccattctgcaaacccactagcacgccgccaccagcgtgttccaattctgcccatttccggttgccttcacggttccccagtagggcctgcagccggtgagactgaagaccggttcacgacacaagagggagaagagacaataagtgaggaggaggaggatgaagctgcttcatggttgttactaaatcctgtgaagaacagcaagaaccagaataataatggcttcttgtttggtggggaggttgatgagtatttggatcttgtggagtacaactcatgtactgaaaatcaatgctctgatcagtacaatcagcaacactactgtgttccgccaaagagttatgggggtgaccgtgctgtgccaattcagtatggagaaggaaaggatcatcaacagcaacggcagtatcacaattttcagttgggattggagtatgagccctcaaaagctgcttgcagctacaatggttcgatcagtcaaagtgtatccatgtcatccatggatgttggagtggtgccagaatcaacaatgagcgagatctcaatctcgcaacatagacctccaaaagggacaatggaacttttctccagcactgctatccagatgccatctcaacttagtccaatggatagggaggcaagagtcctgagatacagagagaaaaagaagacgaggaagtttgagaagacaatcaggtatgcctcaaggaaggcctatgcagagaccagaccccggataaaaggccgatttgcaaagagaaaagatgtagaagtcgaagatgaccaaatgttctcctccacactaatggcagaaacaggatatggcattgtcccatcattctga

SEQ ID NO: 474 - protein, 369 aa, Populus balsamifera subsp. trichocarpa
  misc_feature: Ceres ANNOT ID no.1449721
  misc_feature: Bit score of 818.0 for HMM based on sequences of FIGURE 6.
  misc_feature (14)..(61): Pfam Name: zf-B_box Pfam Description: B-box zinc finger
  misc_feature (300)..(344): Pfam Name: CCT Pfam Description: CCT motif
  misc_feature: Functional Homolog Of Ceres SEEDLINE ID no. ME11939 at SEQ ID NO. 456
MLKQESSGGGGGDNRARVCDTCRAAPCTVYCRADSAYLCAGCDARVHAANRVASRHERVSVCEACERAPAALLCKADAASLCTACDADIHSANPLARRHQRVPILPISGCLHGSPVGPAAGETEDRFTTQEGEETISEEEEDEAASWLLLNPVKNSKNQNNNGFLFGGEVDEYLDLVEYNSCTENQCSDQYNQQHYCVPPKSYGGDRAVPIQYGEGKDHQQQRQYHNFQLGLEYEPSKAACSYNGSISQSVSMSSMDVGVVPESTMSEISISQHRPPKGTMELFSSTAIQMPSQLSPMDREARVLRYREKKKTRKFEKTIRYASRKAYAETRPRIKGRFAKRKDVEVEDDQMFSSTLMAETGYGIVPSF

SEQ ID NO: 475 - protein, 372 aa, Populus deltoides
  misc_feature: Public GI ID no.41323978
  misc_feature: Bit score of 816.7 for HMM based on sequences of FIGURE 6.
  misc_feature (303)..(347): Pfam Name: CCT Pfam Description: CCT motif
  misc_feature (57)..(104): Pfam Name: zf-B_box Pfam Description: B-box zinc finger
  misc_feature: Functional Homolog Of Ceres SEEDLINE ID no. ME11939 at SEQ ID NO. 456
MLKQESSGSGGGDNRARLCDTCRAAACTVYCRADSAYLCAGCDARVHAANRVASRHERVWVCESCERAPAALLCKADAASLCTACDADIHSANPLARRHQRVPILPISGCLHGSQVGPAAGETEDRFTTQEGEETISEEEEEEEDEAASWLLLNPVKNSKNQNNNGFLFEGEVDEYLDLVEYNSCTENQCSDQYNQQHYCVPPKSYGGDRVVPIQYGEGKDHQQQRQYHNFQLGLEYEPSKAAYSYNGLISQSVSMSSMDVGVVPESTMSEISISQHRTPKRTIELFSSTAIQMPSQLSPMDREARVLRYREKKKTRKFEKTIRYASRKAYAETRPRVKGRFAKRKDVEVEDDRTFSSTLMAGTGCGIVPSF

SEQ ID NO: 476 - DNA, 1334 bp, Arabidopsis thaliana
  misc_feature: Ceres CLONE ID no.19906
  misc_feature: Encodes the peptide sequence at SEQ ID NO. 477
aaaaacttagaaagcagagaagagttaaagtgttagagagagagagacagagatcgtagatgtgtagcaacaaagcaagtccggtcgtcggagaagaaaaacagagtacgagatcatcgaagaggatcaagaagagaaaaaacagagaagctaccaccaccatggaggataagtcttcttccaatcttgacgcgtctcgtaagatcagaacaaaaacgaaaaaacccaaatttctcagtctcaagctcgagctcaacacttctcacgagatcaacgagaatcccagaagcaagaagagcaagaagaagaacamcaacaaaaaacagagcaagaagaaagaaccggatacgacgccgtttaaggagaagaagagagcagagactactactacactggggggaggagagaaagaagaagagcaatacgacaccgttgcagcttacctcttcaattccgccaccgacagtacaatttcttcgatccacgatctcctcccttcctccgcggccaccgatgtagattgcggcggagaaaggaataatctttctccgtatgatcgtcaagaccacggatcgtcgtcgtcttcccttctaaggacggcgatgaggaaaggagcgagcgaggaggaggagacgacggaggagcggtgggtgagttattcagaggttgtggaggaagtgatgagtcggagcgggactccacgttgttgcggcggaggcgatggaaacgatggacggccttcgttggctctgaagcttgattatgagcagatcatggaggcttggtcggataaaggtacgctttatgtcgacggagaaccgccgcagacagtgccggacttgcatgcttccgctgatgggtttaatgacggcggagaggcggggaatttatgggcagtgccggagatggaaacgacggagaggttatggagagggcatagagaagccagcttgctccggtataaagagaaacggcaaaaccgtcttttctctaagcggattcgatatcaagttcgtaaactcaatgccgagaaacgtcctcgtgttaaaggccggtttgtaaaaagagaggattcataaaccacctaagtgacggatgtttagtatttcatgatattgctattttgtgacttgttgagaagttaaggctcaaccggagtataccgagaactgaagatgatattggtctgtataggggtcttgaccagctcggttatgcaaaagtttcggttttgtttggccgcctagctttggttctcttattagaaaagtcaactaatttgtaccaaatcatctgaacaataatgataataaaaatgagaagttaatgggtgc

SEQ ID NO: 477 - protein, 339 aa, Arabidopsis thaliana
  misc_feature: Ceres CLONE ID no.19906
  misc_feature: Bit score of 500.0 for HMM based on sequences of FIGURE 6.
  misc_feature (294)..(338): Pfam Name: CCT Pfam Description: CCT motif
  misc_feature (2)..(48): Pfam Name: zf-B_box Pfam Description: B-box zinc finger
  misc_feature: Functional Homolog Of Ceres SEEDLINE ID no. ME11939 at SEQ ID NO. 456
  misc_feature (85)..(85): Xaa is any aa, unknown, or other
MCSNKASPVVGEEKQSTRSSKRIKKRKNREATTTMEDKSSSNLDASRKIRTKTKKPKFLSLKLELNTSHEINENPRSKKSKKKNXNKKQSKKKEPDTTPFKEKKRAETTTTLGGGEKEEEQYDTVAAYLFNSATDSTISSIHDLLPSSAATDVDCGGERNNLSPYDRQDHGSSSSSLLRTAMRKGASEEEETTEERWVSYSEVVEEVMSRSGTPRCCGGGDGNDGRPSLALKLDYEQIMEAWSDKGTLYVDGEPPQTVPDLHASADGFNDGGEAGNLWAVPEMETTERLWRGHREASLLRYKEKRQNRLFSKRIRYQVRKLNAEKRPRVKGRFVKREDS

SEQ ID NO: 478 - protein, 366 aa, Brassica napus
  misc_feature: Public GI ID no.2895186
  misc_feature: Bit score of 721.7 for HMM based on sequences of FIGURE 6.
  misc_feature (293)..(337): Pfam Name: CCT Pfam Description: CCT motif
  misc_feature (59)..(106): Pfam Name: zf-B_box Pfam Description: B-box zinc finger
  misc_feature: Functional Homolog Of Ceres SEEDLINE ID no. ME11939 at SEQ ID NO. 456
MFKQESNNICNRENNRGARACDTCGSTICTVYCHADSAYLCNSCDAQVHSANRVASRHKRVRVCESCERAPAAFMCEADDVSLCTACDLEVHSANPLARRHQRVPVVPIIGNSCSSLATANHTTVTEPEKRVVLVQEDAKETASWLFPKNSDYHNNNNNQNNELLFSDDYLDLADYNSSMDYKFTSQYNQPRHKQDCIVPEKNYSGDRVVPLQLEETRGNLRNKQQNITYGSSGSQYNNNGSINHNAYNPSMETDFVPEQTAPDTTVSHPKTHKGKTAQLPEPLIQILSPMDREARVLRYREKKKRRKFEKTIRYASRKAYAERRPRINGRFAKMSETEVEDQEYNTMLMYCDTGYGIVPSFYGQK

SEQ ID NO: 479 - protein, 366 aa, Brassica napus
  misc_feature: Public GI ID no.2895184
  misc_feature: Bit score of 699.3 for HMM based on sequences of FIGURE 6.
  misc_feature (293)..(337): Pfam Name: CCT Pfam Description: CCT motif
  misc_feature (59)..(106): Pfam Name: zf-B_box Pfam Description: B-box zinc finger
  misc_feature: Functional Homolog Of Ceres SEEDLINE ID no. ME11939 at SEQ ID NO. 456
MFKQESNNIGSEENNTGPRACDTCGSTICTVYCHADSAYLCNSCDAQVHSANRVASRHKRVRVCESCERAPAAFMCEADDVSLCTACDLEVHSANPLARRHQRVPVVPITGNSCSSLATANHTTVTEPEKRVVLVQEDAKETASWLFPKNSDNHNNNNQNNELLFSDDYLDLADYNSSMDYKFTGQYNQPTQHKQDCTVPEKNYGGDRVVPLQLEETRGNLHHKQHNITYGSSGSHYNNNGSINHNAYNPSMETDFVPEQTAPDKTVSHPKTHKGKIEKLPEPLIQILSPMDREARVLRYREKKKRRKFEKTIRYASRKAYAERRPRINGRFAKISETEVEDQEYNTMLMYYDTGYGIVPSFYGQK

SEQ ID NO: 480 - protein, 368 aa, Brassica napus
  misc_feature: Public GI ID no.2895188
  misc_feature: Bit score of 702.4 for HMM based on sequences of FIGURE 6.
  misc_feature (295)..(339): Pfam Name: CCT Pfam Description: CCT motif
  misc_feature (60)..(107): Pfam Name: zf-B_box Pfam Description: B-box zinc finger
  misc_feature: Functional Homolog Of Ceres SEEDLINE ID no. ME11939 at SEQ ID NO. 456
MFKQESNNNICNRENNRGARACDTCGSTICTVYCHADSAYLCNSCDAQVHSANRVASRHKRVRVCESCERAPAAFMCEADDVSLCTACDLEVHSANPLARRHQRVPVVPITGNSCSSLATANHTTVTEPEKRVVLVQEDAKETASWLFPKNSDNHNNNNNQNNELLFSDDYLDLADYNSSMDYKFTGQYNQPTQHKQDCTVPEKNYGGDRVVPLQLEETRGNLHHKQHNITYGSSGSHYNNNGSINHNAYNPSMETDFVPEQTAPDKTVSHPKTHKGKIEKLPEPLIQILSPMDREARVLRYREKKKRRKFEKTIRYASRKAYAERRPRINGRFAKISETEVEDQEYNTMLMYYDTGYGIVPSFYGQK

SEQ ID NO: 481 - protein, 342 aa, Brassica nigra
  misc_feature: Public GI ID no.22854950
  misc_feature: Bit score of 707.8 for HMM based on sequences of FIGURE 6.
  misc_feature (274)..(318): Pfam Name: CCT Pfam Description: CCT motif
  misc_feature (50)..(97): Pfam Name: zf-B_box Pfam Description: B-box zinc finger
  misc_feature: Functional Homolog Of Ceres SEEDLINE ID no. ME11939 at SEQ ID NO. 456
  misc_feature (177)..(177): Xaa is any aa, unknown, or other
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFXGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYGIVPSFS

SEQ ID NO: 482 - protein, 224 aa, Brassica nigra
  misc_feature: Public GI ID no.11037313
  misc_feature: Bit score of 155.1 for HMM based on sequences of FIGURE 6.
  misc_feature (158)..(202): Pfam Name: CCT Pfam Description: CCT motif
  misc_feature (13)..(60): Pfam Name: zf-B_box Pfam Description: B-box zinc finger
  misc_feature: Functional Homolog Of Ceres SEEDLINE ID no. ME11939 at SEQ ID NO. 456
MLKEESNESVFLVGKEEDDDGREVASWLMLNLGKDNDSHNNGFLFGVEYLDPVDYSSSIDNQFEDQYSQYQRSFGGEDGVVPLQVEEITSHLQQSHHNYGHYNYNGSLKDLNHTVSVSSMDISVVPESRAIDTSVQHPKETIDQQSGPPTQKLTPADREARVLRYREKKKRRKFEKTIRYASRKAYAEIRPRIKGRFAKTIETEADAQQLLSTALVSYGIVPSF

SEQ ID NO: 483 - protein, 348 aa, Brassica nigra
  misc_feature: Public GI ID no.22854908
  misc_feature: Bit score of 701.6 for HMM based on sequences of FIGURE 6.
  misc_feature (280)..(324): Pfam Name: CCT Pfam Description: CCT motif
  misc_feature (50)..(97): Pfam Name: zf-B_box Pfam Description: B-box zinc finger
  misc_feature: Functional Homolog Of Ceres SEEDLINE ID no. ME11939 at SEQ ID NO. 456
  misc_feature (321)..(321): Xaa is any aa, unknown, or other
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAXRNEVDADQAFPTVVMFDTGYGIVPSFS

SEQ ID NO: 484 - protein, 321 aa, Brassica rapa
  misc_feature: Public GI ID no.40787165
  misc_feature: Bit score of 521.2 for HMM based on sequences of FIGURE 6.
  misc_feature (252)..(296): Pfam Name: CCT Pfam Description: CCT motif
  misc_feature (46)..(93): Pfam Name: zf-B_box Pfam Description: B-box zinc finger
  misc_feature: Functional Homolog Of Ceres SEEDLINE ID no. ME11939 at SEQ ID NO. 456
MLKEESNESGGTRACDTCRSAACTIYREADSTYLCTTCDARVHAAKRVRVCDSCESAPAAFFCKADAAPLCTACDAEIHSANPLARRHQRVPITSNSCGSMATDGDNNVMMVSEEKEDADEVASWLMLNPGKNNQNNGFLFGVEYLDLVDYSSSIDNQFEDQYNHYQRSFGGGEDGVVPLQLEESTSHMQQSQHNFHLGVNYGFSTEPHYSYISVVPESTSSDTTVQHAKETMDQVSGPPTQMVQQLTPADREARVLRYREKKKRRKFEKTIRYASRKAYAEVRPRIKGRFAKRIDMEADAEQLFSTSLMSNTSYGIVPSF

SEQ ID NO: 485 - protein, 335 aa, Brassica oleracea var. alboglabra
  misc_feature: Public GI ID no.116010474
  misc_feature: Bit score of 692.9 for HMM based on sequences of FIGURE 6.
  misc_feature (265)..(309): Pfam Name: CCT Pfam Description: CCT motif
  misc_feature (50)..(97): Pfam Name: zf-B_box Pfam Description: B-box zinc finger
  misc_feature: Functional Homolog Of Ceres SEEDLINE ID no. ME11939 at SEQ ID NO. 456
MLKQESNWAQTCDTCRSAACTVYCRADSAYLCTNCDAQVHAANRLASRHERVRVCQSCERAPAAFFCKADAASLCTACDSQIHSANPLARRHQRVPILPISGSMVTNHSSETTETEDIVVVGQEEEDEAEAASWLLPSSLKNSGDNNNNNNNNNSENRFSVGDEYVDLVDYNKYQQDYNVPQRSYVADGVVPLQVGVLKSHMHHEEHNFQFGFTNVSSEASPIHMVSLVPESTLSETTVSHPRSPKVATEELHDAPVQMLSPVERKARVMRYREKKKKRKFEKRIRYASRKEYAEKRPRIKGRFAKRNEVDAEEADKAFSSMVMFDTGYGIVPSF

SEQ ID NO: 486 - protein, 366 aa, Brassica oleracea var. alboglabra
  misc_feature: Public GI ID no.116010475
  misc_feature: Bit score of 715.1 for HMM based on sequences of FIGURE 6.
  misc_feature (293)..(337): Pfam Name: CCT Pfam Description: CCT motif
  misc_feature (59)..(106): Pfam Name: zf-B_box Pfam Description: B-box zinc finger
  misc_feature: Functional Homolog Of Ceres SEEDLINE ID no. ME11939 at SEQ ID NO. 456
MFKQESNNICNRENNRGAPACDTCGSTICTVYCHADSAYLCNSCDAQVHSANRVASRHKRVRVCESCERAPAAFMCEADDVSLCTACDLEVHSANPLARRHQRVPVVPITGNSCSSLATANHTTVTEPEKRVVLVQEDAKETASWLFPKNSDNHNNNNNQNNELLFSDDYLDLADYNSSMDYKFTSQYNQPRHKQDCIVPEKNYSGDRVVPLQLEETRGNLRNKQQNITYGSSGSQYNNNGSINHNAYNPSMETDFVPEQTAPDTTVSHPKTHKGKTAQLPEPLIQILSPMDREARVLRYREKKKRRKFEKTIRYASRKAYAERRPRINGRFAKMSETEVEDQEYNTMLMYCDTGYGIVPSFYGQK

SEQ ID NO: 487 - protein, 307 aa, Raphanus sativus
  misc_feature: Public GI ID no.3341723
  misc_feature: Bit score of 440.7 for HMM based on sequences of FIGURE 6.
  misc_feature (1)..(48): Pfam Name: zf-B_box Pfam Description: B-box zinc finger
  misc_feature (241)..(285): Pfam Name: CCT Pfam Description: CCT motif
  misc_feature: Functional Homolog Of Ceres SEEDLINE ID no. ME11939 at SEQ ID NO. 456
MASRLCDSCRSAAATLYCRADAAFLCGECDGKIHTANKLASRHERVLLCQICEQAPAHVTCEADAAALCVTCDRDIHSANPLSRRHERVSVTPFYDAPAQGGSPATTKSAASSNLFGEDADVSMEAVSWLLPNPSVKEGVVVEIPNLFADLDYSAVDPKMEASENSSGNDGVVPVQTKALFLNEDYFNFDVSASKTTFPHGYSCINQTVSSTSLEVPLVPEGGAVTTTNATPAVQLSPAEREARVLRYREKRKNRKFEKTIRYASRKAYAEVRPRIKGRFAKRTDSRVNDGGGDVGVYGGFGVVPSF

SEQ ID NO: 488 - protein, 340 aa, Malus x domestica
  misc_feature: Public GI ID no.4091804
  misc_feature: Bit score of 655.8 for HMM based on sequences of FIGURE 6.
  misc_feature (1)..(48): Pfam Name: zf-B_box Pfam Description: B-box zinc finger
  misc_feature (279)..(323): Pfam Name: CCT Pfam Description: CCT motif
  misc_feature: Functional Homolog Of Ceres SEEDLINE ID no. ME11939 at SEQ ID NO. 456
MALKLCDSCKSATGTLFCRADSAFLCVNCDSKIHAANKLASRHARVWLCEVCEQAPAHVTCKADDAALCVTCDRDIHSANPLSHADERVPVTPFYDSVNSATDSVPAVKSAVNFLNDRYFSDVDGEIEARREEAEAASWLLPNPKAMENPDLNSGQYLFPEMDPYMDLDYGHVDPKLEDAQEQNSCITDGVVPEQSKNMQPQLVNDHSFEIDFSAASKPFVYGYHHAQCLRQSVSSSSMDVSIVPDDNAMTDDSNPYNKSMTSAVESSHPAVQLSSADREARVLRYREKRKNRKFEKTIRYASRKAYAETRPRIKGRFAKRTEVEIEAEPMCRYGIVPSF

SEQ ID NO: 489 - protein, 329 aa, Malus x domestica
  misc_feature: Public GI ID no.4091806
  misc_feature: Bit score of 608.7 for HMM based on sequences of FIGURE 6.
  misc_feature (1)..(48): Pfam Name: zf-B_box Pfam Description: B-box zinc finger
  misc_feature (268)..(312): Pfam Name: CCT Pfam Description: CCT motif
  misc_feature: Functional Homolog Of Ceres SEEDLINE ID no. ME11939 at SEQ ID NO. 456
MASKLCDSCQSATATLFCRADSAFLCVNCDSKIHAANKLASRHPRVWLCEVCEQAPAHVTCKADDAALCVTCDRDIHSANPLSSRHDRVPVTPFYDSVNSAANSVPVVKSVVNFLDDRYLSDVDGETEVSREEAEAASWLLPNPKAMENPDLNSGQYLFQEMDPYLDLDYGHVDPKLEEAQEQNSCGADGVVPVQSKNMQPLLVNDQSFELDFSAGSKPFVYGYHHARCLSQSVSSSSMDISVVPDGNAVTAAVETSQPAVQLSSVDRVARVLRYREKRKNRKFEKTIRYASRKAYAETRPRIKGRFAKRTEVEIEAERMCRYGVVPSF

SEQ ID NO: 490 - DNA, 1137 bp, Glycine max
  misc_feature: Ceres CLONE ID no.523203
  misc_feature: Encodes the peptide sequence at SEQ ID NO. 491
atgtttcacataatcacgcttctttctttcatcacaccccattctcccaaactaacaaacaaatcccagggagccaccaaccatggcttccaagctctgcgactcatgcaaatcagccactgctaccttgtactgccgccccgacgcggccttcctctgcggcgcctgtgactctaaggttcatgccgccaacaagctcgcatcgcgccacccgcgcgtcgtgctctgcgaggtgtgcgagcaggcgcccgcgcatgtgacctgtaaagccgacgccgccgcgctctgccttgcctgcgatcgcgatatccactccgccaaccccctcgccagccgccacgagcgcatccccgtcacgccgttcttcgagtccgtacattcagtcaaggcctcctcgccgatcaacttccaccaccgcttcttctccgacgccgacgctgatgctgacgtcagcaccgaggaggccgaggccgcgtcatggctgctacctaatccaaagacagatctaaattcgtctcagtacttgttctccgaaaccgaaccggttccttacatagatctggattacgcggccatggatccgaagacggagcagaaaagttccgccaccgccgacggcgtcgttccggtgcagagcaacttcgagccgttcacctacggttacaagtacaacactactctctcacagtcacagtctcatatgagccagagtgtatcttctccgtcgtcgatggaagttggagttgtgccggacgggaacacgatgtcggagatatcgaactgcagctacagcaaagtggcaccggtgacggtgacggcgcagttctcggcggcggatagggaggctagagtgttgaggtacagggagaagaggaagaaccgaaagttcgagaagaccattcgttacgcatcgagaaaagcgtatgccgaaacgaggccaagaatcaaaggaaggttcgygaaacgcactgatgcggaccctctggctggatacggcgtcgttccgtcgtgttgatgattatcatatatatcatatatgaatatgaatgcttacttttttgttttcttatgtttgcttttgctgctgtatatatggactacgccttcttttgtttgaattatgcaatgtaaagttgc

SEQ ID NO: 491 - protein, 310 aa, Glycine max
  misc_feature: Ceres CLONE ID no.523203
  misc_feature: Bit score of 518.7 for HMM based on sequences of FIGURE 6.
  misc_feature (1)..(48): Pfam Name: zf-B_box Pfam Description: B-box zinc finger
  misc_feature (253)..(297): Pfam Name: CCT Pfam Description: CCT motif
  misc_feature: Functional Homolog Of Ceres SEEDLINE ID no. ME11939 at SEQ ID NO. 456
  misc_feature (293)..(293): Xaa is any aa, unknown, or other
MASKLCDSCKSATATLYCRPDAAFLCGACDSKVHAANKLASRHPRVVLCEVCEQAPAHVTCKADAAALCLACDRDIHSANPLASRHERIPVTPFFESVHSVKASSPINFHHRFFSDADADADVSTEEAEAASWLLPNPKTDLNSSQYLFSETEPVPYIDLDYAAMDPKTEQKSSATADGVVPVQSNFEPFTYGYKYNTTLSQSQSHMSQSVSSPSSMEVGVVPDGNTMSEISNCSYSKVAPVTVTAQFSAADREARVLRYREKRKNRKFEKTIRYASRKAYAETRPRIKGRFXKRTDADPLAGYGVVPSC

SEQ ID NO: 492 - DNA, 1428 bp, Glycine max
  misc_feature: Ceres CLONE ID no.463157
  misc_feature: Encodes the peptide sequence at SEQ ID NO. 493
aactcactcactcattcaagtcgctaatcctagttccttcaactcctcgctggcaacaacagcagtactaccattagccgcgtttttcaaaagtgattttcgagaattagcgatgggaattgaaagaggaggcttcaagggattcaggagcgcctggagcgtgccgcccaagccgtgcgattcctgcaagctggcctcggcggcgcttttctgccgccccgattccgcgtttctctgcatcgcctgcgattccaacattcactgctcgaacaaactcgcgtcgcgccacgagcgcgtgtggatgtgtgaggtgtgcgagcaggcacccgctgctgtcacgtgcaaggccgacgccgccgccctctgcgtcacgtgtgactccgacatccactccgcgaaccccctcgcgcaacgccacgagcgcgtccccgtggaacctttctttgactccgctgagtccatagtgaaagcctctgctgccgccaccttcgggttcattgtcccatccgacgacggcggcgcctccgacgctttcgcccccgatgactccgacgccgccgcgtggctcatcccgaaccctaatttcgggtccaagctcatggacgcccccgaaatcaagtccaaggagatattcttctctgaaatggaccccttcctcgattttgattactcaaactccttccaaaacaacaacagcgccggaaacgacagcgtcgttccagttcaaaaaccctctctcgcccctcccctaatcaataatcaccaccaccaccaatcagaaacttgcttcgacgtcgatttttgtcgctcgaagctctcctcctttaactacccttccaattctcttagccaaagcgtttcgtcgtcgtcgcttgatgttggagtggtgccggacgggaacacggtgtcagacatgtcgtattcttttggtcggaacagttcggattcgagtgggattgttgttgtgtcaggaaatagtgtggggcaaggtgcgacgcagttgtgtggaatggatcgggaagcgagggtactgcgatacagagagaaaaggaagaaccgaaaattcgagaagacaattcgatacgcatcgcgaaaagcatatgcggaaacccggcccaggataaaaggccgcttcgccaaacgaacagaaattgactcggatgtggagcgtctctatagccctggccctgcggtgctcatgctggacactccatacggcgtcgtaccatcgttttagttaatttcaaaatgaagaaacgatggagtgcatgaatcttagaataatgattagcgattctgtgggattgttaggggaaaaaggtgaagaatcgaatcggtacgaacgtgattcttagctggagcgcgatgggggaagattattgtgaagatttgtctcgatcgaccagaaaagcccgtttactttttatg

SEQ ID NO: 493 - protein, 374 aa, Glycine max
  misc_feature: Ceres CLONE ID no.463157
  misc_feature: Bit score of 614.8 for HMM based on sequences of FIGURE 6.
  misc_feature (302)..(346): Pfam Name: CCT Pfam Description: CCT motif
  misc_feature (60)..(107): Pfam Name: zf-B_box Pfam Description: B-box zinc finger
  misc_feature: Functional Homolog Of Ceres SEEDLINE ID no. ME11939 at SEQ ID NO. 456
MGIERGGFKGFRSAWSVPPKPCDSCKLASAALFCRPDSAFLCIACDSNIHCSNKLASRHERVWMCEVCEQAPAAVTCKADAAALCVTCDSDIHSANPLAQRHERVPVEPFFDSAESIVKASAAATFGFIVPSDDGGASDAFAPDDSDAAAWLIPNPNFGSKLMDAPEIKSKEIFFSEMDPFLDFDYSNSFQNNNSAGNDSVVPVQKPSLAPPLINNHHHHQSETCFDVDFCRSKLSSFNYPSNSLSQSVSSSSLDVGVVPDGNTVSDMSYSFGRNSSDSSGIVVVSGNSVGQGATQLCGMDREARVLRYREKRKNRKFEKTIRYASRKAYAETRPRIKGRFAKRTEIDSDVERLYSPGPAVLMLDTPYGVVPSF

SEQ ID NO: 494 - protein, 312 aa, Pisum sativum
  misc_feature: Public GI ID no.60459257
  misc_feature: Bit score of 582.7 for HMM based on sequences of FIGURE 6.
  misc_feature (1)..(48): Pfam Name: zf-B_box Pfam Description: B-box zinc finger
  misc_feature (245)..(289): Pfam Name: CCT Pfam Description: CCT motif
  misc_feature: Functional Homolog Of Ceres SEEDLINE ID no. ME11939 at SEQ ID NO. 456
MATKLCDSCKSTKATLFCRSDSAFLCITCDSNIQAANKLASRHHRVTLCEVCEQAPAHVTCKADAAALCVSCDHDIHSANPPASRHERIPLNTFHHNSKQQFFSESDPDADVSTEEAEAASWLLQTPANPKGPDLNSSHYSFTEIDATDLNFVCVDAKTDSPEQHSPGTADGVVPVQSHSKTVTEHYSDINNDFSTSKPFTYNYNHSVSSSSLEVGVVPDGNVMSEMSYCGYGRTEAVQITAADREARVMRYREKRKNRRFEKTIRYASRKAYAETRPRIKGRFAKRTDLNMNVNLIGEDESYDGYGVVPSC

SEQ ID NO: 495 - protein, 405 aa, Pisum sativum
  misc_feature: Public GI ID no.61611678
  misc_feature: Bit score of 704.7 for HMM based on sequences of FIGURE 6.
  misc_feature (335)..(379): Pfam Name: CCT Pfam Description: CCT motif
  misc_feature (62)..(109): Pfam Name: zf-B_box Pfam Description: B-box zinc finger
  misc_feature: Functional Homolog Of Ceres SEEDLINE ID no. ME11939 at SEQ ID NO. 456
MLEQKFLTTTSATVRSAVTWPRTCDTCRSAPCAVFCRADSAYLCAGCDARIHAANRVASRHERVWVCEACERAPAAFLCKADAASLCSSCDADIHSANPLASRHQRVPILPISGYLYGPPTTLLGADDEGFVRGGGDAEEEEDEGADMEDENEAASWLLLNPLKNNHHNINNHNNNNNSNDHNQEGNNNGFLFSGEVDEYLDLVDCNSCGGGENTFTTNNTHDHDYSRDQQQQRQDHYGVPQKNYVGDSVVPVQQQHLQNFQLGLEFESSKAGFSYNGASISQSVSVSSMDVGVVPESTMRDATTMSYSRPSKGTIDLFSAPPIQMTSHFSPMDREARVLRYLEKKKTRKFEKTIRYASRKAYAETRPRIKGRFAKRTDVEAEVDQMFSTTLITEVGYGIVPSFV

SEQ ID NO: 496 - protein, 391 aa, Solanum lycopersicum
  misc_feature: Public GI ID no.45544881
  misc_feature: Bit score of 808.7 for HMM based on sequences of FIGURE 6.
  misc_feature (322)..(366): Pfam Name: CCT Pfam Description: CCT motif
  misc_feature (52)..(99): Pfam Name: zf-B_box Pfam Description: B-box zinc finger
  misc_feature: Functional Homolog Of Ceres SEEDLINE ID no. ME11939 at SEQ ID NO. 456
MLKKENSNNWARVCDSCHSATCTVYCRADSAYLCAGCDARIHTASLMASRHERVWVCEACERAPAAFLCKADAASLCASCDADIHSANPLARRHHRVPIMPIPGTIYGPPAVHTITGGSMMIGGTTGEGTEDDGFLSLNQDADDTTIDEEDEDEAASWLLLNPPVKNNNKNNNYGMLFGGEVVDDYLDLAEYGGDSQFNDQYSVNQQQQHYSVPQKSYVEDSVVPVQNGQRKSLILYQTPQQQQSHHLNFQLGMEYDNSNTGYGYPASLSHSVSISSMDVSVVPESAQSETSNSHPRPPKGTIDLFSGPPIQIPPQLTPMDREARVLRYREKKKNRKFEKTIRYASRKAYAETRPRIKGRFAKRTDVEAEVDQMFSTQLMTDSNYGIVPSF

SEQ ID NO: 497 - protein, 409 aa, Solanum lycopersicum
  misc_feature: Public GI ID no.45544887
  misc_feature: Bit score of 722.7 for HMM based on sequences of FIGURE 6.
  misc_feature (340)..(384): Pfam Name: CCT Pfam Description: CCT motif
  misc_feature (59)..(106): Pfam Name: zf-B_box Pfam Description: B-box zinc finger
  misc_feature: Functional Homolog Of Ceres SEEDLINE ID no. ME11939 at SEQ ID NO. 456
MLKKENSGGLDGSSNYWARVCDSCRSVTCTIYCQADSAYLCADCDARIHAASLVTSRHKRVWVCEACERAPAAFLCKADAASLCASCDADIHSANPLAHRHHRIPIITIPGTLYGPPAVETVGGDSMMISGSTGEGTEDDGFLSLTQDADDTIIDEEDEDEDEAASWLLLNHPVKNNNKNNVNNNNNQTNNYDMLFGGEVVDDYLDLAEYGGDSQFNDQYNVNQQQQQYFVPQMSYGGDSVVPVQDGQGKPLIFYQQQQQQQQSHHQNFQLGMEYDNSNTRLGLPASMSHSVSVVSMDVSVVPESALCETSNSQPRPQKGTIELFSGHPIQIPLLTPMDREARVLRYREKKKNRKFEKTIRYASRKAYAETRPRIKGRFAKRTDVEAEVDQMFSTQLMTDSSYRIVPSF

SEQ ID NO: 498 - protein, 369 aa, Triticum aestivum
  misc_feature: Public GI ID no.36789802
  misc_feature: Bit score of 726.0 for HMM based on sequences of FIGURE 6.
  misc_feature (299)..(343): Pfam Name: CCT Pfam Description: CCT motif
  misc_feature (65)..(112): Pfam Name: zf-B_box Pfam Description: B-box zinc finger
  misc_feature: Functional Homolog Of Ceres SEEDLINE ID no. ME11939 at SEQ ID NO. 456
MFMNCNFNSNLLENEAGRISFPWARPCDGCHAAPSTVYCCADAAYLCASCDTQVHSANRVASRHERVRVCETCESAPAVLACHADAAALCTACDAQVHSANPIAQRHQRVPVLPLPAVAIPAASGFAEAEASVTAHGDKEEGEEVDSWLLRRNSDDNNCANKIDRYYNLVGYNMYYDNITCDPRPEEQYRMQEQHVQNRYIEKEGCECVVPPQVVMASEQQESDYGTIGAGQAASVTAMTSTYTASISNDISFSSMEVGIVPDNSRPDISNSNILTSSEAMELSGHSLQMPVHFSSMDREARVLRYKEKKQTRKFQKTIRYATRKAYAEARPRIKGRFAKRSDIEHEEDHMLSPPALPDTSSYNTVPWF

SEQ ID NO: 499 - protein, 370 aa, Triticum aestivum
  misc_feature: Public GI ID no.36789793
  misc_feature: Bit score of 713.0 for HMM based on sequences of FIGURE 6.
  misc_feature (300)..(344): Pfam Name: CCT Pfam Description: CCT motif
  misc_feature (65)..(112): Pfam Name: zf-B_box Pfam Description: B-box zinc finger
  misc_feature: Functional Homolog Of Ceres SEEDLINE ID no. ME11939 at SEQ ID NO. 456
MFMNCNFNSNLLEKEAGRTSFPWARPCDGCHAAPSAVYCCADAAYLCASCDTQVHSANRVASRHERVRVCETCESAPAVLACHADAAALCTACDAQVHSANPIAQRHQRVPVLPLPAVALPAASGFVEAEASVTAHGDKEEGEEVDSWLLRRNSDDNNCANKIDRYFNLVGYNMYYDNITCDPRPEEQYRMQEQQHVQNRYIEKEGCECVVPPQVVMASEQQESDYGTIGAGQAASVTAMTSTYTASISNDISFSSMEVGIVPDNTRPDISNSNILTSSEAMELSGHSLQMPVHFNSMDREARVLRYKEKKQTRKFQKTIRYATRKAYAEARPRIKGRFAKRSDIEHEEDHMLSPPALQDTSSYNTAPWF

SEQ ID NO: 500 - DNA, 1457 bp, Triticum aestivum
  misc_feature: Ceres CLONE ID no.907473
  misc_feature: Encodes the peptide sequence at SEQ ID NO. 501
gtttttaactcgacttagccaagtttggcaaacgaacaggccccgtggccccgcccccgcgcgacagcgaccgggcgcccgaagtgtctcgcgctcgcccacggcacccgagcggagcccccgcccctaccatgtgctctccctgcccgcagacccctcaaaacccacccgcgcccgcacccaggcaccgagcacccagcagaaagaaacgcaccaaatctttatcccctgccctcagcagtgccgacctgagcgccggagatctgcggcgagcgagatgaaagtggaggagcagacggtggtgggaggaggaggaggggggctctgggggctggccgggcggccgtgcgacacgtgcgccgtggacgcggcgcggctctactgccggtcggacggcgcctacctctgcgccgggtgcgacgcgcgcgctcacggggccggctcccgccacgcgcgcgtctggctctgcgaggtctgcgagcacgcgcccgccgcggtcacctgccgcgccgacgccgccgcgctctgcgccacgtgcgacgccgacatccactccgccaacccgctcgccagccggcacgagcgcctccccgtcacgcctttcttcggcgcgctcgccgacccgccccagcccgccccctccccgtcctccgccgccgcgacgcaggaggacgcggacgacgacgggagcaacgaggccgaggcggcctcctggcttcttcccgagcctggcgatagccccgaggacagcaccgctaccttcttccctgactcggacgcgtacctcgatctggacttcgtccggtctatggacgggatcaaggccatcggggtgcccgtcgccccttccgagctcgacgtcgccggcggcgctctcttctaccccgaacactccatgaaccacagcatgtcaacgtccgaggtcgcggtggtgccggacgcgctgtcagccggcggggccccggcgccggcgccgtcggtggcggtggtggctagcaaggggaaggagcgggaggcccggctgatgcggtaccgggagaagcgcaagaaccggaggttccagaagaccatccgctacgcgtcccgcaaggcgtacgccgagacgcggccgcgcatcaagggccggttcgccaagcgcaccgccgaggacgacgcgctggagcgggacgggccgttctcgcccgcgtcgtcggcgcacctggcgtcggacggtgactacggcgtcgtgccgtccttctgaggagaccggcgacggcgacggcgactctgctgtagttttggcgcgcgcatccatccgagtgcgctcgcgtgcggtggctgcgacgcgcgctccgtgtaacattgaataatctgtacagttttgttccatgggattagtgccgtgaccgtgccgacctgaaaaaaaaaaaaaaaaaaaaaaaaaaaaaaaaaaaaaaaaaagaaaaaaaaaaaaaaaa

SEQ ID NO: 501 - protein, 320 aa, Triticum aestivum
  misc_feature: Ceres CLONE ID no.907473
  misc_feature: Bit score of 537.0 for HMM based on sequences of FIGURE 6.
  misc_feature (245)..(289): Pfam Name: CCT Pfam Description: CCT motif
  misc_feature (64)..(106): Pfam Name: zf-B_box Pfam Description: B-box zinc finger
  misc_feature: Functional Homolog Of Ceres SEEDLINE ID no. ME11939 at SEQ ID NO. 456
MKVEEQTVVGGGGGGLWGLAGRPCDTCAVDAARLYCRSDGAYLCAGCDARAHGAGSRHARVWLCEVCEHAPAAVTCRADAAALCATCDADIHSANPLASRHERLPVTPFFGALADPPQPAPSPSSAAATQEDADDDGSNEAEAASWLLPEPGDSPEDSTATFFPDSDAYLDLDFVRSMDGIKAIGVPVAPSELDVAGGALFYPEHSMNHSMSTSEVAVVPDALSAGGAPAPAPSVAVVASKGKEREARLMRYREKRKNRRFQKTIRYASRKAYAETRPRIKGRFAKRTAEDDALERDGPFSPASSAHLASDGDYGVVPSF

SEQ ID NO: 502 - DNA, 1552 bp, Zea mays subsp. mays
  misc_feature: Ceres CLONE ID no.1674443
  misc_feature: Encodes the peptide sequence at SEQ ID NO. 503
agctgcgctgcctccctccactactacgccagccactctgccttccctcccccaccaccacaagaaccgcttcaccattgccgcgccgcgtccagctgagcctcctcttagccgcgccagccaggagaaggcgcgcgcgcacacctgctgcttggtgaccgcgttcgatggagctgcacaagtactggggcgtggggggccggcggtgcggcagctgcgagggggccccggcggcggtgcactgccgcacgtgcgttggtggatccttcctctgcacgacgtgcgacgcccgccccgcgcacgcgcgcctgggccacgagcgcgtgtggatgtgcgaggtctgcgagctggcccccgccgccgtcacgtgcaaggccgacgccgccgtgctctgcgccgcttgcgactccgacatccacgacgccaacccgctggcccggcgccacgcgcgggtccccgtcgcccccatcggctccgaggccgccgccgcggccgtggaggccatgctgttcgggaccggcgaggcggccgcttccgaggccgacgagcagcacgcggcggccgagcacgcgcacgcgcacgcgctgaacctcaacgtggaggccaaggacatgaagctggactacctcttctctgaactggatccctacctcagcgtcgagatcccgcgcttccagcacgctgacagcgtcgtccccaacggcgccggcgctgccgtcgagctggacttcacgtgcggcatcggcgttaagcactcctcctacagctcctacacggccacctccctcgctcatagcggctcctcgtcggaggttggcgtggtgccagaggccttcggcggcagcggcagcggcggcgggagctttgagctcgacttcacaaggcccaagcctcaggcctacatgccatacaccgggactccccagagccacagcgtgccatccgcggacgtggaggtggtgccggagcggggagacttggctgcggtgaggccggtgccgctgatgggggagagcagggaggcgcgcctgatgcggtaccgtgagaaaaggaagaacaggcgcttcgagaagaccatccggtacgcgtcccggaaggcctacgccgagacgcggccgcgaatcaagggccggtttgccaagcgtgctgaccacgacggggacgccgacgccgacgacgctgaggccgaggccgaggccgaggccgccgtgccgatgtcatatgtgctcgacttcggctacggcgtcgtaccgagcttttgatgtgcccgggcccaacacgcgcgcacatggccggccgcgcgcttgaaccggcatggcacgccgctgcgcgcgcgccttgtacttgtatcgatcgatgtatagggaggagtagtaatcccatgtactctctttttgagcaagctcttgcgtaaactagtgatgtataatttgtactactagtaagaaactgcagtagccgctgctaatggatcaccaatctataccgcgcaaaaaaaaaaaaaaaaaaaaaaaaaaaaaaaaaaaaaaaaaaaagaaaaaaaaaaaaaaaa

SEQ ID NO: 503 - protein, 364 aa, Zea mays subsp. mays
  misc_feature: Ceres CLONE ID no.1674443
  misc_feature: Bit score of 253.3 for HMM based on sequences of FIGURE 6.
  misc_feature (284)..(328): Pfam Name: CCT Pfam Description: CCT motif
  misc_feature (51)..(98): Pfam Name: zf-B_box Pfam Description: B-box zinc finger
  misc_feature: Functional Homolog Of Ceres SEEDLINE ID no. ME11939 at SEQ ID NO. 456
MELHKYWGVGGRRCGSCEGAPAAVHCRTCVGGSFLCTTCDARPAHARLGHERVWMCEVCELAPAAVTCKADAAVLCAACDSDIHDANPLARRHARVPVAPIGSEAAAAAVEAMLFGTGEAAASEADEQHAAAEHAHAHALNLNVEAKDMKLDYLFSELDPYLSVEIPRFQHADSVVPNGAGAAVELDFTCGIGVKHSSYSSYTATSLAHSGSSSEVGVVPEAFGGSGSGGGSFELDFTRPKPQAYMPYTGTPQSHSVPSADVEVVPERGDLAAVRPVPLMGESREARLMRYREKRKNRRFEKTIRYASRKAYAETRPRIKGRFAKRADHDGDADADDAEAEAEAEAAVPMSYVLDFGYGVVPSF

SEQ ID NO: 504 - DNA, 1364 bp, Zea mays subsp. mays
  misc_feature: Ceres CLONE ID no.1559496
  misc_feature: Encodes the peptide sequence at SEQ ID NO. 505
aactgacacccgtggcatccctctcgtgactcccggagcggaggcatggacaccgcggcggagctggagctggggctggagttggagcagaagccggcggcggggtactggagcgtggtgggcgcgcgcccttgcgacgcgtgcgccgcggagccggcgcggctgcactgccgcgcggacggcgcgttcctgtgccccggctgcgacgcccgggcgcacggcgccgggtcgcgccacgcgcgcgtctggctgtgcgaggtctgcgagcacgcccccgccgtcgtcacctgccgcgccgacgccgccgcgctctgcgccgcctgcgacgccgacatccactcggccaacccgctcgcgcgccgccacgagcgcctccccatcgcccctctcttcggcgcgctcgcggacgcgccgcagcccttcccgtccccggccctcgctgccgccgcgggggccgaggccccggccccgaccccggctcagggtgaagcggtggcggaagactacgggagcagcgaggccgaggcggcgtcgtggttgctccccgagcccgacaacagccacgaggacagcgccgccgacacgttcttcgcggagtcggacgcgtacctcggcgccgacctcgacttcgcccggtgcatggacggcgtcaaggccatcggcgtgccggtcgcgccgcccgagctggacatcggtgccggcagcttttgctaccccgaacactccatgaaccacattttgtcgtcatcctcggaggtggcggtggtaccggacgcgcaggcggccggtctgccggtggtggtggtggtgagcagaggggaggagcgggaggcgcggctgatgcggtaccgtgagaagcgcaagaaccgccggttcgacaagaccatccgctacgcgtcccgcaaggcgtacgccgagacgcggccgcgcatcaagggccgcttcgccaagcgccgttccgcggagggcgaggacgaggcgctggagcacgaggaaggggcgtgcttctcgcccgcggggtcggcgcccgccgcgtcggacggcgtcgtcccgtccttgtgttgaggggagaagacgacgacgaccccggcagacggctgcttaactttgccagctctgtcgaccctgaaccttttttttttccctcccccaccttctctcttttgatcgaggggttgccagctctggatctgaaactctgaacgcatgggacgcgagctgtgtgtagcatgaataactgcgtagtttgttggatggacgaactcaatcgcgctcgcatggaatggaactcttgtaatccaccctttgtacattaccatctagagttgctccttttttccatgagccaaaaaaaaaaaaaaaaa

SEQ ID NO: 505 - protein, 339 aa, Zea mays subsp. mays
  misc_feature: Ceres CLONE ID no.1559496
  misc_feature: Bit score of 387.5 for HMM based on sequences of FIGURE 6.
  misc_feature (261)..(305): Pfam Name: CCT Pfam Description: CCT motif
  misc_feature (70)..(112): Pfam Name: zf-B_box Pfam Description: B-box zinc finger
  misc_feature: Functional Homolog Of Ceres SEEDLINE ID no. ME11939 at SEQ ID NO. 456
MDTAAELELGLELEQKPAAGYWSVVGARPCDACAAEPARLHCRADGAFLCPGCDARAHGAGSRHARVWLCEVCEHAPAVVTCRADAAALCAACDADIHSANPLARRHERLPIAPLFGALADAPQPFPSPALAAAAGAEAPAPTPAQGEAVAEDYGSSEAEAASWLLPEPDNSHEDSAADTFFAESDAYLGADLDFARCMDGVKAIGVPVAPPELDIGAGSFCYPEHSMNHILSSSSEVAVVPDAQAAGLPVVVVVSRGEEREARLMRYREKRKNRRFDKTIRYASRKAYAETRPRIKGRFAKRRSAEGEDEALEHEEGACFSPAGSAPAASDGVVPSLC

SEQ ID NO: 506 - DNA, 1159 bp, Glycine max
  misc_feature: Ceres CLONE ID no.530984
  misc_feature: Encodes the peptide sequence at SEQ ID NO. 507
atcgcttccacaccacaccctattcccaaacaaaaacaacacatcacggagccaccaaccatggcttccaagctctgcgactcatgcaaatccgccactgctaccttgtactgccgccctgacgccgcgttcctctgcggcgcctgcgattctaaggtccacgccgccaacaagctcgcgtcgcgccacccgcgcgtggcgctctgcgaggtgtgcgagcaggccccggcgcacgtaacctgcaaggctgatgccgccgcgctctgccttgcctgcgaccgcgacatccactccgccaaccccctcgccagccgccacgagcgcatccccgtctcaccgttcttcgagtccgtacactccgtcaaggcctcctcgccgatcaacttcctagatgaccaccgcttcttctccgacgccgatgctgacgtcagcaccgaggaggccgaggccgcctcctggctgcttcctaatccgaagacagatctaaattcctctcagtacttgttctccgaaaccgagccggttccttacatagatctggattatgctgccgtggatcctaaggcggagcagaaaagctccgccaccgccgacggcgtcgttcccgtgcagagcaacttcgagccattcgcctacggttacaagtacaataccactctctcacagtctcagatgagccagagtgtatcgtcgtcgtcgatggaggttggagtcgtgccggacgggaacacaatgtcggagacatcgaactgcagctacagcaaggtgcctccggtgacggtgacggtgacggcgcagttctcggcggcggatagggaggcgagagtgttgaggtacagggagaagaggaagaaccgtaagttcgagaagacgattcgttacgcatcgagaaaagcatatgcggaggcgaggccaaggatcaaagggaggtttgcgaaacgcactgacccggaccctctggctggatacggcgtcgttccgtcgtgttgatttcgctatgatgttaatcatatatatcattatatgaatatgaatgatgctgttgtttttgctgtatatacactatgctcttttcttttttgtttgaattatgcaatgtaaagttgcaaaaacacatttgtgatagattttgtagtttgttaaaaaaaaaaaaaaaaaa

SEQ ID NO: 507 - protein, 309 aa, Glycine max
  misc_feature: Ceres CLONE ID no.530984
  misc_feature: Bit score of 512.4 for HMM based on sequences of FIGURE 6.
  misc_feature (1)..(48): Pfam Name: zf-B_box Pfam Description: B-box zinc finger
  misc_feature (252)..(296): Pfam Name: CCT Pfam Description: CCT motif
  misc_feature: Functional Homolog Of Ceres SEEDLINE ID no. ME11939 at SEQ ID NO. 456
MASKLCDSCKSATATLYCRPDAAFLCGACDSKVHAANKLASRHPRVALCEVCEQAPAHVTCKADAAALCLACDRDIHSANPLASRHERIPVSPFFESVHSVKASSPINFLDDHRFFSDADADVSTEEAEAASWLLPNPKTDLNSSQYLFSETEPVPYIDLDYAAVDPKAEQKSSATADGVVPVQSNFEPFAYGYKYNTTLSQSQMSQSVSSSSMEVGVVPDGNTMSETSNCSYSKVPPVTVTVTAQFSAADREARVLRYREKRKNRKFEKTIRYASRKAYAEARPRIKGRFAKRTDPDPLAGYGVVPSC

SEQ ID NO: 508 - protein, 375 aa, Medicago truncatula
  misc_feature: Public GI ID no.92875402
  misc_feature: Bit score of 685.7 for HMM based on sequences of FIGURE 6.
  misc_feature (298)..(342): Pfam Name: CCT Pfam Description: CCT motif
  misc_feature (60)..(107): Pfam Name: zf-B_box Pfam Description: B-box zinc finger
  misc_feature: Functional Homolog Of Ceres SEEDLINE ID no. ME11939 at SEQ ID NO. 456
MGIERGGLKSLRGGWSVPPKLCDSCKLTPAALFCRSDSAFLCINCDSTIHSANKLSSRHERVWMCEVCEQAPASVTCKADAAALCVTCDSDIHSANPLARRHERVPVEPFFDSAESVVKSSSAAAAAAASFNFVVPTDDGYGQDDAEAAAWLIPNPNFGSKLNETQDIKTREMFFSDMDPFLDFDYSNNFQNNNCSNAMNDSVVPVQTKPTPAPMMNHNSEGCFDIDFCRSKLSSFNYPSHSISHSVSSSSLDVGVVPDGNTVSEISYNFGSESMVSGGVNSSNQGVQGATQLCGMDREARVMRYREKRKNRKFEKTIRYASRKAYAETRPRIKGRFAKRTEIDSDVDRLYNPADPLSVPSSMLMDCPYGVVPTF

SEQ ID NO: 509 - protein, 312 aa, Pisum sativum
  misc_feature: Public GI ID no.61611682
  misc_feature: Bit score of 588.1 for HMM based on sequences of FIGURE 6.
  misc_feature (1)..(48): Pfam Name: zf-B_box Pfam Description: B-box zinc finger
  misc_feature (245)..(289): Pfam Name: CCT Pfam Description: CCT motif
  misc_feature: Functional Homolog Of Ceres SEEDLINE ID no. ME11939 at SEQ ID NO. 456
MATKLCDSCKSTKATLFCRSDSAFLCITCDSNIHAANKLASRHHRVTLCEVCEQAPAHVTCKADAAALCVSCDHDIHSANPLASRHERIPLNTFHHNSKQQFFSESDPDADVSTEEAEAASWLLQTPANPKGPDLNSSHYSFTEIDATDLNFVCVDAKTDSPEQHSPGTADGVVPVQSHSKTVTEHYSDINNDFSTSKPFTYNYNHSVSSPSLEVGVVPDGNVMSEMSYCGYGRTEAVQITAADREARVMRYREKRKNRRFEKTIRYASRKAYAETRPRIKGRFAKRTDLNMNVNLIGEDESYDGYGVVPSC

SEQ ID NO: 510 - protein, 413 aa, Solanum tuberosum
  misc_feature: Public GI ID no.118406898
  misc_feature: Bit score of 811.9 for HMM based on sequences of FIGURE 6.
  misc_feature (344)..(388): Pfam Name: CCT Pfam Description: CCT motif
  misc_feature (59)..(106): Pfam Name: zf-B_box Pfam Description: B-box zinc finger
  misc_feature: Functional Homolog Of Ceres SEEDLINE ID no. ME11939 at SEQ ID NO. 456
MLKKEKSGGFDRSSNNWARVCDSCHSATCTVYCRADSAYLCAGCDSRIHAASLMASRHERVWVCEACERAPAAFLCKADAASLCASCDAVIHSANPLARRHHRVPIMPIPGTLYGPPAVHTVSGGSMMIGGTTGEGTEDDGFLSLTQDADDTTIDEEDENEAASWLLLNPPVKNNNKNNINNNNNNQNNNYGMLFGGEVVDEYLDLAEYGGDSQFNDQYSVNQQQQHYSVPQKSYVEDSVVPVQNGQRKSLILYHQPQQQQQQQQQSHHLNFQLGMEYDNSNTGYGYPASLSHSVSISSMDVSVVPESALSETSNSHPRPPKGTIDLFSGPPIQIPPQLTPMDREARVLRYREKKKNRKFEKTIRYASRKAYAETRPRIKGRFAKRTDVKAEVDQMFSTQLMTDSSYGIVPSF

SEQ ID NO: 511 - protein, 369 aa, Lolium perenne
  misc_feature: Public GI ID no.107770485
  misc_feature: Bit score of 682.8 for HMM based on sequences of FIGURE 6.
  misc_feature (300)..(344): Pfam Name: CCT Pfam Description: CCT motif
  misc_feature (65)..(112): Pfam Name: zf-B_box Pfam Description: B-box zinc finger
  misc_feature: Functional Homolog Of Ceres SEEDLINE ID no. ME11939 at SEQ ID NO. 456
  misc_feature (168)..(168): Xaa is any aa, unknown, or other
  misc_feature (326)..(326): Xaa is any aa, unknown, or other
MLMNCDFNCDLFEQEAKRRSYPWARPCDGCHAAPSAVYCHADAAYLCASCDTQVHSANRLASSHERVRVCVSCESAAAVLECHADSAALCTTCDAQVHSANPIAQRHQRVPVLPLPALAIPAASVFAEAEAATTVYGDKEEGEEVDSWLLLERDSDDNNCTNNIDQYXNLFGYDMYYDKFSCNPGPGEEYRLQEQDVQNMYRENEVCEFAVPSQVGMASEQPESSYGMIGAEQDASMTAGTSTYTASISNGIPFSSMEVGIIPDNTRPDVSNTNIQRTSEAMELAGHSLQMPVHFSSMDRDARVLRYKEKKQARTFQKTIRYATRXAYAEARPRIKGRFAKRSDIEHELDQMLTIPALPDSGHATVLWF

SEQ ID NO: 512 - protein, 369 aa, Triticum aestivum
  misc_feature: Public GI ID no.36789785
  misc_feature: Bit score of 696.9 for HMM based on sequences of FIGURE 6.
  misc_feature (299)..(343): Pfam Name: CCT Pfam Description: CCT motif
  misc_feature (65)..(112): Pfam Name: zf-B_box Pfam Description: B-box zinc finger
  misc_feature: Functional Homolog Of Ceres SEEDLINE ID no. ME11939 at SEQ ID NO. 456
MFMNCNFNSNLLENEAGRISFPWARPCDGCHAAPSAVYCCADAAYLCASCDTQVHSANRVASRHERVRVCETCESAPAVLACHADAAALCTACDAQVHSANPIAQRHQRVPVLPLPAVAIPAASGFAEAEASVTAHGDKEEGEEVDSWRLRRNSDDNNCANKIDRYYNLVGYNMYYNNITCDPRPEEQYRMQEQRVQNRYIEKQGCECVVPPQVVMASEQQESDYGTRGAGQAASVTAITSTYTASISNDISFSSMEVGIIPDNTRPDISNSNILTGSEAMELSGHSLQMPVHFSSMDREARVLRYKEKKQTRKFQKTIRYATRKAYAEARPRIKGRFAKRSDIEHEEDHMLSPPALPDTSSYNTVPWF

SEQ ID NO: 513 - DNA, 1443 bp, Triticum aestivum
  misc_feature: Ceres CLONE ID no.702632
  misc_feature: Encodes the peptide sequence at SEQ ID NO. 514
acctcagatcaatcactcttccctcccactactcccaccgcgttcacccgccattgcctgtcgaagctacgagattagttactagtatgatggagctgcgcaagtactggggcgtgggggggaggaggtgcggggcgtgcgagggggcggcgccggcggcggtgcactgccgggattgcgccgggtacctgtgcacggggtgcgacgcgcggccggcgcacgcgcgggctggccacgagcgcgtctgggtgtgcgaggtctgcgaggtcagccccgcggccgtgacgtgcaaggccgacgccgccgtgctctgcgccgtgtgcgacgccgacatccaccacgccaacccgctcgccgagcgccacgtgcgcgtgcccatcgcgcccatctgctcccccgaggccgccgcggtggcggccgaggccatgatgttctgtggcgccggtgacggcgaggcgcgggcggatcaggacgacgtgcccgagcagctgcaccaacacggggggatgctgaaacctcaacgtggaggccggcaaggagggccggaagatggactacctcttctccgacctcgtcgacccctacctcgctgtcgactttacgcgcttcgcccacgctgacagcgtcgtgcccagcggcgtcgccaccggcgccgtacccgccgtcgtggacctggacttcgcgtgcgggatcggcgccaagccgccggcgacctacagctcctcgtacacggccaacgcctccggcgcgcacagcggctcttcatcggaggtcagcgtggtgccggaggccatctgcggcggcgtcgggagcttcgagatcgacttcacccggcccaagccgcagccgtacatgcccgcgtacaccgcggcaccgccgagccatggggtgagcgcgcagcaggcgtggccggtggacatggggtacttgacggtgccggagcgtccggtggcggtgaccggggagggcagggtggcgaggctgatgcggtaccgggagaagaggaagaaccgccggttcgagaagaccatccggtacgcgtccaggaaggcctacgccgagtcgcggccgcgcgtcaagggccgcttcgccaagcgcaccgaccaggacgccgacggcgacgacgtggacgcggaggcccatgccgtgccgtcttccacgtcctacttgctcgactttggctacggcgtcgtgccgtccttctgatccgccggcccggcgccccggccggcggccttgtacttgtaccattgatgcatgtacagtagtacgtaggggactagtaatccatccatgtactcctcctgagctagttcgatcgcgcttttgatgtactagtaatactgtaaactgtaacagtagtagtactttggccaatatgctcgtttatttttggatggccgaaactagtagcccaaacatttggatcatcaatcattattt

SEQ ID NO: 514 - protein, 372 aa, Triticum aestivum
  misc_feature: Ceres CLONE ID no.702632
  misc_feature: Bit score of 231.4 for HMM based on sequences of FIGURE 6.
  misc_feature (295)..(339): Pfam Name: CCT Pfam Description: CCT motif
  misc_feature (51)..(98): Pfam Name: zf-B_box Pfam Description: B-box zinc finger
  misc_feature: Functional Homolog Of Ceres SEEDLINE ID no. ME11939 at SEQ ID NO. 456
MMELRKYWGVGGRRCGACEGAAPAAVHCRDCAGYLCTGCDARPAHARAGHERVWVCEVCEVSPAAVTCKADAAVLCAVCDADIHHANPLAERHVRVPIAPICSPEAAAVAAEAMMFCGAGDGEARADQDDVPEQLHQHGGMLNLNVEAGKEGRKMDYLFSDLVDPYLAVDFTRFAHADSVVPSGVATGAVPAVVDLDFACGIGAKPPATYSSSYTANASGAHSGSSSEVSVVPEAICGGVGSFEIDFTRPKPQPYMPAYTAAPPSHGVSAQQAWPVDMGYLTVPERPVAVTGEGRVARLMRYREKRKNRRFEKTIRYASRKAYAESRPRVKGRFAKRTDQDADGDDVDAEAHAVPSSTSYLLDFGYGVVPSF

SEQ ID NO: 515 - protein, 376 aa, Festuca pratensis
  misc_feature: Public GI ID no.61657299
  misc_feature: Bit score of 426.1 for HMM based on sequences of FIGURE 6.
  misc_feature (307)..(351): Pfam Name: CCT Pfam Description: CCT motif
  misc_feature (34)..(66): Pfam Name: zf-B_box Pfam Description: B-box zinc finger
  misc_feature: Functional Homolog Of Ceres SEEDLINE ID no. ME11939 at SEQ ID NO. 456
MNSNSSSTIYDEAVGQEGSWRRLCDGCCMVPSVVYCHADSAYLCASCDVRIHSANRVASRHERVCLSVAHEHAPALLQCRTDAVASCAAYEAQAHYANLLAGMHQCVPVVSHPATAILADSLLAEAAVATTIRSCKEEEASWLLLSKNSANHNCSGDNRSSSTYFGEVDEYFDLVGYNSYYDSRMNNNRAQYVMQEQQHLQPMQKEYAEKEGSECVVPSQFATVSKPQQSGYALVGAEQAASMTAGVSVYTDSVNNSISFSSMEGGIVPDNTVVDLPHSIIPTPAGASSLHSGPPLQMPLHFSSMDREAKVLRYKEKKKTRTFEKTTRYATRKAYAEARPRIKGRFAKISEAEMEVDQMFSAAALSDSSYSTVPWF

SEQ ID NO: 516 - protein, 417 aa, Ipomoea nil
  misc_feature: Public GI ID no.10946337
  misc_feature: Bit score of 609.3 for HMM based on sequences of FIGURE 6.
  misc_feature (348)..(392): Pfam Name: CCT Pfam Description: CCT motif
  misc_feature (77)..(119): Pfam Name: zf-B_box Pfam Description: B-box zinc finger
  misc_feature: Functional Homolog Of Ceres SEEDLINE ID no. ME11939 at SEQ ID NO. 456
MLKEESCEVLDLDVTIGSSSGSRSGNKQNWARVCDICRSAACSVYCRADLAYLCGGCDARVHGANTVAGRHERVLVCEACESAPATVICKADAASLCAACDSDIHSANPLARRHHRVPILPISGTLYGPPTSNPCRESSMMVGLTGDAAEEDNGFLTQDAEETTMDEDEDEAASWLLLNPNPNPNPNPVKSNNSTNMCKGGNNNNNEMSCAVEAVDAYLDLAEFSSCHNNLFEDKYSINQQQNYSVPQRNMSYRGDSIVPNHGKNQFHYTQGLQQHNHHAIFNCKEWNMRILTRDMVSISSMDVGVVPESTLSDTSISHSRASKGTIDLFSGPPIQMPPQLQLSQMDREARVLRYREKKKTRKFEKTIRYASRKAYAETRPRIKGRFAKRTDVDTEVDQIFYAPLMAESGYGIVPSF

SEQ ID NO: 517 - DNA, 1357 bp, Panicum virgatum
  misc_feature: Ceres CLONE ID no.1996408
  misc_feature: Encodes the peptide sequence at SEQ ID NO. 518
aaaaacacccccgaggccaaccatttccgacgcaaaaccccccggaatccgtgacacccgcccggaggagagcagagcagaggcaccaggcatggacgccgcggtggagctggagctggagcagaagccggcggtggggtactggggcttggccggcgcgcggccctgcgacgcgtgcgccgcggaggcggcgcggctgcactgccgcgcggacggcgccttcctgtgccccgggtgcgacgcccgcgcgcacggcgccgggtcgcgccacgcgcgcgtctgtctctgcgaggtctgcgagcacgcccccgccgccgtcacgtgccgcgccgacgccgccgcgctctgcgcggcctgcgacgccgacatccactcggccaacccgctcgcgcgccgccacgagcggctccccgtcgcgcccttcttcggcgcgctcgccgacgcgccgcagccgttcccgtcctcagccttcgccgccgcgggggtccaggcccagggggacgcggctgcggacgacgacgggagcaacgaggccgaggccgcctcgtggctcctccccgagcccgacaactgccacgaggacagcgccgccsccaccgacgccttcttcgctgactccgacgcgtacctcggcktckacctcgacttcssccggtccatggacggcatcaaggccatcggcgtgccggtcgcgccgcccgagctggacatggccaccggcggttactactaccccgaacactccgtgaaccacagcgtgtcgtcgtcggaggtggcggttgtgccggacgccctggcgggcggcgccccggccgcgccggcggtgccggcggcgagccgggggaaggagcgggaggcgcggctgatgcggtaccgcgagaagcgcaagaaccggcggttcgacaagaccatccggtacgcgtcccgcaaggcgtacgccgagactcggccgcgcatcaagggccgcttcaccaagcgctgctcctccgcggaggccgaggccgargacgaggcgctgctggagcacgaggaagcggcgtgcttctcgcccgcggcgtcggcgcccgcggcctcctcggacggcgtcgtcccgtcctgctgaggggacacgacgggcggcggccgcgcctcctcctcccaggctccccggcggcgaccccttaattttgccgactctgaatcgatcccaacgcatgcgaacatgcgatgcgatgcgcgctccgtgcagcacatgaataattgtacagtagttccacgaactcgatcgtggtcgcacggaatcgcatgtaatcctcctcaccgtccttgtaatccagccttgtacattaccgtctagaggtgtttgtgcttctctcgc

SEQ ID NO: 518 - protein, 336 aa, Panicum virgatum
  misc_feature: Ceres CLONE ID no.1996408
  misc_feature: Bit score of 376.0 for HMM based on sequences of FIGURE 6.
  misc_feature (254)..(298): Pfam Name: CCT Pfam Description: CCT motif
  misc_feature (66)..(108): Pfam Name: zf-B_box Pfam Description: B-box zinc finger
  misc_feature: Functional Homolog Of Ceres SEEDLINE ID no. ME11939 at SEQ ID NO. 456
  misc_feature (168)..(168): Xaa is any aa, unknown, or other
  misc_feature (182)..(182): Xaa is any aa, unknown, or other
  misc_feature (183)..(183): Xaa is any aa, unknown, or other
  misc_feature (187)..(187): Xaa is any aa, unknown, or other
MDAAVELELEQKPAVGYWGLAGARPCDACAAEAARLHCRADGAFLCPGCDARAHGAGSRHARVCLCEVCEHAPAAVTCRADAAALCAACDADIHSANPLARRHERLPVAPFFGALADAPQPFPSSAFAAAGVQAQGDAAADDDGSNEAEAASWLLPEPDNCHEDSAAXTDAFFADSDAYLGXXLDFXRSMDGIKAIGVPVAPPELDMATGGYYYPEHSVNHSVSSSEVAVVPDALAGGAPAAPAVPAASRGKEREARLMRYREKRKNRRFDKTIRYASRKAYAETRPRIKGRFTKRCSSAEAEAEDEALLEHEEAACFSPAASEPAASSDGVVPSC

SEQ ID NO: 519 - DNA, 1258 bp, Panicum virgatum
  misc_feature: Ceres CLONE ID no.1725313
  misc_feature: Encodes the peptide sequence at SEQ ID NO. 520
aacgctcacacacaaacgcaagaagctcaaagaagctgaggcaagctcaagagagaaaaagaaaaagaagcctagctagaactagaaggaggctcaaagggatgatgggaagcgaaggcagcacgagcccagcggcggggggagcctcctgcgcggtctgcggcggcgcggcggcggtgtactgcgcggcggacgcggcggcgctctgcagcccctgcgacgccgctgtgcacgcggccaacctgctggcgtcgcgccacgagcgcgtgcctctcgccatggccgcggcggcggcggcggcatccggcgtgtacgacgacctcttcgcgcccgacgacgtcgacgccgcgtcgtcgtggccggaggcggcggcgcccgcgcaggggcaggggagcccccaccagaacggcagctcgtcgaccagcttcaccaccagcgacagcggcgcggagggcaggagcctgttcgacctgctctccgacgtcgacctcgcgacggccgcctgcgtcacgggcggcgggtacctgccggacggcttggcacccgtccatcacggcggcgctgcggctccgctgtggtcgcagcccggcatggccgcgtgggcggccgcgtggtcctccccagcggataccgcggccgtcgtcgtcccgggcgccgccgccgtggtcgccgcggcggcggagcgggtggcgagggtgcagaggtaccgcgagaagcgcaagaaccgcaagttccagaagaccatccgctacgcgtcccgcaaggcctacgccgaggcccgcccgaggatcaagggccgcttcgtcaagcgcgcccccgccgccgccgccgccacgaacgcctccgacacggccaagttctggctctccttctccgacgacgcccgcgacgacggcgtcgggttctacgtcgacgccgcggcctacggtgtcgtgccaagcttctagaatgtttcgccctgcaggcccagcttaaagcaagttaagaaatgggcgtgcgccatgtcgccatgctaagggcgctatcatcgttcttgttcgtctcatttcactcttgtggtcaattattcgtggtgaaattccgctgccatcgctatttttaaaagatggcccgggatttccatgggtcagttggtgaacatgaactagggattcacgtgttgtaaggtagcctaagtagatgttcaccttaagtctccatggattgattttctatgctaagatgcttagttctgtggtaaaaaaaaaaaaaaaaaaaa

SEQ ID NO: 520 - protein, 281 aa, Panicum virgatum
  misc_feature: Ceres CLONE ID no.1725313
  misc_feature: Bit score of 66.5 for HMM based on sequences of FIGURE 6.
  misc_feature (12)..(58): Pfam Name: zf-B_box Pfam Description: B-box zinc finger
  misc_feature (195)..(239): Pfam Name: CCT Pfam Description: CCT motif
  misc_feature: Functional Homolog Of Ceres SEEDLINE ID no. ME11939 at SEQ ID NO. 456
MMGSEGSTSPAAGGASCAVCGGAAAVYCAADAAALCSPCDAAVHAANLLASRHERVPLAMAAAAAAASGVYDDLFAPDDVDAASSWPEAAAPAQGQGSPHQNGSSSTSFTTSDSGAEGRSLFDLLSDVDLATAACVTGGGYLPDGLAPVHHGGAAAPLWSQPGMAAWAAAWSSPADTAAVVVPGAAAVVAAAAERVARVQRYREKRKNRKFQKTIRYASRKAYAEARPRIKGRFVKRAPAAAAATNASDTAKFWLSFSDDARDDGVGFYVDAAAYGVVPSF

SEQ ID NO: 521 - protein, 407 aa, Oryza sativa subsp. indica
  misc_feature: Public GI ID no.78058606
  misc_feature: Bit score of 636.9 for HMM based on sequences of FIGURE 6.
  misc_feature (338)..(382): Pfam Name: CCT Pfam Description: CCT motif
  misc_feature (73)..(120): Pfam Name: zf-B_box Pfam Description: B-box zinc finger
  misc_feature: Functional Homolog Of Ceres SEEDLINE ID no. ME11939 at SEQ ID NO. 456
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVHSANPLARRHQRVPVAPLPAITIPATSVLAEAVVATATVLGDKDEEVDSWLLLSKDSDNNNNNNNNNDNDNKDNNNSNSSNNGMYFGEVDEYFDLVGYNSYYDNRIENNQDQQYGMHEQQEQQQQQQEMQKEFAEKEGSECVVPSQITMLSEQQHSGYGVVGADQAASMTAGVSAYTDSISNSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 522 - protein, 347 aa, Oryza sativa subsp. indica
  misc_feature: Public GI ID no.125538317
  misc_feature: Bit score of 257.3 for HMM based on sequences of FIGURE 6.
  misc_feature (279)..(323): Pfam Name: CCT Pfam Description: CCT motif
  misc_feature (55)..(102): Pfam Name: zf-B_box Pfam Description: B-box zinc finger
  misc_feature: Functional Homolog Of Ceres SEEDLINE ID no. ME11939 at SEQ ID NO. 456
MELGLGRYWGVGGRRCGACAVAPAAVHCRTCDGGGGGGGYLCAGCDAEHGRAGHERVWVCEVCELAPAAVTCKADAAALCAACDSDIHDANPLARRHERVPGHPIGSSAAPPPDALLLGGENDAAAAVDGGGGGKEVKLDFLFADFMDPYLGGSPELARFPHADSVVPNHNGSAGPAMELGFAGGGGAAVKPSYSSYTAASLGNSGSSSEVGLVPDAICGGGGGGIIELDFAQSKAAYLPYASTPSHSMSSSMDMGVAAPEMSDGAAAAAGRAYAAEGRAARLMRYREKRKNRRFEKTIRYASRKAYAETRPRVKGRFAKRADDHDAAAPPPQIMLDFAGYGVVPTF

SEQ ID NO: 523 - protein, 370 aa, Oryza sativa subsp. indica
  misc_feature: Public GI ID no.125556324
  misc_feature: Bit score of 245.5 for HMM based on sequences of FIGURE 6.
  misc_feature (294)..(338): Pfam Name: CCT Pfam Description: CCT motif
  misc_feature (50)..(97): Pfam Name: zf-B_box Pfam Description: B-box zinc finger
  misc_feature: Functional Homolog Of Ceres SEEDLINE ID no. ME11939 at SEQ ID NO. 456
MELRKYWGVGGRRCGACEASPAAVHCRGCGGVYLCTACDARPGHARAAHERVWVCEVCEVAPAAVTCKADAAVLCAACDADIHDANPLARRHARVPVAPIGSAAAAAVAAEAMLFGVAAAGAEAEAVEEKAAAEHHHHQQRQQHGALNLNVEAKDMKLDYLFSDLDPYLNVEFARFPHADSVVPNGAGAGAAIELDFTCGLGVGVGGAKQSYSSYTATDLAHSGSSSEVGVVPEAMCGGGGAIDLDFTRPKPQPYMPYTATPPPSHSVVSAQMSSSVVDVGVVPERAAAMGEGREARLMRYREKRKNRRFEKTIRYASRKAYAETRPRIKGRFAKRADHDADDADADADDPAAVPSSYMLDFGYGVVPSF

SEQ ID NO: 524 - protein, 242 aa, Oryza sativa subsp. indica
  misc_feature: Public GI ID no.125548890
  misc_feature: Bit score of 195.8 for HMM based on sequences of FIGURE 6.
  misc_feature (148)..(192): Pfam Name: CCT Pfam Description: CCT motif
  misc_feature (62)..(104): Pfam Name: zf-B_box Pfam Description: B-box zinc finger
  misc_feature: Functional Homolog Of Ceres SEEDLINE ID no. ME11939 at SEQ ID NO. 456
  misc_feature (156)..(156): Xaa is any aa, unknown, or other
MEGDDKSAVVGGAYWGLAARACDACGGEAARLFCRADAAFLCAGCDARAHGPGSRHARVWLCEVCEHAPAAVTCRADAAALCAACDADIHSANPLARRHERLPVAPFFGALADAPKPGSGIILGGGGGAGRGGGRRRSDAGGEQGREREARLMRYXEKRKSRRFERTIRYASRKAYAETRPRIKGRFAKRTKGGAGADADADADADGEDEEMYSSGAAAVAALMAPGGSDADYGVDGVVPTF

SEQ ID NO: 525 - protein, 482 aa, Oryza sativa subsp. japonica
  misc_feature: Public GI ID no.93211100
  misc_feature: Bit score of 589.8 for HMM based on sequences of FIGURE 6.
  misc_feature (428)..(472): Pfam Name: CCT Pfam Description: CCT motif
  misc_feature (46)..(105): Pfam Name: zf-B_box Pfam Description: B-box zinc finger
  misc_feature: Functional Homolog Of Ceres SEEDLINE ID no. ME11939 at SEQ ID NO. 456
MSSSCIPTGLRLDLDIVKAATSPGAHSSPLRPAHSSPSSTLSEASNTSSSSATSVSLKRARAPRKRPNQAYNEAAALLASIHPSVFPVKKSPKTASRPPTRQLSGLSAVFDPSSDLLPPLPVLADAAFLLRDTPPTPRQNCSSPAPVSSAFREFRDPAPLSPASPHTTDEPGELDFDDDCFLDVDEAAADGAAGGIDGIMGSLTVETNTAAATTSDDSILSSSGIHPYLRSLMVVGLAGRFELGLGSRHGARPNLNCALKRRDDDGAWWMWPAVPVKDITVAPPPPTPTPTPPRPQGTASNTTAAMPSPPSAPEKKKSKKKKVVKVEKVMAREKEEEESPPDARCKEEEAADGTVDAGNGDGAPTMAPKTGLGLKLDADDVLKAWSGKGSMFADGGAPESPKSAAEVRAKLADIDLFPENGNGAGGIREASVMRYKEKRRTRLFSKKIRYQVRKVNADCRPRMKGRFVRSPSLLQQVLEEES

SEQ ID NO: 526 - protein, 471 aa, Oryza sativa subsp. japonica
  misc_feature: Public GI ID no.115444217
  misc_feature: Bit score of 552.1 for HMM based on sequences of FIGURE 6.
  misc_feature (428)..(464): Pfam Name: CCT Pfam Description: CCT motif
  misc_feature (48)..(99): Pfam Name: zf-B_box Pfam Description: B-box zinc finger
  misc_feature: Functional Homolog Of Ceres SEEDLINE ID no. ME11939 at SEQ ID NO. 456
MSSSCIPTGLRLDLDIVKAATSPGAHSSPLRPAHSSPSSTLSEASNTSSSSATSVSLKRARAPRKRPNQAYNEAAALLASIHPSVFPVKKSPKTASRPPTRQLSGLSAVFDPSSDLLPPLPVLADAAFLLRDTPPTPRQNCSSPAPVSSAFREFRDPAPLSPASPHTTDEPGELDFDDDCFLDVDEAAADGAAGGIDGIMGSLTVETNTAAATTSDDSILSSSGIHPYLRSLMVVGLAGRFELGLGSRHGARPNLNRALKRRDDDGAWWMWPAVPVKDITVAPPPPTPTPTPPRPQGTASNTTAAMPSPPSAPEKKKSKKKKVVKVEKVMAREKEEEESPPDARCKEEEAADGTVDAGNGDGAPTMAPKTGLGLKLDADDVLKAWSGKGSMFADGGAPESPKSAAEVRAKLADIDLFPENGNGAGGIREASVMRYKEKRRTRLFSKKIRYQVRKVNADCRPRMKASTRTDS

SEQ ID NO: 527 - protein, 395 aa, Oryza sativa subsp. japonica
  misc_feature: Public GI ID no.115467558
  misc_feature: Bit score of 581.1 for HMM based on sequences of FIGURE 6.
  misc_feature (30)..(77): Pfam Name: zf-B_box Pfam Description: B-box zinc finger
  misc_feature (326)..(370): Pfam Name: CCT Pfam Description: CCT motif
  misc_feature: Functional Homolog Of Ceres SEEDLINE ID no. ME11939 at SEQ ID NO. 456
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVHSANPLPAITIPATSVLAEAVVATATVLGDKDEEVDSWLLLSKDSDNNNNNNNNNDNDNNDNNNSNSSNNGMYFGEVDEYFDLVGYNSYYDNRIENNQDRQYGMHEQQEQQQQQQEMQKEFAEKEGSECVVPSQITMLSEQQHSGYGVVGADQAASMTAGVSAYTDSISNSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 528 - protein, 407 aa, Oryza sativa subsp. japonica
  misc_feature: Public GI ID no.11094209
  misc_feature: Bit score of 628.8 for HMM based on sequences of FIGURE 6.
  misc_feature (338)..(382): Pfam Name: CCT Pfam Description: CCT motif
  misc_feature (73)..(120): Pfam Name: zf-B_box Pfam Description: B-box zinc finger
  misc_feature: Functional Homolog Of Ceres SEEDLINE ID no. ME11939 at SEQ ID NO. 456
MNYNFGGNVFDQEVGVGGEGGGGGEGSGCPWARPCDGCRAAPSVVYCRADAAYLCASCDARVHAANRVASRHERVRVCEACERAPAALACRADAAALCVACDVQVYSANPLARRHQRVPVAPLPAITIPATSVLAEAVVATATVLGDKDEEVDSWLLLSKDSDNNNNNNNNNDNDNNDNNNSNSSNNGMYFGEVDEYFDLVGYNSYYDNRIENNQDRQYGMHEQQEQQQQQQEMQKEFAEKEGSECVVPSQITMLSEQQHSGYGVVGADQAASMTAGVSAYTDSISNSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 529 - protein, 427 aa, Oryza sativa subsp. japonica
  misc_feature: Public GI ID no.125596830
  misc_feature: Bit score of 571.0 for HMM based on sequences of FIGURE 6.
  misc_feature (358)..(402): Pfam Name: CCT Pfam Description: CCT motif
  misc_feature (62)..(109): Pfam Name: zf-B_box Pfam Description: B-box zinc finger
  misc_feature: Functional Homolog Of Ceres SEEDLINE ID no. ME11939 at SEQ ID NO. 456
MAGRFGTFLMYLHWLPHTGAKATTTTSKATSFMNYNFGGNVFDQEVGVGGEGGGGGEGSGCPWARPCDGCRAAPSVVYCRADAAYLCASCDARVHAANRVASRHERVRVCEACERAPAALACRADAAALCFAFDVQVHSANPLPAINIPATSVLAEAVVATATVLGDKDEEVDSWLLLSKDSDNNNNNNNNNDNDNNDNNNSNSSNNGMYFGEVDEYFDLVGYNSYYDNRIENNQDRQYGMHEQQEQQQQQQEMQKEFAEKEGSECVVPSQITMLSEQQHSGYGVVGADQAASMTAGVSAYTDSISNSISFSSMEAGIVPDSTVIDMPNSRILTPAGAINLFSGPSLQMSLHFSSMDREARVLRYREKKKARKFEKTIRYETRKAYAEARPRIKGRFAKRSDVQIEVDQMFSTAALSDGSYGTVPWF

SEQ ID NO: 530 - protein, 370 aa, Oryza sativa subsp. japonica
  misc_feature: Public GI ID no.115469296
  misc_feature: Bit score of 245.4 for HMM based on sequences of FIGURE 6.
  misc_feature (294)..(338): Pfam Name: CCT Pfam Description: CCT motif
  misc_feature (50)..(97): Pfam Name: zf-B_box Pfam Description: B-box zinc finger
  misc_feature: Functional Homolog Of Ceres SEEDLINE ID no. ME11939 at SEQ ID NO. 456
MELRKYWGVGGRRCGACEASPAAVHCRGCGGVYLCTACDARPGHARAAHERVWVCEVCEVAPAAVTCKADAAVLCAACDADIHDANPLARRHARVPVAPIGSAAAAAVAAEAMLFGVAAAGAEAEAVEDKAAAEHHHHQQRQQHGALNLNVEAKDMKLDYLFSDLDPYLNVEFARFPHADSVVPNGAGAGAAIELDFTCGLGVGVGGAKQSYSSYTATDLAHSGSSSEVGVVPEAMCGGGGAIDLDFTRPKPQPYMPYTATPPPSHSVVSAQMSSSVVDVGVVPERAAAMGEGREARLMRYREKRKNRRFEKTIRYASRKAYAETRPRIKGRFAKRADHDADDADADADDPAAVPSSYMLDFGYGVVPSF

SEQ ID NO: 531 - protein, 332 aa, Oryza sativa subsp. japonica
  misc_feature: Public GI ID no.115447239
  misc_feature: Bit score of 406.4 for HMM based on sequences of FIGURE 6.
  misc_feature (261)..(305): Pfam Name: CCT Pfam Description: CCT motif
  misc_feature (72)..(114): Pfam Name: zf-B_box Pfam Description: B-box zinc finger
  misc_feature: Functional Homolog Of Ceres SEEDLINE ID no. ME11939 at SEQ ID NO. 456
MEAVEDKAMVGVGGAVAAGYSSSSWGLGTRACDSCGGEAARLYCRADGAFLCARCDARAHGAGSRHARVWLCEVCEHAPAAVTCRADAAALCAACDADIHSANPLARRHERLPVAPFFGPLADAPQPFPFSQAAADAAAAREEDADDDRSNEAEAASWLLPEPDDNSHEDSAAAADAFFADTGAYLGVDLDFARSMDGIKAIGVPVAPPELDLTAGSLFYPEHSMAHSLSSSEVAIVPDALSAGSAAPPMVVVVASKGKEREARLMRYREKRKNRRFDKTIRYASRKAYAETRPRIKGRFAKRTADADDDDEAPCSPAFSALAASDGVVPSF

SEQ ID NO: 532 - protein, 325 aa, Hordeum vulgare subsp. vulgare
  misc_feature: Public GI ID no.21655154
  misc_feature: Bit score of 534.4 for HMM based on sequences of FIGURE 6.
  misc_feature (250)..(294): Pfam Name: CCT Pfam Description: CCT motif
  misc_feature (70)..(112): Pfam Name: zf-B_box Pfam Description: B-box zinc finger
  misc_feature: Functional Homolog Of Ceres SEEDLINE ID no. ME11939 at SEQ ID NO. 456
MKVEEQTVVGGGGGAGQGGAGFWGLAGRPCDTCAVDAARLYCRLDGAYLCAGCDARAHGAGSRHARVWLCEVCEHAPAAVTCRADAAALCATCDADIHSANPLASRHLLLPTPFFGALADPPQPVPSPSSAAATQEDAEDDGSNEAEAASWLLPEPGDSPEDSAATFFADSDAYLDLDFVRSMDGIKAIGVPVAPSELDLAGGTLFYPEHSMNHSMSTSEVAVVPDALSAGGAPAPAPSVAVVASKGKEREARLMRYREKRKNRRFQKTIRYASRKAYAETRPRIKGRFAKRTAEDDALEQDGPFSPASSAHLASDGDYGVVPSF

SEQ ID NO: 533 - protein, 323 aa, Hordeum vulgare subsp. vulgare
  misc_feature: Public GI ID no.21667485
  misc_feature: Bit score of 387.4 for HMM based on sequences of FIGURE 6.
  misc_feature (236)..(280): Pfam Name: CCT Pfam Description: CCT motif
  misc_feature (61)..(103): Pfam Name: zf-B_box Pfam Description: B-box zinc finger
  misc_feature: Functional Homolog Of Ceres SEEDLINE ID no. ME11939 at SEQ ID NO. 456
MEGEEKPVVGGAYWGVGARACDSCATEAARLFCRADAAFLCAGCDARAHGSGSRHARVWLCEVCEHAPAAVTCKADAAVLCASCDADIHAANPLARRHERVPVAPFFGAAADAHKPFPSSGAQAGAAASAEDDGSNDAEAASWLLPEPDHKDGANGATADVFFADSDHYLDLDFARSMDDIKAISVQLNGQPEIDLNGGNKGFYSDHSMNHSLSSSEAAVVPDAAAAPVVSRGREREARLMRYREKRKSRRFEKTIRYASRKAYAETRPRVKGRFAKRTGTADADALEEHEEMYSSAAAAVAALMAPGPDHDYGVDGVVPTLV

SEQ ID NO: 534 - protein, 368 aa, Hordeum vulgare subsp. vulgare
  misc_feature: Public GI ID no.21667475
  misc_feature: Bit score of 684.9 for HMM based on sequences of FIGURE 6.
  misc_feature (298)..(342): Pfam Name: CCT Pfam Description: CCT motif
  misc_feature (63)..(110): Pfam Name: zf-B_box Pfam Description: B-box zinc finger
  misc_feature: Functional Homolog Of Ceres SEEDLINE ID no. ME11939 at SEQ ID NO. 456
MNCNFNSDLLEKEAGRTSFPWARPCDGCHAAPSAVYCCADAAYLCSSCDTQVHSANRVASRHERVRVCETCESTPAVLACHADAAALCTACDAQVHSANPIAQRHQRVPVLPLPAVAIPAASGFAEAEASVTAHGDKEGGEEVDSWLLRRNSDDNNCANKIDRYFNLVGYNMYYDNITCDPRPQEQYRMQEQQHVQNRYREKEGCECVVPPQVVMASEQQGSNYGTIGAGQAASVTAMASTYTASISNDISFSSMEVGIVPDNTRPNISNRNILTSSEAIELSGHSLQMPVHFSSMDREARVLRYKEKKQARKFQKTIRYATRKAYAEARPRIKGRFAKRSDIEHEENHMLSPPALPDTSSYNTVPWF

SEQ ID NO: 535 - protein, 376 aa, Hordeum vulgare subsp. vulgare
  misc_feature: Public GI ID no.21655158
  misc_feature: Bit score of 227.2 for HMM based on sequences of FIGURE 6.
  misc_feature (297)..(341): Pfam Name: CCT Pfam Description: CCT motif
  misc_feature (51)..(98): Pfam Name: zf-B_box Pfam Description: B-box zinc finger
  misc_feature: Functional Homolog Of Ceres SEEDLINE ID no. ME11939 at SEQ ID NO. 456
MMELRKYWGVGGRRCGGCEGAAPAAVHCRDCAGYLCTGCDARPAHARAGHERVWVCEVCEVSPAAVTCKADAAVLCAACDADIHHANPLAERHVRVPIAPIGSPEAAAVAAEAMMLCGAGDGDARADPDEVHDQLHHHGHGGMLNLNVEAGKEGGKMDYLFSDLVDPYLAVDFTRFAHADSVVPNGVATAAVPAVVDLDFACGIGAKPPPSYSSSYTANGSGAHSGSSSEVGVVPEAIHGGAGSFELDFTRPKPQAYMPAYTPAPPSHGVGMQQASAVDMGYLTVPERPVAVTGEGRVARLMRYREKRKNRRFEKTIRYASRKAYAESRPRVKGRFAKRADQDADGDGDDLDAEAHAVPSSTSYLLDFGYGVVPSF

SEQ ID NO: 536 - protein, 381 aa, Cleome spinosa
  misc_feature: Public GI ID no.90657642
  misc_feature: Bit score of 839.0 for HMM based on sequences of FIGURE 6.
  misc_feature (312)..(356): Pfam Name: CCT Pfam Description: CCT motif
  misc_feature (59)..(106): Pfam Name: zf-B_box Pfam Description: B-box zinc finger
  misc_feature: Functional Homolog Of Ceres SEEDLINE ID no. ME11939 at SEQ ID NO. 456
MLKEERTSGGETGENNWARICDTCRSAACTVYCRADSAYLCTSCDARVHAANHVASRHERVWVCESCERAPAAFLCKADAASLCAACDAEIHSANPLARRHHRVPILPISGSMSGPMANHHPSETAMTDTENDMVVGREEAEDEDEDDEEAASWLLLNPGKNSGNNNNQNNGFFFDGEADEYLDLVEYNSSMENQFSDQYSQYHQDCGVPQKSFGGDGVVPLQVEESRGQLHHEQQSFQLAITYGSPGALYGSYNGSMNHSVSMSSMDIVVVPESTASDMAVVSQLRAPKGTTDLLIGPPIQMMPQLSPMDREARVLRYREKKKTRKFEKTIRYASRKAYAETRPRIKGRFAKRTDIEAEVDQAFSTTLMQESGYGIVPSF

SEQ ID NO: 537 - DNA, 2183 bp, Arabidopsis thaliana
  misc_feature: Ceres SEEDLINE ID no.ME12006
  misc_feature: Inplanta Sequence
  misc_feature: Encodes the peptide sequence at SEQ ID NO. 538
atgaagatggacaaaaagactatagtttggtttagaagagacctaaggattgaggataatcctgcattagcagcagctgctcacgaaggatctgtttttcctgtcttcatttggtgtcctgaagaagaaggacagttttatcctggaagagcttcaagatggtggatgaaacaatcacttgctcacttatctcaatccttgaaggctcttggatctgacctcactttaatcaaaacccacaacacgatttcagcgatcttggattgtatccgcgttaccggtgctacaaaagtcgtctttaaccacctctatggtatatactctttcatctcttattcaaaggatatatattcttattaagttagtgtagtctaagtgcaactgaggttgatgcgatcacgtttttctttgttgtagatcctgtttcgttagttcgggaccataccgtaaaggagaagctggtggaacgtgggatctctgtgcaaagctacaatggagatctattgtatgaaccgtgggagatatactgcgaaaagggcaaaccttttacgagtttcaattcttactggaagaaatgcttagatatgtcgattgaatccgttatgcttcctcctccttggcggttgatgccaataactgcaggtaaaaccttaaagagtattacttaaaagctaaaacgtttttgatttcttcaggacataagcggtagtaaaagtttatggctttttctttgttagcggctgaagcgatttgggcgtgttcgattgaagaactagggctggagaatgaggccgagaaaccgagcaatgcgttgttaactagagcttggtctccaggatggagcaatgctgataagttactaaatgagttcatcgagaagcagttgatagattatgcaaagaacagcaagaaagttgttgggaattctacttcactactttctccgtatctccatttcggggaaataagcgtcagacacgttttccagtgtgcccggatgaaacaaattatatgggcaagagataagaacagtgaaggagaagaaagtgcagatctttttcttaggggaatcggtttaagagagtattctcggtatatatgtttcaacttcccgtttactcacgagcaatcgttgttgagtcatcttcggtttttcccttgggatgctgatgttgataagttcaaggcctggagacaaggcaggaccggttatccgttggtggatgccggaatgagagagctttgggctaccggatggatgcataacagaataagagtgattgtttcaagctttgctgtgaagtttcttctccttccatggaaatggggaatgaagtatttctgggatacacttttggatgctgatttggaatgtgacatccttggctggcagtatatctctgggagtatccccgatggccacgagcttgatcgcttggacaatcccgcggtaaactacaaaacttgtcttatagtttagaattcaaagcttaataccagtttttgctatgcattcgttttttattttatttttcagcttatttggtttggttgatttagttctgaagtctatgaaaactctgtttttatttcagttacaaggcgccaaatatgacccagaaggtgagtacataaggcaatggcttcccgagcttgcgagattgccaactgaatggatccatcatccatgggacgctcctttaaccgtactcaaagcttctggtgtggaactcggaacaaactatgcgaaacccattgtagacatcgacacagctcgtgagctactagctaaagctatttcaagaacccgtgaagcacagatcatgatcggagcagcacctgatgagattgtagcagatagcttcgaggccttaggggctaataccattaaagaacctggtctttgcccatctgtgtcttctaatgaccaacaagtaccttcggctgttcgttacaacgggtcaaagagagtgaaacctgaggaagaagaagagagagacatgaagaaatctaggggattcgatgaaagggagttgttttcgactgctgaatcttcttcttcttcgagtgtgtttttcgtttcgcagtcttgctcgttggcatcagaagggaagaatctggaaggtattcaagattcatctgatcagattactacaagtttgggaaaaaatggttgcaaatga

SEQ ID NO: 538 - protein, 612 aa, Arabidopsis thaliana
  misc_feature: Ceres SEEDLINE ID no.ME12006
  misc_feature: Bit score of 1700.3 for HMM based on sequences of FIGURE 22.
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
MKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSKRVKPEEEEERDMKKSRGFDERELFSTAESSSSSSVFFVSQSCSLASEGKNLEGIQDSSDQITTSLGKNGCK

SEQ ID NO: 539 - protein, 727 aa, Physcomitrella patens
  misc_feature: Public GI ID no.5731739
  misc_feature: Bit score of 1772.9 for HMM based on sequences of FIGURE 22.
  misc_feature (207)..(488): Pfam Name: FAD_binding_7 Pfam Description: FAD binding domain of DNA photolyase
  misc_feature (207)..(488): Pfam Name: FAD_binding_7 Pfam Description: FAD binding domain of DNA photolyase
  misc_feature (3)..(174): Pfam Name: DNA_photolyase Pfam Description: DNA photolyase
  misc_feature: Functional Homolog Of Ceres SEEDLINE ID no. ME12006 at SEQ ID NO. 538
MAACTIVWFRRDLRLEDNPALIAAARAGTVVPVFVWSPAEDGQFHPGRVSRWWLKQSLTHLELSLKKLGSPLILRKSPDTLSVLLEIAEATGATQVFYNHLYDPVSLVRDHRVKQGLSQRGIVVHTFNGDLLYEPWEVYDEEGQAFTVYEAFWKKCMSMPFEPEAPLLPPRRLTGPIGKIVGCNAEELGLEDEFEKSSNALLARAWCPGWGFANKSLDSFLRSPLIDYARDRQKADGASGTPTSLLSPHLHFGELSVRKIFHEVRKRQITWAREGNAGGEASVNMFLRALGFREYSRYLSFHFPFTHERSLLANLKSFPWRADEGYFKAWRQGRTGYPLVDAGMRELWATGWAHNRIRVVVASFSVKFLQLPWRWGMKYFWDVLLDADLECDVLGWQYISGSLPDGHELDRIENPEVEGYRFDPDGDYVRRWIPELARLPNEWVHHPWDAPPSALRAAGVELGTNYPRPIVEIGAARERLQASLAEMWERDAAMKAALANGLEEGLGETVEVAGTGGPEHERMDVPRVMVHMQRDADMSCNSSRRDQLVPEIVPNQFHIRAHESIMNRSAAMVEDGEEAGRAAVPMVFASVRRGMGGNYGGHHVEGNGGEVAQASAPIQWPTVTAVDYELDSTAESASVTGRGGSEGGTVPVWSQSVSARTPIQVREGLVPEVRRGPGLSRRQLQASVQRVNLEGMTSNKQAEEEDFYVPKLVKWTQPRKRRVKQDG

SEQ ID NO: 540 - DNA, 1941 bp, Populus balsamifera subsp. trichocarpa
  misc_feature: Ceres ANNOT ID no.1538045
  misc_feature: Encodes the peptide sequence at SEQ ID NO. 541
atggatagaagtaagaccattgtttggtttaggagggaccttcgaattgaagataaccctgcattagctgctgctgcaagggatggttgtgttttccctgtatttatatggtgtcctaaagaagaaggacaattctacccgggtcgagtgtccaggtggtggctgaagcagtcccttgctcacttgggacaatccttgaaatctcttggtgctgaacttgttctcatcaaaacccatagtacagttgctgctcttctggattgcatcgaaaccattggggcgacgagagtggtatttaaccatctgtatgatcctgtctctcttgttcgtgatcacaacatcaaagaaaaattggtggagcttggcatttctgtacaaagttataatggagatttgttgtatgaaccgtgggaaatatatgatgaaagagggcatgctttcacgacatttgaagcatactgggacaggtgcttgcacatgcagatggaacctgtttcacatcttcctccatggagattggtacctgctgcaggaacagttatgaaatgttcagttgaggaattaggtcttgaagatgaagccgaaaaatctagtaattccttgttaggaagaggatggtccccgggttggagcaatgctgataaggctctaactgaatttgctgaacagcatctaattgattatgtggagagtaggctaaaagttgggacctccacctcacttttgtccccgtatcttcattttggagagctgagtgtgaggaaagttttccagtgtgtgcaattgaagcagttattgtgggcaaaagaagagaacttaatggggaaagaaagcgtgactctgtttcttagatccatcgggcttagggaatactcccgttatctttgttttaactttccgttcactcatgagagatcgttgttgagaaacttaaagtattttccgtggaatgacaatcaggtccattttaaggcttggagacaggggcggactggttacccattagttgatgcaggaatgcgtgagctctgggcaactggttggatacacaacaaaataagagtaattgtttcaagcttcgcagtaaaagttcttcttcttccatggagatggggaatgaaatatttctgggacactcttttggatgcagatttggaaagtgacatccttggttggcagtatatttcagggagcttaccagatgctcatgagcttgaacgcttggataacccagagattcaaggctccaaatttgacccagagggtgaatacgtgcggcgctggttgcccgagctagcaagaatgccagctgaatggatccatcatccttgggatgcatccattgctgtgcttaaagctgctggagttgaattgggaatcaattacccaaaacctataattgatatagatttggctagagagcgtctaatggaagctatattcaagatgtgggaaatggaagcagctgcacgggcttcaaatacaaatggaactaatgaagttgttgttgataacactgatgatactgagaatttggccattccgaaggttgtcttaaaagataaggttacttgtcctactaattcatctaatgatcagagggtaccaacaaatcagaattccaagaatattccagcttataggaagagatcaaagtacatggaagaagagagaccacaaccagataaattgcataatgatggtaatgtagtgggtaccacaagaaaggatgaagacttgtgctctactgctgaatcttcatcagctaagaagcaggccaccagcagttgttcgttttctgttccccagtattgttcctcctcagaaggcaagcctttgcaggagagtgaatcttctgacctcaggcagccattgcaagcacaaattgaaatggaacagagttcgagcaaagatggtaagcaattgcactttattgtctag

SEQ ID NO: 541 - protein, 646 aa, Populus balsamifera subsp. trichocarpa
  misc_feature: Ceres ANNOT ID no.1538045
  misc_feature: Bit score of 1818.5 for HMM based on sequences of FIGURE 22.
  misc_feature (207)..(484): Pfam Name: FAD_binding_7 Pfam Description: FAD binding domain of DNA photolyase
  misc_feature (207)..(484): Pfam Name: FAD_binding_7 Pfam Description: FAD binding domain of DNA photolyase
  misc_feature (4)..(174): Pfam Name: DNA_photolyase Pfam Description: DNA photolyase
  misc_feature: Functional Homolog Of Ceres SEEDLINE ID no. ME12006 at SEQ ID NO. 538
MDRSKTIVWFRRDLRIEDNPALAAAARDGCVFPVFIWCPKEEGQFYPGRVSRWWLKQSLAHLGQSLKSLGAELVLIKTHSTVAALLDCIETIGATRVVFNHLYDPVSLVRDHNIKEKLVELGISVQSYNGDLLYEPWEIYDERGHAFTTFEAYWDRCLHMQMEPVSHLPPWRLVPAAGTVMKCSVEELGLEDEAEKSSNSLLGRGWSPGWSNADKALTEFAEQHLIDYVESRLKVGTSTSLLSPYLHFGELSVRKVFQCVQLKQLLWAKEENLMGKESVTLFLRSIGLREYSRYLCFNFPFTHERSLLRNLKYFPWNDNQVHFKAWRQGRTGYPLVDAGMRELWATGWIHNKIRVIVSSFAVKVLLLPWRWGMKYFWDTLLDADLESDILGWQYISGSLPDAHELERLDNPEIQGSKFDPEGEYVRRWLPELARMPAEWIHHPWDASIAVLKAAGVELGINYPKPIIDIDLARERLMEAIFKMWEMEAAARASNTNGTNEVVVDNTDDTENLAIPKVVLKDKVTCPTNSSNDQRVPTNQNSKNIPAYRKRSKYMEEERPQPDKLHNDGNVVGTTRKDEDLCSTAESSSAKKQATSSCSFSVPQYCSSSEGKPLQESESSDLRQPLQAQIEMEQSSSKDGKQLHFIV

SEQ ID NO: 542 - protein, 617 aa, Armoracia rusticana
  misc_feature: Public GI ID no.29467479
  misc_feature: Bit score of 1701.0 for HMM based on sequences of FIGURE 22.
  misc_feature (211)..(489): Pfam Name: FAD_binding_7 Pfam Description: FAD binding domain of DNA photolyase
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of Ceres SEEDLINE ID no. ME12006 at SEQ ID NO. 538
MTTNKKTIVWFRRDLRIEDNPALAAAAHQGSVFPVFIWCPEEEGQFYPGRASRWWMKQSLAHLSQSLKALGSELTLIKTHNTVSAILDCIRVTGATKVVFNHLYDPVSLVRDHTVKEKLVELGISVQSFNGDLLYEPWEIYCEKGKPFTSFSSYWKKCLDMSIESVMLPPPWRLIPITAAVEAVWACSIEELGLENDAEKPSNALLTRAWSPGWSNADKILNEFIDKQLIYYAKNSNKVVGNATSLLSPYLHYGEISVRRVFQCARMKQIIWARDKNSEGEESTDLFLKGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSLPDGHELDRLDNPAIQGAKFDPEGEYIRQWLPELARLPTEWIHHPWDAPLTVLKASGVELGTNYVKPIVDIDTARELLTKAISRTREAQIMIGAAPDEIVADSFGALEGNTVKETGLCPSVSSNDQQVPSAVRYNGSKRVKHVEEEERDMKKSRGFDEVMREERDLFSTAESSSSSTTVRFLVSHSCSLVSEGKNLEGIQDPSDQITTKLGKNG

SEQ ID NO: 543 - protein, 618 aa, Brassica napus
  misc_feature: Public GI ID no.133921974
  misc_feature: Bit score of 1704.8 for HMM based on sequences of FIGURE 22.
  misc_feature (210)..(488): Pfam Name: FAD_binding_7 Pfam Description: FAD binding domain of DNA photolyase
  misc_feature (210)..(488): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of Ceres SEEDLINE ID no. ME12006 at SEQ ID NO. 538
MSTNKKTIVWFRRDLRIEDNPALAAAAHEGSVFPVFIWCPEEEGQFYPGRASRWWMKQSLAHLTQSLKALGSEPTLIKTHNTVSAILDCVRATGATKVVFNHLYDPVSLVRDHTVKEKLVERGISVQSYNGDLLYEPWEIYCEKGKPFTNFNSYWKKCLDMPVESVVIPPPWRLIPLTAAGTVWACSIEELGLENEAEKPSNALLTRAWSPGWSNADKILTEFIEKQLIDYAKNSKKVVGNSTSLLSPYLHFGEISVRRVFQCARMKQIIWARDKNGQGVESAVLFLRGIGLRDYSRYICFNFPFTHEQSLLSHLRFFPWDADVEKFKAWRQGRTGYPLVDAGMRELWATGWMHNRIRVIVSSFAVKFLLLPWKWGMKYFWDTLLDADLECDIIGWQYISGSLPDGHELDRLDNPAIQGAKYDPEGEYIRQWLPELARLPTEWIHHPWDAPLTVLKASGVELGTNYAKPIVDIDTARELLTKAISRTREAQIMIGAPDEIVADSFEALEAANTVKEHGYCPSSNDQQVPSDVRYSGSKRVKPAEEEEEREMKKLRGFNEVIREEEERGLFSTAESSSSSSVRSVFMVSHSCSLVSEGKNLEGIQDSSDQIATSLGKNG

SEQ ID NO: 544 - protein, 704 aa, Brassica rapa
  misc_feature: Public GI ID no.113197027
  misc_feature: Bit score of 1740.1 for HMM based on sequences of FIGURE 22.
  misc_feature (10)..(181): Pfam Name: DNA_photolyase Pfam Description: DNA photolyase
  misc_feature (236)..(514): Pfam Name: FAD_binding_7 Pfam Description: FAD binding domain of DNA photolyase
  misc_feature (236)..(514): Pfam Name: FAD_binding_7 Pfam Description: FAD binding domain of DNA photolyase
  misc_feature: Functional Homolog Of Ceres SEEDLINE ID no. ME12006 at SEQ ID NO. 538
MSNSCSGGGGCSIVWFRRDLRVEDNPALAAAVRAGPVIAVFVWAPEEEGHYQPGRVSRWWLKNSLAQLDSSLRSLGTCLITKRSTDSVASLLEVVKSTGASQIFFNHLYDPLSLVRDHRAKDALTAEGIAVKSFNADLLYEPWEVTDELGRPFSMFAAFWERCLSMPYDPESPLLPPKKIISGLLLHHTLSEIVSYPLLITLFVLAGDVSKCVADTLIFEDESEKGSNALLARAWSPGWSNADKALTTFINGPLIEYSKNRRKADSATTSFLSPHLHFGEVSVRKVFHLLRIKQVAWANEGNQAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTEWIHHPWNAPESVLQAAGIELGSNYPRPIVGLDEAKARLHEALSQMWQLEAASRAAIENGSEEGLGDSTEFVEAPIEFPRDITMEETEPTRLNPVRRYEDQMVPSITTSLIRPEEDQESSLSLRNSGGDSRAEVPRNMVNTNQARQQEARADPVSNQVTAMIPEFNIRIVAENTEESTAESSSSGRRERDGGIVPEWSGYSEQFASEENGIGGGSTTSTYLQNHHEIVNWRRLSQTG

SEQ ID NO: 545 - protein, 600 aa, Medicago truncatula
  misc_feature: Public GI ID no.92879277
  misc_feature: Bit score of 1630.8 for HMM based on sequences of FIGURE 22.
  misc_feature (2)..(173): Pfam Name: DNA_photolyase Pfam Description: DNA photolyase
  misc_feature (205)..(483): Pfam Name: FAD_binding_7 Pfam Description: FAD binding domain of DNA photolyase
  misc_feature (205)..(483): Pfam Name: FAD_binding_7 Pfam Description: FAD binding domain of DNA photolyase
  misc_feature: Functional Homolog Of Ceres SEEDLINE ID no. ME12006 at SEQ ID NO. 538
MNRTIVWFRRDLRIEDNPALAAAARDGSVFPVFICCPKEEGQFYPGRVSRWWLKQSLYHLDQSLKSLGAGLVMIKTDSTLKALLECVNAVQAKKVVFNHLYDPVSLVRDHNIKEKLVELGISVQSYNGDLLHEPWDIYDESGHAFTTFDPFWSRCLQMQMKTYSTIPPCQLIPAQGKVEKHSIEQLGLEDELETSSNALLSRAWSPGWSKSDKALTEFVENHLIHYSKNRLNLGVDSTSLLSPYIHFGELSVRKVFQLVRTKQILWKNEGNIVGEESATFFLRAIGFREYSRYLCFSFPFTVERPLLGNLKFFPWNTDPSKFKAWRLGRTGYPLVDAGMRELWATGWIHNKMRVIVSSFAVKMLLIPWKWGMKYFWDTLLDADLESDILGWQYISGSLPDGHELERLDDPEIQGTKYDPEGEYIRQWLPELARIPTEWIHHPWNAPLTVLKASGIELGQNYPKPIIEIDLAREQLTQAIFKMWEDEAASKASTSENKHEVVDDSENLSIPKVFLKDKAPRGATSSSNDQKVPILQNPKIDDPPNRKKQKCMDKEDREQDSLSNLSKRTDTGVSCVDQEVCSTAESSSKRQSSSTCSFYVP

SEQ ID NO: 546 - protein, 629 aa, Pisum sativum
  misc_feature: Public GI ID no.45935260
  misc_feature: Bit score of 1784.8 for HMM based on sequences of FIGURE 22.
  misc_feature (207)..(485): Pfam Name: FAD_binding_7 Pfam Description: FAD binding domain of DNA photolyase
  misc_feature (207)..(485): Pfam Name: FAD_binding_7 Pfam Description: FAD binding domain of DNA photolyase
  misc_feature (4)..(174): Pfam Name: DNA_photolyase Pfam Description: DNA photolyase
  misc_feature: Functional Homolog Of Ceres SEEDLINE ID no. ME12006 at SEQ ID NO. 538
MGSNRTIVWFRRDLRIEDNPALAAAARDGSVFPVFIWCPKEEGQFYPGRVSRWWLKQSLAHLDQSLKSLGAKLVLIKTDSTLNALLECVNAIQATKVVFNHLYDPVSLVRDHNIKEKLVELGISVKSYNGDLLYEPWELYDEKGHAFTTFDPFWERCLHKQMEPVSLIPPWQLIPAKGKVERCSIEDLGLENELEKPSNALLGRAWSPGWGNANKALTEFMDKQLLNYSKNRQKVGGDSTSLLSPYLHFGELSVRKVFQMARVKQISWGNEGNSVGKESVTLFLRAIGLREYSRYLCFNFPFTHERALLGHLSFFPWNADPSNFKTWRQGRTGYPLVDAGMRELWATGWMHNRIRVIVSSFAVKMLLLPWKWGMKYFWDTLLDADLECDILGWQYISGCLPDGHELERLDDPEILGAKFDPEGEYVRQWLPELARMPTEWIHHPWNAPLSVLRASGVELGQNYPNPIIDIDLAREKLTQAIFKMWEIQAASKASGSEARDEVVVDNENQDIPKVILKDKGPCVTISANDQKVPALPDPKNELPVRKRKKGMEEKGKEQESSVNNEKDSKVSSPDQETCSTADSSACKKQCSTSTYTFSVPQQCSSSSNLKWSWQEQIDMEQSSGKDGPT

SEQ ID NO: 547 - protein, 635 aa, Solanum lycopersicum
  misc_feature: Public GI ID no.8101444
  misc_feature: Bit score of 1762.2 for HMM based on sequences of FIGURE 22.
  misc_feature (208)..(486): Pfam Name: FAD_binding_7 Pfam Description: FAD binding domain of DNA photolyase
  misc_feature (208)..(486): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of Ceres SEEDLINE ID no. ME12006 at SEQ ID NO. 538
MESNYKTIVWFRRDLRIEDNPALAAAARNGSVLPVFIWCPKEEGQFYPGRVSRWWLKQSLIHLKQSLKSLGAELVLMKAQSTLSALTECVDAVGATKVVYNHLYDPVSLVRDHNIKQKLGDLGISVQSYNGDLLNEPWEVYDDDGKVFTTFDAYWEKSLSIQNEPVSQLPPWRLTQAAGSVKMCSVEELGLENESEKSSNALLGKGWAPGWSNADKALTEFVESNLLAYSKDRLRVGGNSTSLLSPYLHFGEVSVRKVFNSVRLKQILWTKEGNSVGKDSATIYLRAIGLREYSRYICFNFPFTHERSLLNNLRFFPWNADQAHFKAWRQGRTGYPLVDAGMRELWATGWVHNKIRVIVSSFFVKFLLLPWQWGMKYFWDTLLDADLESDIIGWQYISGSLPDGHELERLDNPEVQGFNYDPEGEYVRHWLPELARMPAEWIHHPWDAPLNVLKAAGVELGMNYPNPIIDVDVARDRLMQAIIIMREKEAAVNTSHANGTVEVVFDNSENVGDSASIPKDDVVKGKEPCPSSSSYDQRVPSMQNVGTYRKRPKPEEETKKLNDNKLSYKNERIKMSNVDGDLCSTAESSSMKKQMTVSRNSFSVPRTITMSHDRKSFDDEASSHVKLQKEEEIDT

SEQ ID NO: 548 - protein, 641 aa, Nicotiana sylvestris
  misc_feature: Public GI ID no.78217443
  misc_feature: Bit score of 1800.0 for HMM based on sequences of FIGURE 22.
  misc_feature (208)..(486): Pfam Name: FAD_binding_7 Pfam Description: FAD binding domain of DNA photolyase
  misc_feature (208)..(486): Pfam Name: FAD_binding_7 Pfam Description: FAD binding domain of DNA photolyase
  misc_feature (5)..(176): Pfam Name: DNA_photolyase Pfam Description: DNA photolyase
  misc_feature: Functional Homolog Of Ceres SEEDLINE ID no. ME12006 at SEQ ID NO. 538
MESNSKTIVWFRRDLRIEDNPALAAAARNGSVFPVFIWSPKEEGQFYPGRVSRWWLKQSLIHLEQSLKSLGAELVLIKAQSTLSALLDCIEAVGATKVVYNHLYDPVSLVRDHNIKQKLGELGISVQSYNGDLLNEPWEVYDDDGKVFTTFDAYWEKSLRLQKEPVSHLPPWKLIPAAGSVKMCSVEELGLENESEKSSNALLGKGWAPGWSNADKALTEFVENQLLAYSKDRLRVGGNSTSLLSPYLHFGEVSVRKVFNSVRLKQILWTKEGNSVGDESASLYLRAIGLREYSRYICFNFPFTHERSLLNNLKFFPWNADQARFKAWRQGRTGYPLVDAGMRELWATGWIHNKIRVIVASFFVKFLLLPWQWGMKYFWDTLLDADLESDIIGWQYISGSLPDGHELERLDNPEVQGFNYDPEGEYVRHWLPELARMPAEWIHHPWDAPLTVLKAAGVELGMNYPNPIIDVDVARDRLMQAIFIMREKEAAANAADANGTNEVVFDNSENVGDSVNPKVVKGKVPCPSSSSYDQRVPSMQKGSTNKKRPNPVEEEKKFKDNWLSCKIKTEGKISKADDDLCSTAESSSMKKQMTTSRNSFSVPQAISMSYDIKSFDGEASSHVKLQNEEEIDMEINSCKNE

SEQ ID NO: 549 - protein, 651 aa, Oryza sativa subsp. japonica
  misc_feature: Public GI ID no.28372347
  misc_feature: Bit score of 1703.6 for HMM based on sequences of FIGURE 22.
  misc_feature (211)..(489): Pfam Name: FAD_binding_7 Pfam Description: FAD binding domain of DNA photolyase
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of Ceres SEEDLINE ID no. ME12006 at SEQ ID NO. 538
MAGSERTVVWFRRDLRIDDNPALASAARDGAVLPVFIWCPADEGQFYPGRCSRWWLKQSLPHLSQSLESLGCPLVLIRAESTLEALLRCIDSVGATRLVYNHLYDPVSLVRDDKIKKELSALGISIQSFNGDLLYEPWEIYDDSGLAFTTFNMYWEKCMELPIDASPSLAPWKLVPVPGLESVRSCSVDDLGLESSKDEESSNALLMRAWSPGWRNAEKMLEEFVSHGLLEYSKHGMKVEGATTSLLSPYLHFGEVSVRKVYQLVRMQQIKWENEGTSEAEESIHFFMRSIGLREYSRYLCFNFPFTHEKSLLGNLKHYPWKVDEERFKSWRQGMTGYPLVDAGMRELWATGWTHNRIRVIISSFAVKFLLIPWTWGMKYFWDVLLDADLESDILGWQYISGSLPDGHELSRLDNPEVQGQKYDPDGVYVRTWIPELARMPTEWIHHPWDAPSCILEVAGVELGFNYPKPIVDLHIARECLDDSISTMWQLDTAEKLAELDGEVVEDNLSNIKTFDIPKVVLRETSPCALPIDQRVPHASSKDHNLKSKVLKASNRSSICVDMIRSSKMEATSSVANSPVSRKRSFCETAFHVPSYSSSAEVHSHIQDHGGSLVGPSRYLLQEAGRNYVDEVEDSSTADSGSSISRQRKAA

SEQ ID NO: 550 - protein, 727 aa, Physcomitrella patens
  misc_feature: Public GI ID no.16416405
  misc_feature: Bit score of 1766.6 for HMM based on sequences of FIGURE 22.
  misc_feature (207)..(488): Pfam Name: FAD_binding_7 Pfam Description: FAD binding domain of DNA photolyase
  misc_feature (207)..(488): Pfam Name: FAD_binding_7 Pfam Description: FAD binding domain of DNA photolyase
  misc_feature (3)..(174): Pfam Name: DNA_photolyase Pfam Description: DNA photolyase
  misc_feature: Functional Homolog Of Ceres SEEDLINE ID no. ME12006 at SEQ ID NO. 538
MAACTIVWFRRDLRLEDNPALIAAARAGTVVPVFVWSPAEDGQFHPGRVSRWWLKQSLTHLELSLKKLGSPLILRKSPDMLSVLLEIAEATGATQVFYNHLYDPVSLVRDHRVKQGLSQRGIVVHTFNGDLLYEPWEVYDEEGQAFTVYEAFWKKCMSMPFEPEAPLLPPRRLTGPIGKIVGCNAEELGLEDEFEKSSNALLARAWCPGWGFANKSLDSFLRSPLIDYARDRQKADGASGTPTSLLSPHLHFGELSVRKIFHEVRKRQITWAREGNAGGEASVNMFLRALGFREYSRYLSFHFPFTHERSLLANLKSFPWRADEGYFKAWRQGRTGYPLVDAGMRELWATGWAHNRIRVVVASFSVKFLQLPWRWGMKYFWDVLLDADLECDVLGWQYISGSLPDGHELDRIENPEVEGYRFDPDGDYVRRWIPELARLPNEWVHHPWDAPPSALRAAGVELGTNYPRPIVEIGAARERLQASLAEMWERDAAMKAALANGLEEGLGETVEVAGTGGPEHERMDVPRVMVHMQRDADMSCNSSRRDQLVPEIVPNQFHIRAHESIMNRSAAMVEDGEEAGRAAVPMVFASVRRGMGGNYGGHHVEGNGGEVAQASAPIQWPTVTAVDYELDSTAESASVTGRGGSEGGTVPVWSQSVSARTPIQVREGLVPEVRRGPGLSRRQLQASVQRVNLEGMTSNKQAEEEDFYVPKLVKWTQPRKRRVKQDG

SEQ ID NO: 551 - DNA, 1800 bp, Populus balsamifera subsp. trichocarpa
  misc_feature: Ceres ANNOT ID no.1484634
  misc_feature: Encodes the peptide sequence at SEQ ID NO. 552
atgcggtatagttttcttgaagtagataataaggttttctatagtcaatcagagttaggaattaactggcaatattccatcttggaagatgctcttgttatttttctgggctctgagcatgcaagatgtcaattactccatgattttcaccgaatcaatcataaaacttatcctgtctctcttgttcgtgatcacaacatcaaagaaaaattggtggagcttggcatttctgtacaaagttataatggagatttgttgtatgaaccgtgggaaatatatgatgaaagagggcatgctttcacgacatttgaagcatactgggacaggtgcttgcacatgcagatggaacctgtttcacatcttcctccatggagattggtacctgctgcaggaacagttatgaaatgttcagttgaggaattaggtcttgaagatgaagccgaaaaatctagtaattccttgttaggaagaggatggtccccgggttggagcaatgctgataaggctctaactgaatttgctgaacagcatctaattgattatgtggagagtaggctaaaagttgggacctccacctcacttttgtccccgtatcttcattttggagagctgagtgtgaggaaagttttccagtgtgtgcaattgaagcagttattgtgggcaaaagaagagaacttaatggggaaagaaagcgtgactctgtttcttagatccatcgggcttagggaatactcccgttatctttgttttaactttccgttcactcatgagagatcgttgttgagaaacttaaagtattttccgtggaatgacaatcaggtccattttaaggcttggagacaggggcggactggttacccattagttgatgcaggaatgcgtgagctctgggcaactggttggatacacaacaaaataagagtaattgtttcaagcttcgcagtaaaagttcttcttcttccatggagatggggaatgaaatatttctgggacactcttttggatgcagatttggaaagtgacatccttggttggcagtatatttcagggagcttaccagatgctcatgagcttgaacgcttggataacccagagattcaaggctccaaatttgacccagagggtgaatacgtgcggcgctggttgcccgagctagcaagaatgccagctgaatggatccatcatccttgggatgcatccattgctgtgcttaaagctgctggagttgaattgggaatcaattacccaaaacctataattgatatagatttggctagagagcgtctaatggaagctatattcaagatgtgggaaatggaagcagctgcacgggcttcaaatacaaatggaactaatgaagttgttgttgataacactgatgatactgagaatttggccattccgaaggttgtcttaaaagataaggttacttgtcctactaattcatctaatgatcagagggtaccaacaaatcagaattccaagaatattccagcttataggaagagatcaaagtacatggaagaagagagaccacaaccagataaattgcataatgatggtaatgtagtgggtaccacaagaaaggatgaagacttgtgctctactgctgaatcttcatcagctaagaagcaggccaccagcagttgttcgttttctgttccccagtattgttcctcctcagaaggcaagcctttgcaggagagtgaatcttctgacctcaggcagccattgcaagcacaaattgaaatggaacagagttcgagcaaagatggtaagcaattgcactttattgtctag

SEQ ID NO: 552 - protein, 599 aa, Populus balsamifera subsp. trichocarpa
  misc_feature: Ceres ANNOT ID no.1484634
  misc_feature: Bit score of 1352.1 for HMM based on sequences of FIGURE 22.
  misc_feature (160)..(437): Pfam Name: FAD_binding_7 Pfam Description: FAD binding domain of DNA photolyase
  misc_feature (160)..(437): Pfam Name: FAD_binding_7 Pfam Description: FAD binding domain of DNA photolyase
  misc_feature (52)..(127): Pfam Name: DNA_photolyase Pfam Description: DNA photolyase
  misc_feature: Functional Homolog Of Ceres SEEDLINE ID no. ME12006 at SEQ ID NO. 538
MRYSFLEVDNKVFYSQSELGINWQYSILEDALVIFLGSEHARCQLLHDFHRINHKTYPVSLVRDHNIKEKLVELGISVQSYNGDLLYEPWEIYDERGHAFTTFEAYWDRCLHMQMEPVSHLPPWRLVPAAGTVMKCSVEELGLEDEAEKSSNSLLGRGWSPGWSNADKALTEFAEQHLIDYVESRLKVGTSTSLLSPYLHFGELSVRKVFQCVQLKQLLWAKEENLMGKESVTLFLRSIGLREYSRYLCFNFPFTHERSLLRNLKYFPWNDNQVHFKAWRQGRTGYPLVDAGMRELWATGWIHNKIRVIVSSFAVKVLLLPWRWGMKYFWDTLLDADLESDILGWQYISGSLPDAHELERLDNPEIQGSKFDPEGEYVRRWLPELARMPAEWIHHPWDASIAVLKAAGVELGINYPKPIIDIDLARERLMEAIFKMWEMEAAARASNTNGTNEVVVDNTDDTENLAIPKVVLKDKVTCPTNSSNDQRVPTNQNSKNIPAYRKRSKYMEEERPQPDKLHNDGNVVGTTRKDEDLCSTAESSSAKKQATSSCSFSVPQYCSSSEGKPLQESESSDLRQPLQAQIEMEQSSSKDGKQLHFIV

SEQ ID NO: 553 - DNA, 2361 bp, Populus balsamifera subsp. trichocarpa
  misc_feature: Ceres ANNOT ID no.1451869
  misc_feature: Encodes the peptide sequence at SEQ ID NO. 554
atggcttggcttgaagatggcatagacgtcttttcaccacaggggtgctacagaacacttgctagtaaggaagaacgaagtcgtctcttgttttgcaaattttccaccctgtcaaggagcgagggagagagggttggagaaggaagtagagatgcggagagaaagatgtcaggaggtgggtgtagtatagtttggttcagaagagatctaagggtagaagataacccggcacttgcagctggtgtaagagcaggtgctgttgttgctgtgtttgtatgggcacccgaggaggaaggccattattatcccggtagggtctcaaggtggtggcttaaacaaagtttggctcatcttgactcttctttaaggagtcttggtacttctcttgttactaagagatcaactgatagtgtttcttctcttcttgaggttgtcaaatctaccggtgctactcagcttttattcaaccacttatatgaccccttgtcactggttagggatcaccgggcaaaggagattttgactgctcaaggtattactgtaagatcttttaacgcggacttgctttatgaaccatgggatgttaatgatgcccagggccgtccgttcacaacctttgacactttctgggaaagatgcctcagcatgccttttgatccagaggctccacttctcccgcctaagaggattatttcggagttgctttttgaaatagataacattaaaaaacgagaagaaaatgcaaagcactcatgctatatatcatttaatcacacggtcctcaagagaaaccaaaaagtaaatcttgtcctccccaatctgctttcacccatttactgcactctttcaggtgatgtatccagatgcccttcagtcacgctggtatttgaagatgaatcagagaaaggaagcaatgcacttcttgcaagagcatggtcacctggatggagcaatgctgatagggctttgaccactttcattaacggaccactaattgagtactctatgaatcgtagaaaggctgatagcgccacaacctcatttctctcaccacacttgcattttggggaggtgagtgtgagaaaagtcttccatcttgttcgcatcaagcaggttctgtgggcaaatgaagggaacagggccggcgaagagagtgtaaacttgtttatcaagtcaattggtcttagggaatattcaagatacttgagtttcaaccatccttgcactcatgaaaggcctcttcttgggcaccttaagtttttcccttgggttgtggacgaaggctattttaaggcatggagacaaggtagaacaggttatccattagttgacgctggaatgagagaattgtgggctgctggttggctgcatgatcgtatacgtgtggtagttgctagtttctttgtgaaggttctacaacttccatggagatggggaatgaagtatttttgggataccctattggatgcagatttagagagcgatgctcttgggtggcaatacataaccggcactctcccagacagccgtgagtttgatcgcatagataatccacagtttgagggttacaaatttgacccgaatggagaatatgtacgccggtggcttcctgaacttgctaggctaccaactgaatggatacaccacccatggaatgcacctgaatctgtactccaagctgccggaattgagctgggatcaaattaccctctccctattgtagggatagatgcagcaaaggtcaggttggaagaagcactttcagaaatgtggcagcaagaagctgcttcaagagctgcaattgagaatggaacagaggaagggcttggagactcctctgaatcagccccatttgccttccccgaagacatacatatggaggaaaaccatgagcctgtgagaaacaatcctcctgctacaaatcgtcgctatgaggatcagatggtcccaagcatgacatcttcctttctgagaattgaagacgaagaaacttctgatgtacgcaattctacaggagatggcagagcagaggtgccaagagatgtaaatgtgaatcaagaaccaagaagagacgctttgaaccaggggtttgttcaaactgttcgtaataacactgctttgtcaccatttaatatttcgagaggtctgacaaatgttgaagactcgaccgcagagtcttcaagtagtggtaggagagagagggatggaggtatagttccagtttggtcccctccaacttctagttactcagagcagtttgttggtgatgacaatggaattggagcaacttcttcttacttgcagaggcatccacagtctcaccagataatcaattggaggcggctatctcaaactgggtaa

SEQ ID NO: 554 - protein, 786 aa, Populus balsamifera subsp. trichocarpa
  misc_feature: Ceres ANNOT ID no.1451869
  misc_feature: Bit score of 1496.1 for HMM based on sequences of FIGURE 22.
  misc_feature (313)..(591): Pfam Name: FAD_binding_7 Pfam Description: FAD binding domain of DNA photolyase
  misc_feature (313)..(591): Pfam Name: FAD_binding_7 Pfam Description: FAD binding domain of DNA photolyase
  misc_feature (60)..(231): Pfam Name: DNA_photolyase Pfam Description: DNA photolyase
  misc_feature: Functional Homolog Of Ceres SEEDLINE ID no. ME12006 at SEQ ID NO. 538
MAWLEDGIDVFSPQGCYRTLASKEERSRLLFCKFSTLSRSEGERVGEGSRDAERKMSGGGCSIVWFRRDLRVEDNPALAAGVRAGAVVAVFVWAPEEEGHYYPGRVSRWWLKQSLAHLDSSLRSLGTSLVTKRSTDSVSSLLEVVKSTGATQLLFNHLYDPLSLVRDHRAKEILTAQGITVRSFNADLLYEPWDVNDAQGRPFTTFDTFWERCLSMPFDPEAPLLPPKRIISELLFEIDNIKKREENAKHSCYISFNHTVLKRNQKVNLVLPNLLSPIYCTLSGDVSRCPSVTLVFEDESEKGSNALLARAWSPGWSNADRALTTFINGPLIEYSMNRRKADSATTSFLSPHLHFGEVSVRKVFHLVRIKQVLWANEGNRAGEESVNLFIKSIGLREYSRYLSFNHPCTHERPLLGHLKFFPWVVDEGYFKAWRQGRTGYPLVDAGMRELWAAGWLHDRIRVVVASFFVKVLQLPWRWGMKYFWDTLLDADLESDALGWQYITGTLPDSREFDRIDNPQFEGYKFDPNGEYVRRWLPELARLPTEWIHHPWNAPESVLQAAGIELGSNYPLPIVGIDAAKVRLEEALSEMWQQEAASRAAIENGTEEGLGDSSESAPFAFPEDIHMEENHEPVRNNPPATNRRYEDQMVPSMTSSFLRIEDEETSDVRNSTGDGRAEVPRDVNVNQEPRRDALNQGFVQTVRNNTALSPFNISRGLTNVEDSTAESSSSGRRERDGGIVPVWSPPTSSYSEQFVGDDNGIGATSSYLQRHPQSHQIINWRRLSQTG

SEQ ID NO: 555 - protein, 716 aa, Arabidopsis thaliana
  misc_feature: Public GI ID no.25407462
  misc_feature: Bit score of 1638.5 for HMM based on sequences of FIGURE 22.
  misc_feature (12)..(183): Pfam Name: DNA_photolyase Pfam Description: DNA photolyase
  misc_feature (214)..(492): Pfam Name: FAD_binding_7 Pfam Description: FAD binding domain of DNA photolyase
  misc_feature (214)..(492): Pfam Name: FAD_binding_7 Pfam Description: FAD binding domain of DNA photolyase
  misc_feature: Functional Homolog Of Ceres SEEDLINE ID no. ME12006 at SEQ ID NO. 538
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENGIGGGSTTSSYLQNHHEILNWRRLSQTGYVKSAFGGAKGEEHHKGCNSGEIWLDCKPSTFGTV

SEQ ID NO: 556 - protein, 617 aa, Armoracia rusticana
  misc_feature: Public GI ID no.29467481
  misc_feature: Bit score of 1677.3 for HMM based on sequences of FIGURE 22.
  misc_feature (211)..(489): Pfam Name: FAD_binding_7 Pfam Description: FAD binding domain of DNA photolyase
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of Ceres SEEDLINE ID no. ME12006 at SEQ ID NO. 538
MTTNKKTIVWFRRDLRIEDNPALAAAAHEGSVFPVFIWCPEEEGQFYPGRASRWWMKQSLAHLSQSLKALGSELTLIKTHNTVSAILDCIRVTGATKVVFDHLYDPVSLVRDHTVKEKLVELGISVQSFNGDLLYEPWEIYCEKGKHFTIFSSYWKKCLDMSIESVMLPPPWRLRPITAAADAVWACSIEELGLENDAEKPSNALLTRAWSPGWSNADKILNEFIDKQLIYYAKNSKKVVGNSTSLLSPYLHYGEISVRRVFQCARMKQIIWARDKNSEGEESTDLFLKGIGLREYSRYICFNFPFTHEQSLLSHLRFFPWDTDVDKFKAWRQGRTGYPLVDAGMRELWATGWMHNRIRVIVSSFAVKFLLLPWKWGMKYFWDTLLDADLECDILGWQYISGSLPDGHELDRLDNPAIQGANFDPEGEYIRQWLPELVRLPTEWIHHPWDAPLTVLKASGVELGTNYAKPIVDIDTARELLTKAISRTREAQIMIGAAPDEIVADSFGALEGNTVKETGLCPSVSSNDQQVPSAVRYNGSKRVKHVEEEERDMKKSRGFDEVMREERDLFSTAESSSSSTTVRFLVSHSCSLVSEGKNLEGIQDPSDQITTKLGKNG

SEQ ID NO: 557 - protein, 617 aa, Armoracia rusticana
  misc_feature: Public GI ID no.29467477
  misc_feature: Bit score of 1391.6 for HMM based on sequences of FIGURE 22.
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of Ceres SEEDLINE ID no. ME12006 at SEQ ID NO. 538
MTTNKKTIVWFRRDLRIEDNPALAAAAHEGSVFPVFIWCPEEEGQFYPGRASRWWMKQSLAHLSQSLKALGSELTLIKTHNTVSAILDCIRITGATKVVFNHLYDPVSLVRDHTVKEKLVELGISVQSFNGDLLYEPWEIYFEKGKPFTNFSSYWKKCLDMSIESVMLPPPWRLMPISTAAEAVWACSIEELGLENEAEKPSNALLTRAWSPGWSNADKILNEFIEKQLIDYAKNSKKVVGNSTSLLSPYLHYGEISVRRIFQCARMKQIIWARDKNSEGDESADLFLKGIGLREYLGIYVSISRLLTSNLCGVIFVFSLGMADVDKFQGLETRQDWLSVGGCRNERALGYGCMHNRLRVIVSSFAVKFLLLPWKWGMKYFWDTLLDADLECDILGWQYISGSLPDGHELDRLDNPAIQGAKYDPEGEYIRQWLPELARLPTEWIHHPWDAPLTVLKASGVELGTNYAKPILDIDTARELLTKAISRTREAQIMIGAAPDEIVADSFEALEGNTVKEPGLYPSVSSNDQQVPSAVRYNGSKRVKHVEEEERDMKKSRGFDEVMREERDLFSTAESSSSSTTVRFLVSHSCSLVSEGKSLEGIQDPSDKITTSLGKNG

SEQ ID NO: 558 - protein, 598 aa, Pisum sativum
  misc_feature: Public GI ID no.45935264
  misc_feature: Bit score of 1530.8 for HMM based on sequences of FIGURE 22.
  misc_feature (207)..(485): Pfam Name: FAD_binding_7 Pfam Description: FAD binding domain of DNA photolyase
  misc_feature (207)..(485): Pfam Name: FAD_binding_7 Pfam Description: FAD binding domain of DNA photolyase
  misc_feature (4)..(175): Pfam Name: DNA_photolyase Pfam Description: DNA photolyase
  misc_feature: Functional Homolog Of Ceres SEEDLINE ID no. ME12006 at SEQ ID NO. 538
MGMNRTIVWFRRDLRIEDNPALAAAARDGSVFPVFIWCPKEEGQFYPGRVSRWWMKQSLVHLDQSLKSLGAGLVIIKTDSTLKALLECVNAVQATKVVFNHLYDPVSLVRDHNIKEKLVEQGVSVQSYNGDLLYEPWEIFDESGHAFTTFDPFWNTCLHMQMKTYSPIPPCQLILAQGKVEKHSIEQLGLEDELEKSSNSSLGRSWSPGWSKSDKALAEFIENYLLHYSGNRLNLGGDSTSLLSPYIHFGELSVRKVFQLARTKQILWTHEGNIIGEESATLFLRAIGFREYSRYLCFSFPFTLERPLLGNLKFFPWNNDPSNFKAWRQGRTGYPLVDAGMRELWATGWIHNKMRVIVSSFAVKMLLIPWKWGMKYFWDTLLDADLESDILGWQYISGSLPDGHKLERLDDPEVLGRKYDPAGEYIRQWLPELARMPAEWIHHPWDAPLTVLTASGVELGQNYPKPIIDIDLAREQLTQAILKMWETEAATEASSSQDRHEVVDENEKLLIPKVFLKDKVPRGATSANDQTVPILQNLKSDDPPNKRQKCTAEEDRKPDKSRNRSDHTEVSCIDQEDCSTAESSSKRQSSSTSSFSVP

SEQ ID NO: 559 - protein, 679 aa, Solanum lycopersicum
  misc_feature: Public GI ID no.5524201
  misc_feature: Bit score of 1483.2 for HMM based on sequences of FIGURE 22.
  misc_feature (207)..(485): Pfam Name: FAD_binding_7 Pfam Description: FAD binding domain of DNA photolyase
  misc_feature (207)..(485): Pfam Name: FAD_binding_7 Pfam Description: FAD binding domain of DNA photolyase
  misc_feature (5)..(176): Pfam Name: DNA_photolyase Pfam Description: DNA photolyase
  misc_feature: Functional Homolog Of Ceres SEEDLINE ID no. ME12006 at SEQ ID NO. 538
MSGGGCSIVWFRRDLRVEDNPALAAGVRAGAVIAVFIYAPEEEGHYYPGRVSRWWLKQSLAHLDSSLKSLGTSLITKRSTDSISSLLEVVKSTGATQLFFNHLYDPISLVRDHRTKEILTAQGISVRSFNADLLYEPWEVNDDEGRPFTTFSAFWEKCLSMPYDPEAPLLPPKRIISGDASRCPSDNLVFEDESEKGSNALLARAWSPGWSNADKALTTFVNGPLLEYSQNRRKADSATTSFLSPHLHFGEVSVRKVFHFVRIKQVLWANEGNKAGEESVNLFLKSIGLREYSRYMSFNHPYSHERPLLGHLRYFPWVVDEGYFKAWRQGRTGYPLVDAGMRELWATGWLHDRIRVVVSSFFVKVLQLPWRWGMKYFWDTLLDADLESDALGWQYISGTLPDGRELDRIDNPQFVGYKCDPHGEYVRRWLPELARLPTEWIHHPWNAPESVLEAAGIELGSNYPLPIVEIDSAKVRLEQALSQMWQNDAAARAAIENGMEEGHGDSADSPIAFPQAMHMEMDHEPVRNNPVIVTVRRYEDQMVPSMTSSLFRAEDEENSVDIRNSVVESRAEVPTDINVAEVHRRDTRDQAVMQTARTNATPHFNFAVGRRNSEDSTAESSSSTRERDGGVVPTWSPSSSNYSDQYVGDDNGIGTSSSYLQRHPQSHQLMNWQRLSQTG

SEQ ID NO: 560 - protein, 681 aa, Nicotiana sylvestris
  misc_feature: Public GI ID no.78217441
  misc_feature: Bit score of 1489.8 for HMM based on sequences of FIGURE 22.
  misc_feature (207)..(485): Pfam Name: FAD_binding_7 Pfam Description: FAD binding domain of DNA photolyase
  misc_feature (207)..(485): Pfam Name: FAD_binding_7 Pfam Description: FAD binding domain of DNA photolyase
  misc_feature (5)..(176): Pfam Name: DNA_photolyase Pfam Description: DNA photolyase
  misc_feature: Functional Homolog Of Ceres SEEDLINE ID no. ME12006 at SEQ ID NO. 538
MSGSGCSIVWFRRDLRVEDNPALAAGVRAGAVIAVFIWAPEEEGHYYPGRVSRWWLKQSLAHLDSSLKSLGTSLVTKRSTDSISSLLEIVKSTGATQLFFNHLYDPISLVRDHRAKEVLTAQGISVRSFNADLLYEPWEVNDEEGRPFTTFSAFWEKCLSMPYDPEAPLLPPKRIIPGDASRCSSDSLVFEDESEKGSNALLARAWSPGWSNADKALTTFVNGPLLEYSQNRRKADSATTSFLSPHLHFGEVSVRKVFHFVRIKQVLWANEGNKAGEESVNLFLKSIGLREYSRYMSFNHPYSHERPLLGHLRYFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFVGYKCDPHGEYVRRWLPELSRLPTEWIHHPWNAPESVLEAAGIELGSNYPLPIVEIDSAKVRLEQALSQMWQHEAASRAAVENGMEEGHGDSADSPIAFPQAMHMEMDHEPVRNNNPVIVTVRRYEDQMVPSMTSSLFRVDDEETSVNIRNSVVDTRAEVPNDVNVTEGPRRDTLDQAVTQPARTNTTPPQFNFVVGRRNSEDSTAESSSSTRERDGGVVPVWSPSSTNYSDQYVGDDNGIGTSSSYLQRHPQSHQLMNWQRLSQTG

SEQ ID NO: 561 - protein, 718 aa, Adiantum capillus-veneris
  misc_feature: Public GI ID no.3551221
  misc_feature: Bit score of 1346.1 for HMM based on sequences of FIGURE 22.
  misc_feature (209)..(487): Pfam Name: FAD_binding_7 Pfam Description: FAD binding domain of DNA photolyase
  misc_feature (209)..(487): Pfam Name: FAD_binding_7 Pfam Description: FAD binding domain of DNA photolyase
  misc_feature (4)..(175): Pfam Name: DNA_photolyase Pfam Description: DNA photolyase
  misc_feature: Functional Homolog Of Ceres SEEDLINE ID no. ME12006 at SEQ ID NO. 538
MAKSCTVVWFRRDLRLEDNPALAAAARAGAVVPVFIWSPDEEGQFRPGRVSRWWLKQSLIQLDISLRSLGVSLVMINANDTVSALLELVKTTGASQVVYNHLYDPVSLVRDHRVKQSLVQNGIQVQSFNGDLLYEPWEVLDDHGKPFTYFESYWAKCLTMPFEPESPLLPPRRLTAAPAGIVHSLTPDELGLEDEADKSSNALLARAWAPGWSNADKALEAFLAGPFLNYSRNRHEIDGPTTSLLSPHLHFGEVSVRKVFHSVRRLQVLWAKDGSMLGEESINYFMRSIGFREYSRYLCFNFPFTHERSLLSNLKSFPWRVDEGLFKAWRQGRTGYPLVDAGMRELWATGWLHNRVRVIVSSFCVKFLQLPWRWGMKYFWDTLLDADLESDILGWQYISGSLPDGHELDRMDNPQTEGYKHDPLGEYVRRWLPELVRLPTEWIHHPWDAPPGVLRAAGVELGSNYPRPVVEVAAARERLRDAVTHMWEQEAALKAAGDKGIEEASVGDSIAKVNCQPEVAAQPCKIPKASVSQATNGDMEVSSAGSSRRDQMVPTFAKELKTQADALCGDYGSIALPLPSQQNLPCPSTNFSAIRGVSKLSPGNRGDMVDTTEALRNTHSEPLPPVSDTNPMTESSSSSSPREQISSIKDDPPMIWVPAIAHQRPSSDFGCVPYAGDAEQLRKHLLILQNARTDDKVEDGVQLNGSQWARGSKRKAKS

SEQ ID NO: 562 - protein, 679 aa, Adiantum capillus-veneris
  misc_feature: Public GI ID no.3551219
  misc_feature: Bit score of 1371.8 for HMM based on sequences of FIGURE 22.
  misc_feature (212)..(490): Pfam Name: FAD_binding_7 Pfam Description: FAD binding domain of DNA photolyase
  misc_feature (212)..(490): Pfam Name: FAD_binding_7 Pfam Description: FAD binding domain of DNA photolyase
  misc_feature (8)..(179): Pfam Name: DNA_photolyase Pfam Description: DNA photolyase
  misc_feature: Functional Homolog Of Ceres SEEDLINE ID no. ME12006 at SEQ ID NO. 538
MAAHTIVAHTIVWFRRDLRIEDNPALVAAVRAGPVLPVFIWSPEEEGQFLPGRVSRWWLKQSLVHLNESLTILGAPLVMRRASNVLAALLEIKKATGATQVFYNHLYDPVSLVRDHRVKQGLSQAGIIVNSFNADLLYEPWEVNDDNGQAFTTFSGFWAKCMDMPAEPEAQILPPKRILKFPGPSLSCSIEDLDLEDELEKGSNALLARAWQPGWANADRALESFINGSLMEYAANRQKVDSATTSLLSPHLHYGEVSVRKIFHNVRMKQVLWVKEGRVEAEESVNLFLRSIGFREYSRYLSFNFPFTHERSLLYNLKFFPWRVDESYFKAWRQGRTGYPLVDAGMRELWATGWLHNQIRVIVSSFCVKFLQLPWRWGMKYFWDTLLDADLESDVLGWQYISGSLPDGHELDRIDNPQIEGYKFDPYGEYVRRWLPELSRLPTEWIHHPWDAPPSVLRAAGIELGSNYPRPIVEIAAARERLEQALAEMWANEAADKATLANGLEEGLGDTVEVQGMRNGFPANMDIDRGPGEKALLVRSPHDQMVPNVGVRRSTTGAVQGGAANQGSALQAVLREVPANGHVQAVQAQSQRMAAPPMAMQNGYDDTHSTAESTSARHWSLAIGLPVWSQYVPVCLHMRQDDSQVPLVPDLHHGVMSRRLPHAPPMVNFEATKTSSLSV

SEQ ID NO: 563 - protein, 651 aa, Oryza sativa subsp. indica
  misc_feature: Public GI ID no.23954324
  misc_feature: Bit score of 1696.8 for HMM based on sequences of FIGURE 22.
  misc_feature (211)..(489): Pfam Name: FAD_binding_7 Pfam Description: FAD binding domain of DNA photolyase
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of Ceres SEEDLINE ID no. ME12006 at SEQ ID NO. 538
MAGSERTVVWFRRDLRIDDNPALAAAARDGVVLPVFIWCPADEGQFYPGRCSRWWLKQSLPHLSQSLESLGCPLVLIRAESTLEALLRCIDSVGATRLVYNHLYDPVSLVRDDKIKKELSALGISIQSFNGDLLYEPWEIYDDSGLAFTTFNMYWEKCMELPIDISPSLAPWKLVPAPGLESVRSCSVDDLGLESSKDEESSNALLRRAWSPGWRNAEKMLEEFVSHGLLEYSKHGMKVEGATTSLLSPYLHFGEVSVRKVYQLVRMQQIKWENEGTSEAEESIHFFMRSIGLREYSRYLCFNFPFTHEKSLLGNLKHYPWKVDEERFKSWRQGMTGYPLVDAGMRELWATGWTHNRIRVIISSFAVKFLLIPWTWGMKYFWDVLLDADLESDILGWQYISGSLPDGHELSRLDNPEVQGQKYDPDGVYVRTWIPELARMPTEWIHHPWDAPSCILEVAGVELGFNYPKPIVDLHIARECLDDSISTMWQLDTAEKLAELDGEVVEDNLSNIKTFDIPKVVLRETSPCALPIDQRVPHASSKDHNLKSKVLKASNRSSICVDMIRSSKMEATSSVANSPVSRKRSFCETAFHVPSYSSSAEVHSHIQDHGGSLVGPSRYLLQEAGRNCVDEVEDSSTADSGSSISRQRKAA

SEQ ID NO: 564 - protein, 665 aa, Oryza sativa subsp. japonica
  misc_feature: Public GI ID no.125582937
  misc_feature: Bit score of 1506.6 for HMM based on sequences of FIGURE 22.
  misc_feature (211)..(539): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of Ceres SEEDLINE ID no. ME12006 at SEQ ID NO. 538
MAGSERTVVWFRRDLRIDDNPALASAARDGAVLPVFIWCPADEGQFYPGRCSRWWLKQSLPHLSQSLESLGCPLVLIRAESTLEALLRCIDSVGATRLVYNHLYDPVSLVRDDKIKKELSALGISIQSFNGDLLYEPWEIYDDSGLAFTTFNMYWEKCMELPIDASPSLAPWKLVPVPGLESVRSCSVDDLGLESSKDEESSNALLMRAWSPGWRNAEKMLEEFVSHGLLEYSKHGMKVEGATTSLLSPYLHFGEVSVRKVYQLVRMQQIKWENEGTSEAEESIHFFMRSIGLREYSRYLCFNFPFTHEKSLLGNLKHYPWKVDEERFKSWRQGMTGYPLVDAGMRELWATGWTHNRIRVIISSFAVKFLLIPWTWGMKYFWDVLLDADLESDILGWQYISGSLPDGHELSRLDNPEVSLIKACLVFTTFSMALVQKCRLTQYLCLVFIVLVDYGKCDCYVLCLVHMVQGQKYDPDGVYVRTWIPELARMPTEWIHHPWDAPSCILEVAGVELGFNYPKPIVDLHIARECLDDSISTMWQLDTAEKLAELDGEVVEDNLSNIKTFDIPKVVLRETSPCALPIDQRVPHASSKDHNLKSKVLKDGSNELCSKLTAEVHSHIQDHGGSLVGPSRYLLQEAGRNYVDEVEDSSTADSGSSISRQRKAA

SEQ ID NO: 565 - protein, 696 aa, Marchantia paleacea var. diptera
  misc_feature: Public GI ID no.83764373
  misc_feature: Bit score of 1435.7 for HMM based on sequences of FIGURE 22.
  misc_feature (208)..(486): Pfam Name: FAD_binding_7 Pfam Description: FAD binding domain of DNA photolyase
  misc_feature (208)..(486): Pfam Name: FAD_binding_7 Pfam Description: FAD binding domain of DNA photolyase
  misc_feature (3)..(174): Pfam Name: DNA_photolyase Pfam Description: DNA photolyase
  misc_feature: Functional Homolog Of Ceres SEEDLINE ID no. ME12006 at SEQ ID NO. 538
MAARTIVWFRRDLRVEDNPALVAAARAGIVIPVFIWSPEEDGQFHPGRVSRWWLKQSLIHLDSSLKSLGSPLIMRKSPDTLTVLLDIVQQVGATQVFYNHLYDPVSLVRDHRVKQGLSIHNIPVHTFNGDLLYEPWEVYDDEGQAFTTFDDFWDKCMNMPFEPEAPLLSPRRLVGLPPGRISVGRIDDLGLENEYERSSNALLGRAWAPGWSSANKALEVFMKGPLHDYATHRIKADNANTSQLSPHLHFGEVSVRKIFHEARTKQILWARENSYVGEQSVGMFLRAIGFREYSRYLSFNFPFTHERSLLANLKSFPWRIDENSFKSWRQGRTGYPLVDAGMRELWATGWLHNRIRVVVSSFCVKFLQLPWRWGMKYFWDTLLDADLECDVLGWQYISGSLPDGHELDRMENPQIEGYKFDPEGEYVRRWLPELSRLPTEWIHHPWDAPANVLRAAGVELGSNYPLPIVDISSARDQLQQSLAEMWEREAASKAALANGSEEGLGETVETPGSCGPGVKMDVHRVVIRSSRAACSTASSRRDQLVPCMPTEDHKLAAASIMNWNQSPVDEEDEPVQPAFVPSQTGGLLDRPSDVRAEVIAHPPSDSSMAEAVHVDNELNSTAESSAAVGRRSEESRGEVPVWPQSSSSRPQRPHLEGLVPVVPEVRRATMNRRHLHSMQMVNLEARTSHKTSSLSA

SEQ ID NO: 566 - DNA, 1965 bp, Sorghum bicolor
  misc_feature: Ceres ANNOT ID no.6045327
  misc_feature: Encodes the peptide sequence at SEQ ID NO. 567
atggctgggtcggggaagactgttgtttggttcaggagagacctcaggatccacgataacccggccttggcagctgcggcgaaagagggctctgtcctccctctcttcatatggtgtcctgctgactacgagcagtattaccctggaaggtgctcccggtggtggctcaagcagtcccttgcccaccttgggaagtcactagagttgctcgggtgcccactcgtgctgatccgtgcggaggacagcactcttgcaactcttttggagtgcgtccattgcatcagtgccactagagtcgtttataatcgtctctacgaccctatttcacttgtgcttgacgacaaaatcaagaatgagctttcagcccatggcatatctgtccaaagtttcaatggtgatctactttacgagccgtgggatgtttatgatgagaatgggcaggcatttacatcctttaacaagtactgggagaaatgcatgaatgttcctattgagatatcacaatatcttgcacctacgaggctggtggcagcgccaggtctagcgaatgttcgctgttgttcaattgatgatctaggtcttgaatctagtaaggatgtggaatcaagcaatgctttgctaagcagggcctggtctcctggctggcgcaatgcagagaatatgcttgaggaatttttgtcatgtggtctcctagaatattcaaaacacggtatgaaggttgggggaactacaacgtcattattgtcaccatatctccatttcggggagttgagtgtaaggaaggtttatcaacttgttacaatgcatcatgtcaagtggcaaaatgaaggaaaatctgaagctgaggagagtgttcgattgttcctaagatcaattggttttcgggaatattcacggtacttatgttttaacttcccattcacgcacgagagatcatttctgggtaacttgaagcattatccctggctattggatgaggaccgtttcaaatcttggagacagggaatgactggatacccattagtagatgctggcatgagagaactctgggctactggttggacacataatcggataagagtgattgtttcaagtttcgctgtaaaatgtctacagataccctggatttggggaatgaagtacttttgggatgtgcttctggatgcagacctagaaagtgatattcttggttggcagtatatatctgggagtttgcctgatggacatgagctcagccgtcttgataatccagaggttcagggtcaaaagtacgatccagatggtgaatatgtaagaacttggattcctgaacttgctagaatgccaacagaatggatccattgtccatggagtgctcctaactctatattacaagttgctggagttgagttgggctttaactaccctaagcccatagtagaacttcatatggcgcgggaatgcttagatgacgccatctccacaatgtggcaactggacacagctgcaaaacttgctgcactagatggtgaagttgtggacgacaatctgaataatatcaggagttttgatatcccaaaggttgttttgaagaagaaattatctccaagcacttcatcgatgaacaaaagggtgctgtctactaatggcaagaacgaaaagtcacagcctactgaagtgaaggccccgtacaaacagattattcgagatgatatgatcaatgcctcaaacatggatgacaccggctctactgctaacttgcaagtgacaaggaaaagatctcgcagtgatagtgctttcaatgttccgtcatcttcatcctcactagtcatggaatcacggattcatgataatgacagttgttctgttcggtattcaggctacctccagcagacagcagacagggatgacactgataaggttgaagataacgacagtgaagatagtggtacgagcatctctaggccatccaagagacctgcttag

SEQ ID NO: 567 - protein, 654 aa, Sorghum bicolor
  misc_feature: Ceres ANNOT ID no.6045327
  misc_feature: Bit score of 1373.1 for HMM based on sequences of FIGURE 22.
  misc_feature (212)..(490): Pfam Name: FAD_binding_7 Pfam Description: FAD binding domain of DNA photolyase
  misc_feature (212)..(490): Pfam Name: FAD_binding_7 Pfam Description: FAD binding domain of DNA photolyase
  misc_feature (5)..(176): Pfam Name: DNA_photolyase Pfam Description: DNA photolyase
  misc_feature: Functional Homolog Of Ceres SEEDLINE ID no. ME12006 at SEQ ID NO. 538
MAGSGKTVVWFRRDLRIHDNPALAAAAKEGSVLPLFIWCPADYEQYYPGRCSRWWLKQSLAHLGKSLELLGCPLVLIRAEDSTLATLLECVHCISATRVVYNRLYDPISLVLDDKIKNELSAHGISVQSFNGDLLYEPWDVYDENGQAFTSFNKYWEKCMNVPIEISQYLAPTRLVAAPGLANVRCCSIDDLGLESSKDVESSNALLSRAWSPGWRNAENMLEEFLSCGLLEYSKHGMKVGGTTTSLLSPYLHFGELSVRKVYQLVTMHHVKWQNEGKSEAEESVRLFLRSIGFREYSRYLCFNFPFTHERSFLGNLKHYPWLLDEDRFKSWRQGMTGYPLVDAGMRELWATGWTHNRIRVIVSSFAVKCLQIPWIWGMKYFWDVLLDADLESDILGWQYISGSLPDGHELSRLDNPEVQGQKYDPDGEYVRTWIPELARMPTEWIHCPWSAPNSILQVAGVELGFNYPKPIVELHMARECLDDAISTMWQLDTAAKLAALDGEVVDDNLNNIRSFDIPKVVLKKKLSPSTSSMNKRVLSTNGKNEKSQPTEVKAPYKQIIRDDMINASNMDDTGSTANLQVTRKRSRSDSAFNVPSSSSSLVMESRIHDNDSCSVRYSGYLQQTADRDDTDKVEDNDSEDSGTSISRPSKRPA

SEQ ID NO: 568 - DNA, 495 bp, Arabidopsis thaliana
  misc_feature: Ceres SEEDLINE ID no.ME12596
  misc_feature: Expected Sequence
  misc_feature: Encodes the peptide sequence at SEQ ID NO. 570
atggagagatcagcgtcggtgggtgttaacgacggccgttttggtggcaaccaattctattcgccatctttctcttcttcttcttcttcttcttccatgagacatgttaattacagttgtggatcttgtgggtatgaactaaacctgagctccacgaatcgaatcacatcgacaatcggatcaaagtacggtaaatccatgaagagtgggatcatatctttcttcaacatcgacgagggaagattcagtcaggtcgatgagttccaatgcatgcctcacttctctagatactcttggggtttgtttcgacacagaacgaagcttctatgtcgcaaatgtaataattatatcggcaatgcttctcaggagaaggctcctgagtatgcacttgttacacaaaactcggatccgacatcgcctaggattggtagtgttacgaagtacgatatcagaatccgctcgcttcaaccttcttctgcggtcgctttgctgtga

SEQ ID NO: 569 - DNA, 1142 bp, Arabidopsis thaliana
  misc_feature: Ceres SEEDLINE ID no.ME12596
  misc_feature: Inplanta Sequence
  misc_feature: Encodes the peptide sequence at SEQ ID NO. 570
atggagagatcagcgtcggtgggtgttaacgacggccgttttggtggcaaccaattctattcgccatctttctcttcttcttcttcttcttcttccatgagacatgttaattacaggtatcttttgcttacacgtcaatttactgaatcttgtggcttagggttcttattttagtaattgtagtaagaaaatgaagctaatggttcttgtttttttttctgaatttagtaaaaatctgtattgagacagaacccttgtttctgtgtaactgtgaaaagataaatctttgttctttatttagtttggttcatcattcggtgactaatttggaagcagagtaatcatgtgaataaggaattagtaatcaatttgatttgattgttgtattgaatctcaaaggtagtctaggttttttttatttagggttttgatagttgattttggagtaattgtgtatttagcttggttcatcattttaataaggcacatgtgaatcatgaatttgttaatttgttgatgatgatgatgattattgttatgtgaattggtaggtgatgattatacttagttgttgtcttgtcttgtctataattcgatgactaatttgtagtcttgtcttgtcatagagctcgttttgttacttagattagttttgttacttagataaaggattgttatgttgattgatctttagtttgttggtgttgtgttctttttagataataacttagactgaacaaatatcttttgaactttcttgtagttgtggatcttgtgggtatgaactaaacctgagctccacgaatcgaatcacatcgacaatcggatcaaagtacggtaaatccatgaagagtgggatcatatctttcttcaacatcgacgagggaagattcagtcaggtcgatgagttccaatgcatgcctcacttctctagatactcttggggtttgtttcgacacagaacgaagcttctatgtcgcaaatgtaataattatatcggcaatgcttctcaggagaaggctcctgagtatgcacttgttacacaaaactcggatccgacatcgcctaggattggtagtgttacgaagtacgatatcagaatccgctcgcttcaaccttcttctgcggtcgctttgctgtga

SEQ ID NO: 570 - protein, 163 aa, Arabidopsis thaliana
  misc_feature: Ceres SEEDLINE ID no.ME12596
  misc_feature: Bit score of 424.4 for HMM based on sequences of FIGURE 24.
MERSASVGVNDGRFGGNQFYSPSFSSSSSSSSMRHVNYSCGSCGYELNLSSTNRITSTIGSKYGKSMKSGIISFFNIDEGRFSQVDEFQCMPHFSRYSWGLFRHRTKLLCRKCNNYIGNASQEKAPEYALVTQNSDPTSPRIGSVTKYDIRIRSLQPSSAVAL

SEQ ID NO: 571 - DNA, 1014 bp, Gossypium hirsutum
  misc_feature: Ceres CLONE ID no.1919714
  misc_feature: Encodes the peptide sequence at SEQ ID NO. 572
gagcgcgttccctcttctctagaaactgctgctgtttttttttcatccttttaactcagtccctgaaaattgagccgttaacgtcaacccgattcaggcggaaccgtttcctcactcaaaatcctcgcacaaactcagcagttaattaaacacttcataaagttgagtcgctttattagcacagttgccgttatagtgataatcaaaggtgttgattctgtaggaagaaggaaaaaagtaatggagaaatctgtttttgttaaagatgtacaacaactcaatggaaatctccaccattctttttcctctgtttctcaaagagatgtaacttacagctgtggttcttgtgggtatgagctaaacctaagttcctctagtagaaacaccgcaacaatcggctctaaatatggaaaattgattaagcgagggatgatatcattcttcaatatagacgagaccagatttacgcaggtcgatgaattccaatgcagaccctacttttcgaagcactcatggggtttattccgccatagaaccaaattactttgtcgcaagtgtgggaaccacattggcgatgcttatgatgataaatcttctggctaccctcatgtcttagatggttctgattcatcctccggcactgaaccttctaaccatagaaaatatgatgttagaatccgtgccctacagccttcgactgctgaaggactcggctctccactttttgcgtgatttcctgcagtgcatcattgatggtcttcggtttgaattatcaacgactgactgagcgttttcgtatgggattattgctgtctattagttggtttgagtcttccattttatgctgtctttgctgtgtttctgttaagtgtatatatgaaaggtaagtaatgtggagctttaaaatgaggttgagcacagtaatgtcattacccaaatttaagtgtaatatctgtttgagttgaattaaatcaagtatttttcttttggccttaaaaaaaaaaaaaaaaaaaa

SEQ ID NO: 572 - protein, 163 aa, Gossypium hirsutum
  misc_feature: Ceres CLONE ID no.1919714
  misc_feature: Bit score of 452.1 for HMM based on sequences of FIGURE 24.
  misc_feature: Functional Homolog Of Ceres SEEDLINE ID no. ME12596 at SEQ ID NO. 570
MEKSVFVKDVQQLNGNLHHSFSSVSQRDVTYSCGSCGYELNLSSSSRNTATIGSKYGKLIKRGMISFFNIDETRFTQVDEFQCRPYFSKHSWGLFRHRTKLLCRKCGNHIGDAYDDKSSGYPHVLDGSDSSSGTEPSNHRKYDVRIRALQPSTAEGLGSPLFA

SEQ ID NO: 573 - DNA, 495 bp, Populus balsamifera subsp. trichocarpa
  misc_feature: Ceres ANNOT ID no.1443290
  misc_feature: Encodes the peptide sequence at SEQ ID NO. 574
atggaaaaatctaaggttggcaagggagcttacctcaacgggaatccccatcattccttctcttcttcctctgcttctcaaagacatgtcagctacagctgcggtatttgcgggtatgaattgaacttgagctcctccaatcggaacacctcatctattggctctaaatatgggaaatccataaagagagggatcatctcattcttcttcatcgatgagagcagatttacccaggttgatgaattccaatgcattcccttcttttcaagaaactcctggggtttgttccaccggagaacagcacttctttgccgcaagtgtggtaataatattggaattgcttatgatgataaagcctcagcttatccacttgtagcagacggatctgactcttcctcagtcagtgaagtttccaaacatcgaaaatatgatgttaaaatccgtgccttgcagccttcttctgttgaccagtttagcactccaattcacacctga

SEQ ID NO: 574 - protein, 164 aa, Populus balsamifera subsp. trichocarpa
  misc_feature: Ceres ANNOT ID no.1443290
  misc_feature: Bit score of 445.6 for HMM based on sequences of FIGURE 24.
  misc_feature: Functional Homolog Of Ceres SEEDLINE ID no. ME12596 at SEQ ID NO. 570
MEKSKVGKGAYLNGNPHHSFSSSSASQRHVSYSCGICGYELNLSSSNRNTSSIGSKYGKSIKRGIISFFFIDESRFTQVDEFQCIPFFSRNSWGLFHRRTALLCRKCGNNIGIAYDDKASAYPLVADGSDSSSVSEVSKHRKYDVKIRALQPSSVDQFSTPIHT

SEQ ID NO: 575 - DNA, 936 bp, Glycine max
  misc_feature: Ceres CLONE ID no.1042157
  misc_feature: Encodes the peptide sequence at SEQ ID NO. 576
attatcttcttcttctctacctttcgatcctttcactttggcgtgaccgaaccattccactccctcgcaaaacggtgtcgtgccgatcgcgttcgttcggttaaactcgcgcgttcagaatcctccggaacaacgctcttcgcccaattccctataattcactcctctctctctctcgctttctctggtaacctcctcgcgacggtggctcttccgcattccgccgccgccactgccatcgccgttgccgccgccggaaaacactaatcaatagatggatgattctgcgttcaaacgaggcggtcactttaatcgaacttactcgtgctcttctcagagagatgtctgttacagctgtggcacttgtggttatgagctgaacctatcctcctcaaaccggaacactgcatccattggatctaaatacgggaagtccataaagcgaggtattatatcattcttcagcattgatcttagcagatttactcaggttgatgaaattcagtgtgtgccccattttgataagcactcatggggtttgtttcgccgaagaaccaagcttctttgtcgcaagtgtggcaaccatattggaaatgcatacaatggttacacttcgtcctttcctcttgtgtcagacggagcagaatcatctcctagttccaaagtggtcagtcatacaaaatatgacattcgcatttgtgccttacaaccttcatcttctgaagaatctggaatccccgtgtttgcttgaactacctggtaaaaatagtaattcctacacagccaaatccggtgacagggtggttagaagttcattaatatatgcagatggtttggcttgttttttgtgcttttcctaatgaaaatgtgactaatagtcgtgtgaaagagttgtaagaattaaattaaaaattattacaggtgtgggattttatg

SEQ ID NO: 576 - protein, 158 aa, Glycine max
  misc_feature: Ceres CLONE ID no.1042157
  misc_feature: Bit score of 428.4 for HMM based on sequences of FIGURE 24.
  misc_feature: Functional Homolog Of Ceres SEEDLINE ID no. ME12596 at SEQ ID NO. 570
MDDSAFKRGGHFNRTYSCSSQRDVCYSCGTCGYELNLSSSNRNTASIGSKYGKSIKRGIISFFSIDLSRFTQVDEIQCVPHFDKHSWGLFRRRTKLLCRKCGNHIGNAYNGYTSSFPLVSDGAESSPSSKVVSHTKYDIRICALQPSSSEESGIPVFA

SEQ ID NO: 577 - DNA, 874 bp, Zea mays
  misc_feature: Ceres CLONE ID no.1384304
  misc_feature: Encodes the peptide sequence at SEQ ID NO. 578
cttactgcttcaattcgatcgttgctagaaagttgaaaccacgacatcggaggcgtgaaaaagttttaagtcacaccgaatcaatcaagtgggagggacacgttcttcaacctattaatcaaaccccactcttctcggtcacgaaagtcttggaagctttgcctgatttcgagcgacgatggacagatcggcgtcggtgggtatcaaggacggcggatttggtggcaaccacttgtattctccatcattttcttcttcatcttccatgagacatgtcaattacagttgtggatcttgtgggtacgagctgaacttgagctccaccaatcgaattacatcatcaattggatcgaagtatgggaaatccatgaagactggaatcatatccttcttcaacattgacgaggggagattcagccaggttgatgagttccaatgcatgcctcacttctccagatactcttggggtttgttcagacgcaagactaagcttctctgtcgccaatgtaataactacataggcaatgcttcttatgacaaggcccctcctgagtacgcactcgtaacacaaaactcatcgcccaggaagggtgtcactgacactgttaccaagtatgatatcagaattcgtgcgcttcaaccttcttccggtgttgcttctctgtgactgagtgtgtttcttctacaactgtatattgtagaaaattcttcaaagtatcagtactgttttcataaggtgggttcggctttttctttctttctcaaattgtacagtaatttaacaatttgccttttttttttttttttgtttctgagaatattgaggttaaatatgaatttcacttgctcatgttcatcaaaaaaaaaaaaaaaa

SEQ ID NO: 578 - protein, 162 aa, Zea mays
  misc_feature: Ceres CLONE ID no.1384304
  misc_feature: Bit score of 427.7 for HMM based on sequences of FIGURE 24.
  misc_feature: Functional Homolog Of Ceres SEEDLINE ID no. ME12596 at SEQ ID NO. 570
MDRSASVGIKDGGFGGNHLYSPSFSSSSSMRHVNYSCGSCGYELNLSSTNRITSSIGSKYGKSMKTGIISFFNIDEGRFSQVDEFQCMPHFSRYSWGLFRRKTKLLCRQCNNYIGNASYDKAPPEYALVTQNSSPRKGVTDTVTKYDIRIRALQPSSGVASL

SEQ ID NO: 579 - protein, 152 aa, Oryza sativa subsp. japonica
  misc_feature: Public GI ID no.115464375
  misc_feature: Bit score of 394.1 for HMM based on sequences of FIGURE 24.
  misc_feature: Functional Homolog Of Ceres SEEDLINE ID no. ME12596 at SEQ ID NO. 570
MVRTPERSYSCSSAKEVAYSCGYCGYALNLSSSTRNTANIGSKYGKQIRKGVISFFAIDESRFTQTDEVSCMPYFHSRRSWGLFRKRTRLICRKCGGRIGNAYEDEDSTLYDGSDDLHMSSEGYSMSSGKKYVIKINALQPSTDDSGVPFTL

SEQ ID NO: 580 - protein, 122 aa, Gossypium hirsutum
  misc_feature: Ceres CLONE ID no.100028078
  misc_feature: Bit score of 135.8 for HMM based on sequences of FIGURE 24.
  misc_feature: Functional Homolog Of Ceres SEEDLINE ID no. ME12596 at SEQ ID NO. 570
MSQAHVSYSCGSCGYPLNLTSSNRIATSIGSEYRKSVEKGLISFLSVDLSRFTQVDEVHCFPVSWGRHRSKTKLLCRKCGVHVGYGYGDAPALCGFDSPDSSSAAFRKFTIKIRALQPSDEC

SEQ ID NO: 581 - DNA, 495 bp, Populus balsamifera subsp. trichocarpa
  misc_feature: Ceres ANNOT ID no.1452096
  misc_feature: Encodes the peptide sequence at SEQ ID NO. 582
atggaaaaatctacggctttcagggaagcttacctcaacgggaatcaccatcattccttttcttcttcctctgcttctcatagacatgttagctacagctgcggtatctgcgggtatgagttgaacttgagctcctccaatcgaaacacgtcaacaattggctctaaatatgggaaatccataaagcgagggaaaatctcattcttcttcatcgatgagagtagatttactcaggttgatgaattccaatgctttcccttcttttcaaaaaactcccttggtttgttccgccagagaactgcacttctttgccgcaagtgtggtaatcacattggaattgcttatgctgatgaagcttcagcttatccacttgtagcagacggatctgactcttcctcagtcagtgaagttttcaaacgtcgaaaatatgatgttaaaatccgtgccttgcagccttcttctgccgagcagtttagcattccactttacacctga

SEQ ID NO: 582 - protein, 164 aa, Populus balsamifera subsp. trichocarpa
  misc_feature: Ceres ANNOT ID no.1452096
  misc_feature: Bit score of 404.0 for HMM based on sequences of FIGURE 24.
  misc_feature: Functional Homolog Of Ceres SEEDLINE ID no. ME12596 at SEQ ID NO. 570
MEKSTAFREAYLNGNHHHSFSSSSASHRHVSYSCGICGYELNLSSSNRNTSTIGSKYGKSIKRGKISFFFIDESRFTQVDEFQCFPFFSKNSLGLFRQRTALLCRKCGNHIGIAYADEASAYPLVADGSDSSSVSEVFKRRKYDVKIRALQPSSAEQFSIPLYT

SEQ ID NO: 583 - DNA, 471 bp, Populus balsamifera subsp. trichocarpa
  misc_feature: Ceres ANNOT ID no.1503869
  misc_feature: Encodes the peptide sequence at SEQ ID NO. 584
atggaatcatggattgggtttagatgtgtgcttgaaatagtgtgttcatttcttcgaaaaagaaagaaaagctgcggttcttgtgggtatcagttaaacttgaactcttgcaaccggaacactccagatattggagttaattacaagaaatccataaagaaaggaagtatttcattcttcagcattgatgaaaccaggttcactcaaattgaagaacttcgatgtacaccatacttcaattccatgcgttcctggggtttattccagcgaagaaccaagcttctttgttacaaatgtggaaatcatcttgggattgcttacaaagagaataatacctcttcctcccctctcagattggggaaatgtcgatcagatttgatctcttgggatgggatttctgatgccagaatttatgttatcaagatacgttccttgcagcctgcttctactgaggactatagtttgagctga

SEQ ID NO: 584 - protein, 156 aa, Populus balsamifera subsp. trichocarpa
  misc_feature: Ceres ANNOT ID no.1503869
  misc_feature: Bit score of 173.8 for HMM based on sequences of FIGURE 24.
  misc_feature: Functional Homolog Of Ceres SEEDLINE ID no. ME12596 at SEQ ID NO. 570
MESWIGFRCVLEIVCSFLRKRKKSCGSCGYQLNLNSCNRNTPDIGVNYKKSIKKGSISFFSIDETRFTQIEELRCTPYFNSMRSWGLFQRRTKLLCYKCGNHLGIAYKENNTSSSPLRLGKCRSDLISWDGISDARIYVIKIRSLQPASTEDYSLS

SEQ ID NO: 585 - DNA, 453 bp, Populus balsamifera subsp. trichocarpa
  misc_feature: Ceres ANNOT ID no.1525651
  misc_feature: Encodes the peptide sequence at SEQ ID NO. 586
atgacaaaagaatttactgggggtggtcctttcaatcaaccagatcctgctaaaggggagcgtaaaacaaggcaatctgcaagaattaagcttctgtttgagctgcaaagctgtggctcttgtggataccccttgaatttaacatcttccaatcgaatcacctccaacataggttctggatatcagaaatctataaagaaaggttatatctccttcctttctgttgatcttagtcgattcacacaggttgatgaggtaaactgtcttcctgtgtcttggggtcgttatcattcaaaaagtaaacttctttgtcgtaaatgtggggttcacgtaggctatggatatggagattcgcccgctctatgtggttttgactctcccaactcatcaagctcagcttataaaaaatttaccataaagatccgagctctacagccttcagaagagtgctaa

SEQ ID NO: 586 - protein, 150 aa, Populus balsamifera subsp. trichocarpa
  misc_feature: Ceres ANNOT ID no.1525651
  misc_feature: Bit score of 128.4 for HMM based on sequences of FIGURE 24.
  misc_feature: Functional Homolog Of Ceres SEEDLINE ID no. ME12596 at SEQ ID NO. 570
MTKEFTGGGPFNQPDPAKGERKTRQSARIKLLFELQSCGSCGYPLNLTSSNRITSNIGSGYQKSIKKGYISFLSVDLSRFTQVDEVNCLPVSWGRYHSKSKLLCRKCGVHVGYGYGDSPALCGFDSPNSSSSAYKKFTIKIRALQPSEEC

SEQ ID NO: 587 - DNA, 918 bp, Glycine max
  misc_feature: Ceres CLONE ID no.1645639
  misc_feature: Encodes the peptide sequence at SEQ ID NO. 588
ttgccttcattcatctcaaaatgaaaaattccgtgtttaacaacaaagcacaagttcaccaaaatcgaacttgctcctcctattcctattcctactcttctcagagggatgtctgctacagttgtggtacatgcgggtatgagcttaacctatcctcctctaaccggaatatatcatccatcggttcaaaatatgggaaatccataaagcgaggcattatatcattcctcaacgttgatgacagcagattcacccgcgccgatgaaattgaattcgccccatatttttcaaagcacaagtggggtttgttccgccgaaaaaccaagcttctttgtcgcaagtgttgcaaccatattggatatgcctacaacgatcgcacttcatcattttttcccttcgtatcaaacagaacagaaccatcaccacccaccgaagcatcaaattcaagtccaatgaaatacgatattcgcattcgtgctttacaaccttcatcttctcaagaacatggaatcactgtgttggcttaaaatttcaaatacgcggtaaaaaattgttatcactaactacggggaggttgtgatttcattttttttttttttttatagatttgaagttctgttttggcaagggtgttgtgttcccctttccctgtgtctcaagtgtgattaatatacacttgtatactagaagtagtagctgtggaatttttggaatgttaagttaaattttgcaaaacaacgaagatagaaagaatatttatggtggtgctacttcgtaaatcagaagatattatctagttttgaatagtcagatatcaggagtggattgcccggcctcacaatgtatgaatataatgttgatatataatcgtatattgtatggtataatattattttcagcaaaaaaaaaaaaaaaaaa

SEQ ID NO: 588 - protein, 168 aa, Glycine max
  misc_feature: Ceres CLONE ID no.1645639
  misc_feature: Bit score of 306.1 for HMM based on sequences of FIGURE 24.
  misc_feature: Functional Homolog Of Ceres SEEDLINE ID no. ME12596 at SEQ ID NO. 570
MKNSVFNNKAQVHQNRTCSSYSYSYSSQRDVCYSCGTCGYELNLSSSNRNISSIGSKYGKSIKRGIISFLNVDDSRFTRADEIEFAPYFSKHKWGLFRRKTKLLCRKCCNHIGYAYNDRTSSFFPFVSNRTEPSPPTEASNSSPMKYDIRIRALQPSSSQEHGITVLA

SEQ ID NO: 589 - DNA, 709 bp, Glycine max
  misc_feature: Ceres CLONE ID no.603237
  misc_feature: Encodes the peptide sequence at SEQ ID NO. 590
attataaaactgagtccttcactctctctcgaaccagctcacagaaacaatgatctcctacgccgacatgctcaagggatcacatggatgtcaacaacttcaactatcctccattgtcagagatgtaaactacagctgtggctcgtgtggttatgagctgaacttgaactccagcaaccgcaacacttgttctctcattgactcaaagtccataaagagaggcatcatctccttcttctccgtggatgagagcaggttcactcagatccagcaacttcactggccttcttggatgccctttttcaactccaagcgccaaagaaccaagcttttttgccgcagctgtgggaaccaccttggctatgcttacactttgccctctcaatctcaatcctgggatggcatctctgatgattccagaatctatgatatcaaactaaccgctttgttaccttctttctgcgaggaaccaagtcaaaagttagaggatatgggcaagtttgagactgcatcttcctccactstggtgttctaattctgaaagggacagaaacatattcatcagtttcttgtttgtttgaatgtgaattaatgtattctaccttttgatcattatgaggatactttctcaatagttttttttttttttaattctgttccgtgtgcttagttgatcatttaactattgtgtaatgtttagctttattgt

SEQ ID NO: 590 - protein, 161 aa, Glycine max
  misc_feature: Ceres CLONE ID no.603237
  misc_feature: Bit score of 118.6 for HMM based on sequences of FIGURE 24.
  misc_feature: Functional Homolog Of Ceres SEEDLINE ID no. ME12596 at SEQ ID NO. 570
  misc_feature (159)..(159): Xaa is any aa, unknown, or other
MISYADMLKGSHGCQQLQLSSIVRDVNYSCGSCGYELNLNSSNRNTCSLIDSKSIKRGIISFFSVDESRFTQIQQLHWPSWMPFFNSKRQRTKLFCRSCGNHLGYAYTLPSQSQSWDGISDDSRIYDIKLTALLPSFCEEPSQKLEDMGKFETASSSTXVF

SEQ ID NO: 591 - DNA, 761 bp, Zea mays
  misc_feature: Ceres CLONE ID no.340925
  misc_feature: Encodes the peptide sequence at SEQ ID NO. 592
ggccaagccaagcaatcaagcgggggtgtcggtccgccgagcggagggcgagcatggtgagggccctcgaccgctactcctccggcaaagatgtcgcctacagctgtggatactgcggcttcgcgttgaacttgagctcctccacgcggaacacggccaacattgggtccaagtacggcaagcacatcaggaaaggcgtcgtctccttcttcgcgatcgacgagagccgcttcacgcaggccgacgaggtgagctgcacgccgtacttccgctccagccgttcgtggggcttcttcaggaacaggacgcggctgctctgccggaagtgcggtggccacactggttatgcctacgaagacgagggtcccgccctgcgcgacgaggggccagcagatgacctggacatgagctccagctccaggggaagcagcacgtcccctcggaagaagtatgttatcaagatcagtgcgctgcggccgttatcagacgactctggtgctctcctctccccgtgatggcgatctggattctgagctgcagccatgtgtaaattaagggatagtggttctcttcagttacttcgtgagcagaatttttttggtttattgtacgttacaagttacatcatgttcatatttattttgtgtaataaggtgtggttgatgtaatatcttgtttatgattaggtcatggagataatagacatctagctttagcattgatgttcctgtttgctagtcagtaaattaagggatttgatc

SEQ ID NO: 592 - protein, 153 aa, Zea mays
  misc_feature: Ceres CLONE ID no.340925
  misc_feature: Bit score of 257.7 for HMM based on sequences of FIGURE 24.
  misc_feature: Functional Homolog Of Ceres SEEDLINE ID no. ME12596 at SEQ ID NO. 570
MVRALDRYSSGKDVAYSCGYCGFALNLSSSTRNTANIGSKYGKHIRKGVVSFFAIDESRFTQADEVSCTPYFRSSRSWGFFRNRTRLLCRKCGGHTGYAYEDEGPALRDEGPADDLDMSSSSRGSSTSPRKKYVIKISALRPLSDDSGALLSP

SEQ ID NO: 593 - DNA, 1432 bp, Zea mays
  misc_feature: Ceres CLONE ID no.293238
  misc_feature: Encodes the peptide sequence at SEQ ID NO. 594
gtcgcatacacgtctgccgccggccgcgcgtccatcgaacttcgaagccaagattgccaagtcatttcccccaaattcctttccccttcgatcctcccctgcaaaccaagtctcaacgaccatggacgtcttcccctgaccgcgccccactgccccagacgccgtcgcctacatccatgagacttcccgatcttcctgcggccgaggatgtcccagcgcgacgtcgactacagttgcggattctgtggataccctctaaacctttcatcttctaaccgaagcacgtctgaagtaggctcctcatataagaagtctctgaagaagggattgatttcattcatttctgttgatctaagccgatttactcaggtggacaaggtatcttgctttcccctcacctggcgcagttacaggccaaaaactaagcttctctgccgaaaatgcggagcatcgatcggctatggatacggtgagccagctgctttgtgcagttttgatccagcaagttcatcttcctccagtacatcccagaagtatttaataaagatccaagcactccaaccttcagacgggacccagtaagtcagatatggaaagagagacaatagatgccagcttagagaactccatcagttacctatctgacgactgcttgctttctatatttaacaagctagaaagcgagtcagagaggagtgtttttggtttgacctgcaagaattggttcaaggttcggaaccttggtcggaaatcactaacattccattgttcttttaaccctgcaatagacaaggagcatgccaagtgcacaggtagttagtggcagtgggctcaggtacctgaacctgcacaggttaggaagcttaactggtctggatggcctgggtaaccttgcttttgctaaaagcctctgcgttctgaatctcaggatgtatcgctatctcacagatgattctgttacagcaatagccagtgggtgcccactgcttgaggagtggggaaccttgctgttttctatgggtgtccatttacctggctggttgtactgcaataagctaagagtgctgcatgtgaaccgctgccggcacatctgtgaccacagtttgctggccatcggcaatggctgtctggttctgcatgtaaatggttgtgtcaaggtcaccaacaatggcctggctgatgaagtcatgtccattggcccttccattgagaacttgttccggctgcattgaggagaaactgtagttaggttttctaagcctggggctaaaagtttagtagccccgtcccattacggttacggctgattggttcttcggtcattatgtgcattgtgtttgctctagtgtacttgttgtaagataacgagacccaccgtactcatgtgggaaacatgggcactgaatcgtaaatatacaaatgagctgagctc

SEQ ID NO: 594 - protein, 124 aa, Zea mays
  misc_feature: Ceres CLONE ID no.293238
  misc_feature: Bit score of 137.4 for HMM based on sequences of FIGURE 24.
  misc_feature: Functional Homolog Of Ceres SEEDLINE ID no. ME12596 at SEQ ID NO. 570
MSQRDVDYSCGFCGYPLNLSSSNRSTSEVGSSYKKSLKKGLISFISVDLSRFTQVDKVSCFPLTWRSYRPKTKLLCRKCGASIGYGYGEPAALCSFDPASSSSSSTSQKYLIKIQALQPSDGTQ

SEQ ID NO: 595 - DNA, 1157 bp, Zea mays
  misc_feature: Ceres CLONE ID no.483742
  misc_feature: Encodes the peptide sequence at SEQ ID NO. 596
aggatacctgattaaagaattgcttaactagcagcggcgcaaagcctcggccggaggccaatcctccgtgtccggtcgggcgcaacccgaccaaacaacttccttttaagcaaaccgctcgcgttcctgaattcctgacccccgctctctctcccccacccgcactcgccccacgtctcctctctcccgtcccgtctgctctctgatcagcaggagagaaaggtggatgcgccagcgaagcgagcaccgtccctaatcgtcggccatggagaggtctctcgacagctactcctccatcaaggacgtcacctacagctgcgggtactgcgggtacgcgctgaacctgagctcctcggcgcgggacacggagggcatcgggcccaagtaccgcaagcagatcaggaagggcgtcgtcgccttcgtcgcggtcgacgagagccggttcacgctggcccacgagctcacctgcacgccctacttccgctccgcccgctcctggggcctcttcaggaggcggtcgcgcctgctctgccgcaagtgcggggggcacatcggcagcgcctacggctacggggaggaggaggaggacgccagggactccagctcctccagcctcttcggcggtgacggctcctcggatgacacgcgcccgagctccggctcgggccgcagcagcgtcgcgtcgagccagaagagctacgtggtcaggatcagcgcgctgcagccgtcttcggatgactctgctgtcgttcccttcacgcatcgatgatgcattgcaggtgtcgagttggtgtgccgtgttcttcttccagcctggatgaatttgaatttgctgtaacctgggatggcgatggactgcaggaggacgaagtggagcaagggaagatatttcttggcgtgtctagacttttcagaggtttgatcagctgcatgctgctttcagtcatcttgctgtttgtaatgcctctgtgtttcctctgtacattggtaagtatagagcaacatggtttttgaaattttggttggtgtcgtgtaaatgattaaaggttttctgtatttcgattgattctatagcgtttgtattatgtcatagaattgaaattttgattagtcttgtactcttgtctcgcttgcatgtgtggatgttttagcttccc

SEQ ID NO: 596 - protein, 167 aa, Zea mays
  misc_feature: Ceres CLONE ID no.483742
  misc_feature: Bit score of 215.0 for HMM based on sequences of FIGURE 24.
  misc_feature: Functional Homolog Of Ceres SEEDLINE ID no. ME12596 at SEQ ID NO. 570
MERSLDSYSSIKDVTYSCGYCGYALNLSSSARDTEGIGPKYRKQIRKGVVAFVAVDESRFTLAHELTCTPYFRSARSWGLFRRRSRLLCRKCGGHIGSAYGYGEEEEDARDSSSSSLFGGDGSSDDTRPSSGSGRSSVASSQKSYVVRISALQPSSDDSAVVPFTHR

SEQ ID NO: 597 - DNA, 818 bp, Zea mays
  misc_feature: Ceres CLONE ID no.1460255
  misc_feature: Encodes the peptide sequence at SEQ ID NO. 598
atcagctcgccaccagcaagcaaccgctctttttagtccccactcgctccacgatccctcccccactccggccggccacgcgcaaagcgaaacgctccccgactccggccaagagctccagcgccgccgccgccgaccgtcgttcgtccatatggtgaggtccaactccatcgacagctgctactcctccatccaggacgtcacctacagctgcgggtactgcggctacgcgctgaacctgagctcggcggcgcggaacacggccaacatcggctccaagtacggcaagcagatcaggaagaagggcatcgtggccttcgtcgccgtcgacgagacgcgcttcacgcaggccgacgaggtcacctgcgcgccccgcctccgcccctggacctggcgcctcttccggcggaggtcgcgcctgctctgcggcaagtgcggcggccgcatcggcgccgcctacgaggtcgacgaggaggacgaggaccccgccggcctctccgcgtgcggcggctcggacgacgacgacgacgacctgcggacgagcccgggcgatgatgtcggcgcgtccagaaggaggaactacctgatcaggatcggcgcgctgcagccctcgacggacgatcctcctcctgccgatcccttctctctatgatatgatatgatattgatatgacacaccgctgctgaattttgttcctttgttcatagtggaagacgacccgagagcttgatgtgtgtaagttgatcctgctatagtttttgtgtcctggtaatggagtgagccatggttgcaattttgaacaaaaaaaaaaaaaaaa

SEQ ID NO: 598 - protein, 166 aa, Zea mays
  misc_feature: Ceres CLONE ID no.1460255
  misc_feature: Bit score of 195.6 for HMM based on sequences of FIGURE 24.
  misc_feature: Functional Homolog Of Ceres SEEDLINE ID no. ME12596 at SEQ ID NO. 570
MVRSNSIDSCYSSIQDVTYSCGYCGYALNLSSAARNTANIGSKYGKQIRKKGIVAFVAVDETRFTQADEVTCAPRLRPWTWRLFRRRSRLLCGKCGGRIGAAYEVDEEDEDPAGLSACGGSDDDDDDLRTSPGDDVGASRRRNYLIRIGALQPSTDDPPPADPFSL

SEQ ID NO: 599 - DNA, 587 bp, Zea mays
  misc_feature: Ceres CLONE ID no.1400107
  misc_feature: Encodes the peptide sequence at SEQ ID NO. 600
aaaccaaatctcaacgaaacattgccgcctccccctgaccgcgccccactccccagacgccgtcgcctagatccatgagacttcccgatcttcctgcggcccgaggatgtcccagagcgacgtcgactacagttgcggatcttgtggataccctctaaacctttcatcttctaaccgaagcacatctgaagtaggctcatataagaagtctctgaagaaaggactgatttcattcatttctgttgatctcagccgatttactcaggtggacgaagtatcttgctttcccctcacctggcgtggttacaggccaaaaactaagcttctgtgccgaatatgtggggcatctattggctacggatacggtgagccggctgttttgtgtagttttgatccagcaagttcatcttcctccagtacatcccagaagtatttaataaagatccaagcactccaaccttcagacaggactcagtaagtgaaatatggaaagagaggaaataggtgtcagcctagagaactccatcagttacctatctgatgattgcttgctttctatatttaacaagctagaaagcgggtcagag

SEQ ID NO: 600 - protein, 123 aa, Zea mays
  misc_feature: Ceres CLONE ID no.1400107
  misc_feature: Bit score of 126.3 for HMM based on sequences of FIGURE 24.
  misc_feature: Functional Homolog Of Ceres SEEDLINE ID no. ME12596 at SEQ ID NO. 570
MSQSDVDYSCGSCGYPLNLSSSNRSTSEVGSYKKSLKKGLISFISVDLSRFTQVDEVSCFPLTWRGYRPKTKLLCRICGASIGYGYGEPAVLCSFDPASSSSSSTSQKYLIKIQALQPSDRTQ

SEQ ID NO: 601 - protein, 157 aa, Oryza sativa subsp. japonica
  misc_feature: Public GI ID no.115440865
  misc_feature: Bit score of 285.8 for HMM based on sequences of FIGURE 24.
  misc_feature: Functional Homolog Of Ceres SEEDLINE ID no. ME12596 at SEQ ID NO. 570
MVRSLDSYPSIKDVTYSCGYCGYALNLSSSTRNTANIGSKYGKQIKKGVVSFFAVDESRFTQADEVTCVPYFHSRRSWGLFRRRSRLLCRKCGGRIGSAYEEDEPAAAALPACDGPDDLRTTSSGSSGSASSQKNYVIKINALQPSSDDSDAVAFTL

SEQ ID NO: 602 - DNA, 516 bp, Sorghum bicolor
  misc_feature: Ceres ANNOT ID no.6016008
  misc_feature: Encodes the peptide sequence at SEQ ID NO. 603
atggacaggtctctcgacagaaactcctccatcaaggacgtcacttatagctgcgggtactgcggctacgcgctgaacctgagctcctcggcgcgggacacggagggcatcgggtgctccaagtaccgcaagcagatcaagaagggcgtcgtcgccttcgtcgcggtggacgagacccggttcacgctcgccgacgaggtcacctgcatgccctacttccgctccgcccgctcctggggcctcttcaggaggcgggcgcgcctgctctgccgcaagtgcggcggacgcatcggcaacgcctacgaggaggaggacgacgccagggactactccagctccagcctcttcgacggcgacggcgacggctcctcggatgacatgcgccggagctccggcttgggctcgggccgcagcagcatcgtgtcgtcgagccagaagaactacgtgatcaagatcagcgcgctgcagccgtcgtcagatgattctgctgctgttgttcccttcacacatcgatga

SEQ ID NO: 603 - protein, 171 aa, Sorghum bicolor
  misc_feature: Ceres ANNOT ID no.6016008
  misc_feature: Bit score of 216.3 for HMM based on sequences of FIGURE 24.
  misc_feature: Functional Homolog Of Ceres SEEDLINE ID no. ME12596 at SEQ ID NO. 570
MDRSLDRNSSIKDVTYSCGYCGYALNLSSSARDTEGIGCSKYRKQIKKGVVAFVAVDETRFTLADEVTCMPYFRSARSWGLFRRRARLLCRKCGGRIGNAYEEEDDARDYSSSSLFDGDGDGSSDDMRRSSGLGSGRSSIVSSSQKNYVIKISALQPSSDDSAAVVPFTHR

SEQ ID NO: 604 - DNA, 738 bp, Arabidopsis thaliana
  misc_feature: Ceres SEEDLINE ID no.ME12899
  misc_feature: Expected Sequence
  misc_feature: Encodes the peptide sequence at SEQ ID NO. 606
atggattattcttcgatgcatcagaatgtgatgggagtatcttcatgttcaacacaagattatcaaaaccagaagaaaccattgtcggcgactaggccagctccaccagagcaatcattaagatgccctcgctgtgactccaccaacacaaagttctgctactacaacaactacagtctctctcaacctcgctacttctgcaaatcttgtaggagatactggaccaagggtggaatcctaagaaacatcccaatcggtggtgcttaccggaaacacaaacgctcctcctccgcaaccaaaagcctcagaacaacccctgagcccacgatgacccatgacggcaaatcattcccaacggcgagttttggctataataataataacattagcaacgaacagatggagcttgggttagcatatgccttgttgaacaagcaacctctaggggtttcttcacatctagggttcggaagctctcagtctccaatggccatggatggcgtgtatgggaccacgagccatcagatggagaacacggggtatgcgtttggaaatggtggaggcggtatggagcagatggcgacaagtgatccaaacagggttttgtggggattcccctggcagatgaacatgggaggaggaagtggtcatggtcatggtcatgttgatcagattgattcagggagagagatttggagcagtactgtcaactacattaatactggtgctttattgtag

SEQ ID NO: 605 - DNA, 1079 bp, Arabidopsis thaliana
  misc_feature: Ceres SEEDLINE ID no.ME12899
  misc_feature: Inplanta Sequence
  misc_feature: Encodes the peptide sequence at SEQ ID NO. 606
atctcccactctttatctctcctttctttctcctagttctctttatctcatactcctctacatttcaaagaagtttctcaattggttgagatggattattcttcgatgcatcaggtactaatcaacatcacattcttatgattattttgtttgagattaaattggttttagatgttcatttaaatttgtgttttgatagaatgtgatgggagtatcttcatgttcaacacaagattatcaaaaccagaagaaaccattgtcggcgactaggccagctccaccagagcaatcattaagatgccctcgctgtgactccaccaacacaaagttctgctactacaacaactacagtctctctcaacctcgctacttctgcaaatcttgtaggagatactggaccaagggtggaatcctaagaaacatcccaatcggtggtgcttaccggaaacacaaacgctcctcctccgcaaccaaaagcctcagaacaacccctgagcccacgatgacccatgacggcaaatcattcccaacggcgagttttggctataataataataacattagcaacgaacagatggagcttgggttagcatatgccttgttgaacaagcaacctctaggggtttcttcacatctagggttcggaagctctcagtctccaatggccatggatggcgtgtatgggaccacgagccatcagatggagaacacggggtatgcgtttggaaatggtggaggcggtatggagcagatggcgacaagtgatccaaacagggttttgtggggattcccctggcagatgaacatgggaggaggaagtggtcatggtcatggtcatgttgatcagattgattcagggagagagatttggagcagtactgtcaactacattaatactggtgctttattgtagtctatttattttaaaatttgggtttgattagggtttggattgtggtcgtcttggttagagaaagggataatatgagtttggggttaatggtaaaagaaaatagatatgttgtgctttctttaaagattttcagttacttgggaaatgaattgtgtttttttgtttg

SEQ ID NO: 606 - protein, 245 aa, Arabidopsis thaliana
  misc_feature: Ceres SEEDLINE ID no.ME12899
  misc_feature: Bit score of 599.9 for HMM based on sequences of FIGURE 23.
  misc_feature (35)..(97): Pfam Name: zf-Dof Pfam Description: Dof domain, zinc finger
MDYSSMHQNVMGVSSCSTQDYQNQKKPLSATRPAPPEQSLRCPRCDSTNTKFCYYNNYSLSQPRYFCKSCRRYWTKGGILRNIPIGGAYRKHKRSSSATKSLRTTPEPTMTHDGKSFPTASFGYNNNNISNEQMELGLAYALLNKQPLGVSSHLGFGSSQSPMAMDGVYGTTSHQMENTGYAFGNGGGGMEQMATSDPNRVLWGFPWQMNMGGGSGHGHGHVDQIDSGREIWSSTVNYINTGALL

SEQ ID NO: 607 - protein, 289 aa, Medicago truncatula
  misc_feature: Public GI ID no.92873064
  misc_feature: Bit score of 771.1 for HMM based on sequences of FIGURE 23.
  misc_feature (36)..(98): Pfam Name: zf-Dof Pfam Description: Dof domain, zinc finger
  misc_feature: Functional Homolog Of Ceres SEEDLINE ID no. ME12899 at SEQ ID NO. 606
MGMDSSSGQQQQMSNQSLESMLTCSKGEQDKKPKPPQPEALKCPRCDSNNTKFCYYNNYSLSQPRYFCKSCRRYWTKGGTLRNVPVGGGCRKNKRSSSASSKRSQDQPFQTNPNPLTCFPSLSYDSNDLTLALARLQKGHLGFDHEHDFSILGNQTNTSCGILNNHGMNHSSNNQGFFEALMGSQNNVQNLYYMGEVDNGNANGNGNGEMMLPYDHEMSIATTQAVTVTTMKQEMCNVREQNENRVLLGFPWQFNNGDTNMAEMDHLGRAGWNGLTSSWGHGLLNSPLM

SEQ ID NO: 608 - protein, 296 aa, Pisum sativum
  misc_feature: Public GI ID no.37051125
  misc_feature: Bit score of 783.4 for HMM based on sequences of FIGURE 23.
  misc_feature (34)..(96): Pfam Name: zf-Dof Pfam Description: Dof domain, zinc finger
  misc_feature: Functional Homolog Of Ceres SEEDLINE ID no. ME12899 at SEQ ID NO. 606
MDSSSEQQHQQMSNQSLESMLTCSKGEQDKKAKPQPEALKCPRCDSSNTKFCYYNNYSLSQPRYFCKSCRRYWTKGGTLRNVPVGGGCRKNKRSSSSVSRRIQDQAFVNNPNPVTCFPSLSYDSNDLTLALARLQKGQLGFDHEHDFSILGNHANSNININTNTSCAVLNNHGMNHSSNNHGFFEALMGSQNNVQNLYYGYGNRDMGEVDNGNVSGEMMLPYDHEMSIATTQAVTVTTMKQEMCNVREQNESRVLLGFPWQFNNGDSNMDEIDHSGRAGWNGLTSPWHGLLNSPLM

SEQ ID NO: 609 - protein, 285 aa, Glycine max
  misc_feature: Public GI ID no.112363376
  misc_feature: Bit score of 754.3 for HMM based on sequences of FIGURE 23.
  misc_feature (23)..(85): Pfam Name: zf-Dof Pfam Description: Dof domain, zinc finger
  misc_feature: Functional Homolog Of Ceres SEEDLINE ID no. ME12899 at SEQ ID NO. 606
MNPSSGQPQQMSSQSVEKKPKPHPEQALKCPRCDSTNTKFCYYNNYSLSQPRYFCKSCRRYWTKGGTLRNVPVGGGCRKKRSSSLKRAQGQTLTPNLNPLTTLPHLSYDSNDFTLAVARFQKQSSGQLGYNDRDLSTLGNPTTGSFCDILGNSGMNPSSANPSFLDAIRTGFLETQNHLQNLYCMYGNGDLGEVDNGNSGVVGVSGEMMLPYDQVIMSNATTQSVSVMKQEMCSRREQSERRVLGGFPWQINADTNIGELDSGRTIASWNSFTNSWHGFLQSPLM

SEQ ID NO: 610 - DNA, 1103 bp, Gossypium hirsutum
  misc_feature: Ceres CLONE ID no.1938524
  misc_feature: Encodes the peptide sequence at SEQ ID NO. 611
gctttgagttgttaccaaaaacaaaacccatctctctgcttctcttccctcatcttctttgcacttgatctcttcttgttaaaacaaccccccaaagttggagcttccttagctgtgttgcatattttgttttctttttctgctgcatggatggatccttctaccagacaacaccaggagatggctaacccttcaatggaaaacatgtcggttaactcaaaaggacaacaagcgagaaagccaagacctcaacatgaacaagcactcaagtgcccaagatgtgattccatcaacaccaaattttgttattacaacaactacagcctttctcagccaaggtatttttgcaagtcatgcaggaggtactggaccaaaggaggcacattgagaaatgttccggtgggcggtgggtgcaggaagaacaaaagatcatcatcatcatcgtcatcgtcatcatcatcaaagagaagccaagatcaaccgttattaacatccaatactaacccactcattgctggtcacctcccacctttgaattacgacaccaatgacctaagcctggcctttgctcggctccaaaaacaatctggtttccctttagggtttgatgattttggaaccctagccttaacggttgtaccagtagtacttcaccacccaatcctgccattgttgatgcactaagaagcagtttccttggaaaccagaacagcttgcagaatttttactatgggtttggaaatgagaacatgggggaggttgaagatatggggtttaacggggaacttatggtaccatatcataatgaagaaatgagtaacgcaagtacagttacaacaatgaagcaagagctttccattgccgactttgattctggaagaggaacctggaatggcttcaattcgtcttggcatggacttctcaatagccctctaatgtagtaaaaagaaaagaagaagaaaaaagaaaaagaaaaggacttagtcttctgttccttgttcttgtcttttgttaatgtctgaaagcagcatatttcagtagctgttaatctgtttttttgtggtaggagatttgattcatcagaaaaaaaaaaaaaaaaaaaa

SEQ ID NO: 611 - protein, 177 aa, Gossypium hirsutum
  misc_feature: Ceres CLONE ID no.1938524
  misc_feature: Bit score of 154.2 for HMM based on sequences of FIGURE 23.
  misc_feature (34)..(96): Pfam Name: zf-Dof Pfam Description: Dof domain, zinc finger
  misc_feature: Functional Homolog Of Ceres SEEDLINE ID no. ME12899 at SEQ ID NO. 606
MDPSTRQHQEMANPSMENMSVNSKGQQARKPRPQHEQALKCPRCDSINTKFCYYNNYSLSQPRYFCKSCRRYWTKGGTLRNVPVGGGCRKNKRSSSSSSSSSSSKRSQDQPLLTSNTNPLIAGHLPPLNYDTNDLSLAFARLQKQSGFPLGFDDFGTLALTVVPVVLHHPILPLLMH

SEQ ID NO: 612 - DNA, 1122 bp, Populus balsamifera subsp. trichocarpa
  misc_feature: Ceres ANNOT ID no.1473601
  misc_feature: Encodes the peptide sequence at SEQ ID NO. 613
atgtcacttggcattggcacactcgataaaaagactggccatgtgggggcgaatttggcaagggatggggggaggcacgtgagaggcgcatggcagggagaatcgatcctttgcttgtggagagaggcgagtgggtccactcattcgggccctcaagttagagtgctatttcgtttaatgggtcttaattcactccaagtttgcatggattcaagtgattggttgcagggcacgattaacgaggagtctggaatggattcttcttcaccgtctggggatatgctcacttgttcaaggcccttgattgagaggaggcttaggcccccacatgaccaagctctcaagtgtcccaggtgtgactcagcacacaccaaattttgttactacaacaactacagcctctctcagccaaggtacttttgcaagacttgcaggaggtactggaccaaaggaggcaccctaaggaacatccccgtgggtggtggatgtagaaagaacaagaaagtgtcaaagaaatcaaatgatcaatcagttaaccaaattaacactggatcatcttcctcccataatcctactgatctccacctttcgtttcctgatcaggtgcaactttcacaccttcataacatacttggctctcaagaaacacttgcaaaccctaacttcatggagagcaagtataatatcggtatgctagaaaaccctaggcctgtagattttatggatagtaagttcgaagctttagtggggagctctaggaattatgatttcatggggaatggtgacttgggtatggttagtgggctcggagatatgagccatcatcacgggctggcaccaaattatagtggttattgctctccattcgggatgtcccttgatggaaatagtggctctttcatggaaacttgccagaggttaatgcttccttatgaccagggaaatgatcatgatcagaatccaattgatgtgaaaccaaacaccaagctcttgtctcttgattggcaagaccagggttgctctgatgttgggaaggacacatttggatacctaaacaatctgggatcatggacaggcatgatgaatggttatggatcatccacgaccaatactttagtgtaa

SEQ ID NO: 613 - protein, 305 aa, Populus balsamifera subsp. trichocarpa
  misc_feature: Ceres ANNOT ID no.1473601
  misc_feature: Bit score of 120.1 for HMM based on sequences of FIGURE 23.
  misc_feature (41)..(103): Pfam Name: zf-Dof Pfam Description: Dof domain, zinc finger
  misc_feature: Functional Homolog Of Ceres SEEDLINE ID no. ME12899 at SEQ ID NO. 606
MDSSDWLQGTINEESGMDSSSPSGDMLTCSRPLIERRLRPPHDQALKCPRCDSAHTKFCYYNNYSLSQPRYFCKTCRRYWTKGGTLRNIPVGGGCRKNKKVSKKSNDQSVNQINTGSSSSHNPTDLHLSFPDQVQLSHLHNILGSQETLANPNFMESKYNIGMLENPRPVDFMDSKFEALVGSSRNYDFMGNGDLGMVSGLGDMSHHHGLAPNYSGYCSPFGMSLDGNSGSFMETCQRLMLPYDQGNDHDQNPIDVKPNTKLLSLDWQDQGCSDVGKDTFGYLNNLGSWTGMMNGYGSSTTNTLV

SEQ ID NO: 614 - DNA, 963 bp, Populus balsamifera subsp. trichocarpa
  misc_feature: Ceres ANNOT ID no.1468397
  misc_feature: Encodes the peptide sequence at SEQ ID NO. 615
atgggcacattattgatacctcgaagcatgaaaagacaagataatttcttcttccctcttgtccgttgcactattggcacgattaacgatgagtctggaatggattcttcttcaccatctggggatatgctcacttgttcaaggcccttgatagagaggaggcttaggcccccacatgaccaagctctcaaatgccctaggtgtgactcaacacacaccaaattttgttactacaacaactacagcctctcccagccaaggtacttttgcaagacttgcaggaggtactggaccaaaggaggcaccctgaggaacatccctgtgggtggtggatgtagaaagaacaagaaagtgtctaagaaatcaaatgatcaatcagttaaccaaattaaccctggatcatcatcctcccacaatcctactgatcttcacctttcatttcctgaggtgcaactttcacacttaaatagcatacttggttcacaaggaacaattgcaacctctaacttcatggatagcaagtacaatatcggtatgctagaaaacccaaggcctatagattttatggatagtaagttagaagctttagtgggaagctctaggaattatgatttcatggggaatggtgacttgggtatggttagtgggctcggagatacgagtcatcatcatgggttagcaccaaattttagtgatatttgctcttcatttgggatgtcccttgatggaaacagtggcactttcatggaaacttgccaaaggttaatgcttccttatggccaaggaaataatgatcagaatgcaattgatgtgaagccaaacaccaagctcttgtcccttgactggcaagaccagggttgctctgatggtgggaaggacacatttggatacctaaacaatttaggatcatggacaggcatgatgaatggttatggatcatccacgaccaatactttagtgtaa

SEQ ID NO: 615 - protein, 287 aa, Populus balsamifera subsp. trichocarpa
  misc_feature: Ceres ANNOT ID no.1468397
  misc_feature: Bit score of 137.9 for HMM based on sequences of FIGURE 23.
  misc_feature (25)..(87): Pfam Name: zf-Dof Pfam Description: Dof domain, zinc finger
  misc_feature: Functional Homolog Of Ceres SEEDLINE ID no. ME12899 at SEQ ID NO. 606
MDSSSPSGDMLTCSRPLIERRLRPPHDQALKCPRCDSTHTKFCYYNNYSLSQPRYFCKTCRRYWTKGGTLRNIPVGGGCRKNKKVSKKSNDQSVNQINPGSSSSHNPTDLHLSFPEVQLSHLNSILGSQGTIATSNFMDSKYNIGMLENPRPIDFMDSKLEALVGSSRNYDFMGNGDLGMVSGLGDTSHHHGLAPNFSDICSSFGMSLDGNSGTFMETCQRLMLPYGQGNNDQNAIDVKPNTKLLSLDWQDQGCSDGGKDTFGYLNNLGSWTGMMNGYGSSTTNTLV

SEQ ID NO: 616 - protein, 239 aa, Arabidopsis thaliana
  misc_feature: Public GI ID no.21554185
  misc_feature: Bit score of 285.2 for HMM based on sequences of FIGURE 23.
  misc_feature (32)..(94): Pfam Name: zf-Dof Pfam Description: Dof domain, zinc finger
  misc_feature: Functional Homolog Of Ceres SEEDLINE ID no. ME12899 at SEQ ID NO. 606
MGLSYSSNPTQLDNDQKKPSPATAAAATRPQPPELALRCPRCDSTNTKFCYYNNYSLTQPRYFCKSCRRYWTKGGTLRNIPVGGGCRKNKRSTSSAARSLRTTPEPASHDGKVFSAAGFNGYSNNEHIDLSLAFALLNKQHPGSSSQLGFHSELGSSHQSDMEGMFGTSQQKENATYAFGNGSSGLGDPSRVLWGFPWQMNGESFGMMNIGGGGGHVDQIDSGREMWTNMNYINSGALM

SEQ ID NO: 617 - protein, 257 aa, Arabidopsis thaliana
  misc_feature: Public GI ID no.18424330
  misc_feature: Bit score of 288.0 for HMM based on sequences of FIGURE 23.
  misc_feature (50)..(112): Pfam Name: zf-Dof Pfam Description: Dof domain, zinc finger
  misc_feature: Functional Homolog Of Ceres SEEDLINE ID no. ME12899 at SEQ ID NO. 606
MDHLLQHQDVFGNYNKAREAMGLSYSSNPTPLDNDQKKPSPATAVTRPQPPELALRCPRCDSTNTKFCYYNNYSLTQPRYFCKSCRRYWTKGGTLRNIPVGGGCRKNKRSTSSAARSLRTTPEPASHDGKVFSAAGFNGYSNNEHIDLSLAFALLNKQHPGSSSQLGFHSELGSSHQSDMEGMFGTSQQKENATYAFGNGSSGLGDPSRVLWGFPWQMNGESFGMMNIGGGGGHVDQIDSGREMWTNMNYINSGALM

SEQ ID NO: 618 - protein, 237 aa, Arabidopsis thaliana
  misc_feature: Public GI ID no.8885571
  misc_feature: Bit score of 282.5 for HMM based on sequences of FIGURE 23.
  misc_feature (30)..(92): Pfam Name: zf-Dof Pfam Description: Dof domain, zinc finger
  misc_feature: Functional Homolog Of Ceres SEEDLINE ID no. ME12899 at SEQ ID NO. 606
MGLSYSSNPTPLDNDQKKPSPATAVTRPQPPELALRCPRCDSTNTKFCYYNNYSLTQPRYFCKSCRRYWTKGGTLRNIPVGGGCRKNKRSTSSAARSLRTTPEPASHDGKVFSAAGFNGYSNNEHIDLSLAFALLNKQHPGSSSQLGFHSELGSSHQSDMEGMFGTSQQKENATYAFGNGSSGLGDPSRVLWGFPWQMNGESFGMMNIGGGGGHVDQIDSGREMWTNMNYINSGALM

SEQ ID NO: 619 - DNA, 1130 bp, Arabidopsis thaliana
  misc_feature: Ceres CLONE ID no.20852
  misc_feature: Encodes the peptide sequence at SEQ ID NO. 620
aaactcatatccatcattctctctgatctcaagaaataatctcaaatctcttacactcatagtcttcaagcagcttcttagattcagctcttatggatcatttgttacaacaccaggatgtttttgggaattataacaaagccagagaagcaatgggactatcatattcatcaaacccaacacagttagataacgaccagaagaaaccttctcctgcaactgcagcggctgcgacaaggccacagcctccggagctagctctgaggtgtccacgttgcgactcaacaaacacaaagttttgttactacaacaactacagtctcactcagcctcgctacttctgcaaatcatgccggagatattggactaaaggtggaactctaaggaacatccccgtgggtggaggctgccggaaaaacaaacgatccacatcttcggctgcaagaagcctcagaaccactccagaaccggcgtcccacgacgggaaagtcttctcggcggcaggttttaatgggtatagtaacaatgaacatattgatctgagcttagcctttgccttgctgaacaaacaacatccggggagttcttcacagctagggtttcattcagaactcggtagctctcatcagtctgacatggaaggtatgtttgggacaagccaacaaaaagagaacgctacttatgcgtttggtaacgggagcagcggtttgggtgatccaagcagagtcttatggggatttccatggcagatgaatggagagagctttggaatgatgaacatagcgaggaggtggtggtcatgtagatcagattgattcagggagagagatgtggaccaatatgaactacattaattctggtgctttaatgtagttcaaaattaaaaccccaatattatttgggttttgatttagggtttgaatttcatgttttttaatgggagtagaaaagggtggtagctattttatgaaatggttaaggaagtatagatatattagggcttcttcaaagagtttcaaacttgcaaaatggggttggggtagttcttgttttcgatttctgatctaaattgttgagtttctttatttgtatgttcactatgtttaaatgaaacatttcctttgttgttc

SEQ ID NO: 620 - protein, 240 aa, Arabidopsis thaliana
  misc_feature: Ceres CLONE ID no.20852
  misc_feature: Bit score of 236.4 for HMM based on sequences of FIGURE 23.
  misc_feature (52)..(114): Pfam Name: zf-Dof Pfam Description: Dof domain, zinc finger
  misc_feature: Functional Homolog Of Ceres SEEDLINE ID no. ME12899 at SEQ ID NO. 606
MDHLLQHQDVFGNYNKAREAMGLSYSSNPTQLDNDQKKPSPATAAAATRPQPPELALRCPRCDSTNTKFCYYNNYSLTQPRYFCKSCRRYWTKGGTLRNIPVGGGCRKNKRSTSSAARSLRTTPEPASHDGKVFSAAGFNGYSNNEHIDLSLAFALLNKQHPGSSSQLGFHSELGSSHQSDMEGMFGTSQQKENATYAFGNGSSGLGDPSRVLWGFPWQMNGESFGMMNIARRWWSCRSD

SEQ ID NO: 621 - protein, 288 aa, Arabidopsis thaliana
  misc_feature: Public GI ID no.21553763
  misc_feature: Bit score of 209.7 for HMM based on sequences of FIGURE 23.
  misc_feature (43)..(105): Pfam Name: zf-Dof Pfam Description: Dof domain, zinc finger
  misc_feature: Functional Homolog Of Ceres SEEDLINE ID no. ME12899 at SEQ ID NO. 606
MDPEQEISNETLETILVSSTKGSNNNNKKMEEEMKKKVSRGELGGEAQNCPRCESPNTKFCYYNNYSLSQPRYFCKSCRRYWTKGGTLRNVPVGGGCRRNKRSSSSAFSKNNNNKSINFHTDPLQNPLITGMPPSSFGYDHSIDLNLAFATLQKHHLSSQATTPSFGFGGDLSIYGNSTNDVGIFGGQNGTYNNSLCYGFVSGNGNNNQNEIKMASTLGMSLEGNERKQENVNNNNNNSENPSKVFWGFPWQMTGDSAGVVPEIDPGRESWNGMVSSWNNGLLNTPLV

SEQ ID NO: 622 - protein, 288 aa, Arabidopsis thaliana
  misc_feature: Public GI ID no.18401763
  misc_feature: Bit score of 211.8 for HMM based on sequences of FIGURE 23.
  misc_feature (43)..(105): Pfam Name: zf-Dof Pfam Description: Dof domain, zinc finger
  misc_feature: Functional Homolog Of Ceres SEEDLINE ID no. ME12899 at SEQ ID NO. 606
MDPEQEISNETLETILVSSTKGSNNNNKKMEEEMKKKVSRGELGGEAQNCPRCESPNTKFCYYNNYSLSQPRYFCKSCRRYWTKGGTLRNVPVGGGCRRNKRSSSSAFSKNNNNKSINFHTDPLQNPLITGMPPSSFGYDHSIDLNLAFATLQKHHLSSQATTPSFGFGGDLSIYGNSTNDVGIFGGQNGTYNNSLCYGFMSGNGNNNQNEIKMASTLGMSLEGNERKQENVNNNNNNSENPSKVFWGFPWQMTGDSAGVVPEIDPGRESWNGMVSSWNNGLLNTPLV

SEQ ID NO: 623 - DNA, 1211 bp, Arabidopsis thaliana
  misc_feature: Ceres CLONE ID no.16423
  misc_feature: Encodes the peptide sequence at SEQ ID NO. 624
attcatatttgctcacctcaaactctctctttctctctctctctggttccctagaatttgagcaaaatttctaccataattgctaattattaaaaggaaacataagtaatcgttgcttcgatcctttgttacatggatggatcctgaacaggaaatctcaaacgagactttggaaactatattggtaagttcaacaaaaggaagcaataataacaaataagaaaatggaagaagaaatgaagaagaaagtatcaagaggagaattaggaggtgaagctcaaaattgtccaagatgtgaatctccaaacacaaagttttgttactacaacaactatagtctctcacaacctcgttacttctgcaaatcttgtcggagatattggactaaaggcggtactcttcgtaacgttcccgtcggtggtggttgccgtcgaaacaaacgatcctcttcctcagctttctccaagaacaacaacaataagtctattaatttccatactgatccacttcagaaccctttaattacgggaatgccaccatcatcttttggttatgatcactccattgatctcaacctcgctttcgctactctccaaaagcatcatttatcctctcaagctactactccttcttttgggtttggaggtgatctttctatttatggaaactcaacgaatgatgtagggatcttyggagggcaaaacggtacttataacaatagtttgtgttatgggtttgtgtccggaaatggtaataataatcaaaatgaaatcaagatggcttctacattggggatgtctttggaaggaaacgagagaaagcaagagaatgtgaacaataacaataataactcagagaatcctagcaaggtgttctgggggtttccatggcagatgaccggagattccgccggagttgtaccggagattgatcccggaagggaaagctggaatgggatggtttcatcttggaataatggtttactcaacactcctttggtctagcagatcattaataaataaatatataatatattactatatattaaagtttatgtcatcacatgtttgtacaccactttcactaatatgggggatgtttggtttttataatttctagggtttctatctttttttagtttcccaatttttcttgttgagacgaagacttataagagttcttctatgaaaactatagaaaaaagtttctcc

SEQ ID NO: 624 - protein, 259 aa, Arabidopsis thaliana
  misc_feature: Ceres CLONE ID no.16423
  misc_feature: Bit score of 194.6 for HMM based on sequences of FIGURE 23.
  misc_feature (14)..(76): Pfam Name: zf-Dof Pfam Description: Dof domain, zinc finger
  misc_feature: Functional Homolog Of Ceres SEEDLINE ID no. ME12899 at SEQ ID NO. 606
  misc_feature (156)..(156): Xaa is any aa, unknown, or other
MEEEMKKKVSRGELGGEAQNCPRCESPNTKFCYYNNYSLSQPRYFCKSCRRYWTKGGTLRNVPVGGGCRRNKRSSSSAFSKNNNNKSINFHTDPLQNPLITGMPPSSFGYDHSIDLNLAFATLQKHHLSSQATTPSFGFGGDLSIYGNSTNDVGIXGGQNGTYNNSLCYGFVSGNGNNNQNEIKMASTLGMSLEGNERKQENVNNNNNNSENPSKVFWGFPWQMTGDSAGVVPEIDPGRESWNGMVSSWNNGLLNTPLV

SEQ ID NO: 625 - protein, 183 aa, Glycine max
  misc_feature: Public GI ID no.112363380
  misc_feature: Bit score of 248.2 for HMM based on sequences of FIGURE 23.
  misc_feature (34)..(96): Pfam Name: zf-Dof Pfam Description: Dof domain, zinc finger
  misc_feature: Functional Homolog Of Ceres SEEDLINE ID no. ME12899 at SEQ ID NO. 606
MDPSSGQHQQMSSQSLENMLACSKAHQERKPTPQPEQALKCPRCDSTNTKFCYYNNYSLSQPRYFCKSCRRYWTKGGTLRNVPVGGGCRKNKRSSSKRVQDQAFTPNVNPLTGLPSLMSYDSNDLTLALARLQKQSCGQLGYDDHDLSMLGNHHTSTPCGDNILGMHHHSSSSSTNPGFLDAL

SEQ ID NO: 626 - protein, 283 aa, Pisum sativum
  misc_feature: Public GI ID no.6092016
  misc_feature: Bit score of 416.1 for HMM based on sequences of FIGURE 23.
  misc_feature (32)..(94): Pfam Name: zf-Dof Pfam Description: Dof domain, zinc finger
  misc_feature: Functional Homolog Of Ceres SEEDLINE ID no. ME12899 at SEQ ID NO. 606
MDPSSQQMSRQSSMENMLVCSKEQQESKPKPQPEQALKCPRCDSTNTKFCYYNNYSLTQPRYFCKSCRRYWTKGGTLRNVPVGGGCRKNKRSSSSKRIQDQAFAPNHNPFSNLPHFDQSNDFALRLARLQKQSCGGQMGYDENELSMLGNSGSSMNQSMSINHGFMDAIRSGLFLGNGMHYNNSVQNMYGGGYGNGDNGEVNSGNNNCGVSEEMMFNYDQEMSHCNAAINMKQEQSESRVFGGFPWQINGGIGNMGEVEQARASWNNGFTTPSWQGLLHSPLM

SEQ ID NO: 627 - DNA, 1700 bp, Triticum aestivum
  misc_feature: Ceres CLONE ID no.770468
  misc_feature: Encodes the peptide sequence at SEQ ID NO. 628
catccggttggggctttggccatggctccgctgcttttcgctcccttcttattcacatctcccccctccacgtctctcaccaactaccagtagcaccgcagcccaccagcttcgctgcctcatatctcctcttccttctccatagcctctcttctcctgtccagtatctctgcgtcgatccaccccgccctcctcttcatcttcatgttcttcctagctaatcggtgaatccgcctcctcttagctaaccaatcgcccttaaacccgtcgacaaaataacgaaacgagaacaagcaggccgcgtgcgtgtgcagtaggtgtagaccatcgatcgtatctaggtttgagttgctgctggatcttggatttgccggagttacgtgcgtagctagccgctggcggtgaggttaccgcatctttggggtgccttgactggttgatcgatcgggaagcccgggcgatcgatgatggcaggcgcagctcatccgatgcatttctgcatggactccgactggctcaagggcatcgtccccgaggaccagggagggatggggtcgtcgtcgccgtcgggggagctgatcatcgcgtgcccggagccgatgcaggcccagcaggcggcggaccggcggctgcgcccgcagcacgaccagccgctcaagtgcccgcgctgcgactccacgcacaccaagttctgctactacaacaactacagcctctcccagccccgctacttctgcaagacgtgccgccgctactggaccaagggcggctccctccgcaacgtccccgtcggcggcggctgccgcaagaacaagcgcgccagcgccgccaagaagccctcggctgccgccgccatcgcgccgccgatttcgatgatgcagcagcttcatcacggccggcacatggcggagaccggcctccacctgtccttctctgggatgcagccgccggcggtctctgccgccgacccgctctgcagcctcgggctcttcgactggaagtacgaccacatcctctcgggttccggcggctttgagagcgcgaactctgaggctcacttcaccgggccaggcatgatgggcattgccaacggaagcggcggaggcggcgcagagtaccacgcactgaacgcgctccggtacgcagccggccttggagagcacctcgcgcttccgtttggtggcgcgacgtcgcgggctgagcgtgacagtgtcgtcgccgagatgaagccgcaggcggagaggctgctgtcgctggagtggtgcggcgaggcgagccgcgcgccgacggagacctccatcagctccctgggcgggctcggcctgtggagtgccatgatcaccggcgccgcccaccatcaccatggctcctctgccgccatctgaacgaggcgaagcatcgtgtcaacgcccccatgcacgcatgcatgcgttagtggtttgctaatacgcattgacgagtgcgaggactacgtagaagtgattgcctttttcttgcttgctccctgtgtggtttcatgcatgatctgctgctgtttcttttcctttgcttttgttcacatcgtttgtttggatcgatgtttgcaccccttatgtttcaagtgttgtactggacaatgttccgtgttgcacagcttcacacgttgctgtggctcgatcaattaagtttgtgacttgttgctgtcaaaaaaaaaaaaaaaa

SEQ ID NO: 628 - protein, 294 aa, Triticum aestivum
  misc_feature: Ceres CLONE ID no.770468
  misc_feature: Bit score of 127.7 for HMM based on sequences of FIGURE 23.
  misc_feature (47)..(109): Pfam Name: zf-Dof Pfam Description: Dof domain, zinc finger
  misc_feature: Functional Homolog Of Ceres SEEDLINE ID no. ME12899 at SEQ ID NO. 606
MDSDWLKGIVPEDQGGMGSSSPSGELIIACPEPMQAQQAADRRLRPQHDQPLKCPRCDSTHTKFCYYNNYSLSQPRYFCKTCRRYWTKGGSLRNVPVGGGCRKNKRASAAKKPSAAAAIAPPISMMQQLHHGRHMAETGLHLSFSGMQPPAVSAADPLCSLGLFDWKYDHILSGSGGFESANSEAHFTGPGMMGIANGSGGGGAEYHALNALRYAAGLGEHLALPFGGATSRAERDSVVAEMKPQAERLLSLEWCGEASRAPTETSISSLGGLGLWSAMITGAAHHHHGSSAAI

SEQ ID NO: 629 - protein, 299 aa, Solanum demissum
  misc_feature: Public GI ID no.113205234
  misc_feature: Bit score of 316.7 for HMM based on sequences of FIGURE 23.
  misc_feature (32)..(94): Pfam Name: zf-Dof Pfam Description: Dof domain, zinc finger
  misc_feature: Functional Homolog Of Ceres SEEDLINE ID no. ME12899 at SEQ ID NO. 606
MDQQQQEMSSQTLESMLVCTKPDQDQKKPRPAEQQPQKCPRCDSANTKFCYYNNYSLTQPRYFCKSCRRYWTKGGTLRNVPVGGGCRKNKKLSSTTSAKRSSQDNISPNISNPIPSYDSSTDLSLAFARLQKQTNAHLEIDQEHDNNNMSMMYNTGNNCTSTTFLDALRGGFLENAPNHPGLFHHNMYNYANMGQLVENGEMGMSYDQDQMSIGTSTTMMTTIVKQEMCNMARSTEGHDLNNSNNNNKVLCGFPWQQMNGDHHVNNMNTNDFEYSTNKQSWNGFGGSSNWHGLINSPLM

SEQ ID NO: 630 - DNA, 1158 bp, Sorghum bicolor
  misc_feature: Ceres ANNOT ID no.6094775
  misc_feature: Encodes the peptide sequence at SEQ ID NO. 631
atggcgtcggcgacgacagcggcgacgggggacgacgctgtcgggacacggaagggcggcaccggcggtgcaactgccggcgggggcacggcgccgcagacgcagcagcagacgcccccgccgcccgagcaggggctgcggtgcccgcgctgcgactcccccaacaccaagttctgctactacaacaactacagcctgtcgcagccgcgccagttctgcaagacgtgccgcaggtactggaccaagggcggcgcgctccgcaacgtgcccgtcggcgggggatgccgcaagaacaagcgctcgcgctccgcggccgccgtggccgtggccgcgccggcagcggcctcgcgcctctcgctcaacctgccgccggcggaggccgccgccgccgaccagcagcagccggcggcgaggctcggcttccttggcgccgcccatcatcatccggccgtggcgtcgtcgccgattggcggcgcaggcgcccccgcggccgactaccaccaccagcaggcgggcatgatggccctgcagccgcggctccacggccccggcgccgtcgtcggccagtacgtgccgttcggggactggccgtcgtcgggggacgtttcttctggcggaggctgccacgcggtgaacggtggcgcggccgcggcggtgagcatgagcagcagcatcgcgtcgtccatcgagtcgctgagcttcatcaaccaggatctgcactggaagctgcagcagcagcggctggccaccatgttcctaggcacgccgacgacgagctccggcgccgccgcgggggcccatgtcgacggcgccgccgcggcggcaggagcagcagcaccgcatgtagtgggcggcaccttcctgcacatggcggcgggaccaccgccaccgcacggcatggtggaggcgaccaccatggcgccgccggcggcgacgtcgtggttcatggacagctcctgctacgtgctcccttccccgacgaccgcgcatcacgctaacaccgccgcggcggccgtcgtagccaccagcaactgcaacgtcgtcaacagcagcggcggcggcgacgacgacaacgcgacgtcgaacaacaacaactgcgggccggggagcgcaatcccgtcgtggggcgacatgtcgacgttcgcgatgctgccttga

SEQ ID NO: 631 - protein, 385 aa, Sorghum bicolor
  misc_feature: Ceres ANNOT ID no.6094775
  misc_feature: Bit score of 82.6 for HMM based on sequences of FIGURE 23.
  misc_feature (41)..(103): Pfam Name: zf-Dof Pfam Description: Dof domain, zinc finger
  misc_feature: Functional Homolog Of Ceres SEEDLINE ID no. ME12899 at SEQ ID NO. 606
MASATTAATGDDAVGTRKGGTGGATAGGGTAPQTQQQTPPPPEQGLRCPRCDSPNTKFCYYNNYSLSQPRQFCKTCRRYWTKGGALRNVPVGGGCRKNKRSRSAAAVAVAAPAAASRLSLNLPPAEAAAADQQQPAARLGFLGAAHHHPAVASSPIGGAGAPAADYHHQQAGMMALQPRLHGPGAVVGQYVPFGDWPSSGDVSSGGGCHAVNGGAAAAVSMSSSIASSIESLSFINQDLHWKLQQQRLATMFLGTPTTSSGAAAGAHVDGAAAAAGAAAPHVVGGTFLHMAAGPPPPHGMVEATTMAPPAATSWFMDSSCYVLPSPTTAHHANTAAAAVVATSNCNVVNSSGGGDDDNATSNNNNCGPGSAIPSWGDMSTFAMLP

SEQ ID NO: 632 - DNA, 261 bp, Arabidopsis thaliana
  misc_feature: Ceres SEEDLINE ID no.ME13456
  misc_feature: Genomic Sequence
  misc_feature: Expected Sequence
  misc_feature: Encodes the peptide sequence at SEQ ID NO. 634
atggaggagtcgaagaaatacaaaagtatggtgaagcagacgatgaataagaagaagaaaaacaacaacaagaagggtcacggatctggatcacgatccgggttactccaaatgaaggtgaggaggctccaaatactgataccgggcgggcagacatgcaaccacccggatctgcttttatcaaagaccgttgattatattgtgcatttgaagttgaagcttaggttccttaaagcaatctccgaaatgtactctctttga

SEQ ID NO: 633 - DNA, 261 bp, Arabidopsis thaliana; identical to SEQ ID NO: 632
  misc_feature: Ceres SEEDLINE ID no.ME13456
  misc_feature: Predicted Sequence
  misc_feature: Encodes the peptide sequence at SEQ ID NO. 634

SEQ ID NO: 634 - protein, 86 aa, Arabidopsis thaliana
  misc_feature: Ceres SEEDLINE ID no.ME13456
  misc_feature: Bit score of 221.7 for HMM based on sequences of FIGURE 7.
MEESKKYKSMVKQTMNKKKKNNNKKGHGSGSRSGLLQMKVRRLQILIPGGQTCNHPDLLLSKTVDYIVHLKLKLRFLKAISEMYSL

SEQ ID NO: 635 - DNA, 624 bp, Gossypium hirsutum
  misc_feature: Ceres CLONE ID no.1916112
  misc_feature: Encodes the peptide sequence at SEQ ID NO. 636
aacccaaaaacacaaggcggttccttttgttatctctctttttaattttttttccaatttcatttcttcttgttttgcagttagaaagcttaagaaatttagtcacatttgttaatttctttcatttttttatgaaacgtatggagttaaggaggtgcaaagagttttctagggcgaaatggaggaggaggaggagaagatggacaggtgacagcggtgaccgtggcagtagatcagttcgaacaaaggtgaagaagttgcaaaggctaattccgggtgcaaaagggttgaagccggactggctgtttctaaggacagctgattatatattgcagttgagattacaagttaatatattgcaagctctttccaagatttatggaccctcacattaatgtttatgatattttatgtatattttgatacaaaacttacatggcataagatgccatataaaaaatgcatgctctttccttgataatgataaatatatgctatgttttttttttaatttagaatatattggtgggtttaatttcctttgcaattcatgttgtactacatgctatgaatgccgaagcacgtcgccccatgatctactggaaaaaaaaaaaaaaaaaaaaa

SEQ ID NO: 636 - protein, 87 aa, Gossypium hirsutum
  misc_feature: Ceres CLONE ID no.1916112
  misc_feature: Bit score of 20.7 for HMM based on sequences of FIGURE 7.
  misc_feature: Functional Homolog Of Ceres SEEDLINE ID no. ME13456 at SEQ ID NO. 634
MKRMELRRCKEFSRAKWRRRRRRWTGDSGDRGSRSVRTKVKKLQRLIPGAKGLKPDWLFLRTADYILQLRLQVNILQALSKIYGPSH

SEQ ID NO: 637 - protein, 117 aa, Arabidopsis thaliana
  misc_feature: Public GI ID no.98961985
  misc_feature: Bit score of 342.1 for HMM based on sequences of FIGURE 7.
  misc_feature: Functional Homolog Of Ceres SEEDLINE ID no. ME13456 at SEQ ID NO. 634
MHVKLSLWLKHFVVTILIYKYRPPSRPLHHNSVFISKKAMEESRSNREQRKQTKKKTGRGSGSGSIQIKMRKLRVLIPGGRRLNQPDLLLTKTADYIMHLELRIRFLKAISDIYSLS

SEQ ID NO: 638 - protein, 406 aa, Arabidopsis thaliana
  misc_feature: Public GI ID no.9369405
  misc_feature: Bit score of 152.3 for HMM based on sequences of FIGURE 7.
  misc_feature: Functional Homolog Of Ceres SEEDLINE ID no. ME13456 at SEQ ID NO. 634
MKNKTQKYIDKKTWNYINMDHHHAFASHSYNSVFISKKAMEESRSYRKERKQTKKKTGRGSGSRSIHIKMRKLRVLIPGGRRLNQPDLLLSKTADYIMHLELRISILHLLVRYYLKKKRSNLSSSPNESNQNPEFSDSDTYQRQLQQLFHLHDSGLDQALIDALPVFLYKEIKGTKEPFDCAVCLCEFSEDDKLRLLPNCSHAFHIDCIDTWLLSNSTCPLCRGTLFSLGHQFEYPDFNFGFFAGDDGGGGVRVSPVQKPAENEIGKRVFSVRLGKFRSSNIVNNGEVVVGGGGETSSSSLDNRRCFSMGSYQYIVAESDLVVALCPNNEGLKNNKDVEGKKINMRSKGESFSVSKIWQWSNKRSKFPNNHPSETNLVVGGSSSSSSYVCSGSDGLSLNGRRFQGP

SEQ ID NO: 639 - protein, 410 aa, Arabidopsis thaliana
  misc_feature: Public GI ID no.9369406
  misc_feature: Bit score of 71.6 for HMM based on sequences of FIGURE 7.
  misc_feature: Functional Homolog Of Ceres SEEDLINE ID no. ME13456 at SEQ ID NO. 634
MINTQVLVLKRQWLIGTTREGRSGSIQIKMRKLRVLIPGGRRLNQPDLLLTKTADYIMHLELRIRSSLLRTRSFEINSKIFNSIKLKEKKSNQRIKKIETYFVWVCFVNQIRSKWRQMIFLACRENIGDKWRNPIVQIPPSMYGRINGLIPHNCEINTPLPYRVLGKHYAKLGLHRYNMLKGTKFEFGRLMKFNMLQNCVASFYITLEAYDYGVPGTSHPQTFQVRIDEKIFGSLDLTVSIARRTTDEVTTKKPFIHHYHGGAVADNIIFKGELPDWPSDDVLKDRERFYVIMNESEWRATAWISLYLELVLCAHDKFITNTDLSRLSIEKVAIETSIGDALLYERLEAKSANVYIWFKRLEKPRVPQQVFVTGMDVERKAIIRRVMDSTGYLTLVGKLCGGVTKVRQFN

SEQ ID NO: 640 - DNA, 623 bp, Glycine max
  misc_feature: Ceres CLONE ID no.1238706
  misc_feature: Encodes the peptide sequence at SEQ ID NO. 641
atcacaaccctttgaagtgttgtcattactcattacacaaagaggcaatggaggagtcaaagaaatacgagaggatggtgaagcagacaatggacaagaacaagaagaagaataacaaaaggggtcatggctctgggtcaggatccgggttgcttggggtgaaggtgaggaagctccaaatactgataccgggtggaaagagatgcaaccacccggatctgcttttatctaaaaccgtggattatattgtccacttgaagttgaagattaggttccttaaagcactctcagatatgtactctctctgaaaatcctagcactattcttctgcttcttcctctcttcgttgtcatataagctatggtaaggattttatttctatgtatatcaattgtcatttggagtttgctttatgtcgtattttcatttgttaaattggttatctatattcatgtttatccgacaatgtgtaagaaattgagtagtttgaaattctaaaatatgctttttgaacttcttggttttcccattgcaaggccttcgtatactgatggctaatatttgatgttataaattcatattatcttatatttgaagagttaagtttaaaaaaaaaaaaaaaa

SEQ ID NO: 641 - protein, 86 aa, Glycine max
  misc_feature: Ceres CLONE ID no.1238706
  misc_feature: Bit score of 189.3 for HMM based on sequences of FIGURE 7.
  misc_feature: Functional Homolog Of Ceres SEEDLINE ID no. ME13456 at SEQ ID NO. 634
MEESKKYERMVKQTMDKNKKKNNKRGHGSGSGSGLLGVKVRKLQILIPGGKRCNHPDLLLSKTVDYIVHLKLKIRFLKALSDMYSL

SEQ ID NO: 642 - DNA, 651 bp, Arabidopsis thaliana
  misc_feature: Ceres SEEDLINE ID no.ME15935
  misc_feature: Genomic Sequence
  misc_feature: Expected Sequence
  misc_feature: Encodes the peptide sequence at SEQ ID NO. 644
atgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaa

SEQ ID NO: 643 - DNA, 651 bp, Arabidopsis thaliana
  misc_feature: Ceres SEEDLINE ID no.ME15935
  misc_feature: Inplanta Sequence
  misc_feature: Encodes the peptide sequence at SEQ ID NO. 644
atgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaagctccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaa

SEQ ID NO: 644 - protein, 216 aa, Arabidopsis thaliana
  misc_feature: Ceres SEEDLINE ID no.ME15935
  misc_feature: Bit score of 448.0 for HMM based on sequences of FIGURE 8.
  misc_feature (49)..(100): Pfam Name: AP2 Pfam Description: AP2 domain
MNSFSAFSEMFGSDYESSVSSGGDYIPTLASSCPKKPAGRKKFRETRHPIYRGVRRRSSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 645 - protein, 216 aa, Arabidopsis thaliana
  misc_feature: Ceres SEEDLINE ID no.ME15935
  misc_feature: Ceres LOCUS ID no.At4g25480
  misc_feature: Expected Sequence
  misc_feature (49)..(100): Pfam Name: AP2 Pfam Description: AP2 domain
  misc_feature: Bit score of 448.0 for HMM based on sequences of FIGURE 8.
  misc_feature: Functional Homolog Of Ceres SEEDLINE ID no. ME15935 at SEQ ID NO. 644
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 646 - DNA, 910 bp, Zea mays
  misc_feature: Ceres CLONE ID no.991178
  misc_feature: Encodes the peptide sequence at SEQ ID NO. 647
ctctctacagctacctagctagtatctacccgccattgcattgcaccacctctgtcctcgatctctcttgctcgaccacacacacacgcacacgatcgactaacaaccctgtatctgtatggatatggcaatgagccagcacagctccgacacctcgtccacgtcctcctactcgtccgacccctcctccacgtcgtccaccaccagcggcaagaagcgcccgcgcccgcacgccgccgccgccccggcgtaccgcggcgtccgcatgcgcgcgtggggcaagtgggtgtcggagatcagggagccccgcaagaagtcgcgcatctggctgggcaccttcccgcgcccggagatggcggcgcgcgcgcacgacgccgccgcgctcagcgtcaagggcgcgcgcgccgtgctcaacttcccggccctcgcgcgccacctcccgcgcccggcctccctggcgccgcgcgacgtccaggccgccgccgcgcgcgccgccgtcatgcacgagccagagcctcaacaacctgatgagcccggacggcagcccgtggaggaggtggccctggccgccgagctggtgttcgacgacctggcgcctctgtgggtggaggacgtggtggagttgggcccgtgcccgtcccagcatagctcgtggacgccgtgcgatgggctcgacgccgccgcctgtctgcactctctccctctcttgtgggactactagctgctactaggctccttgctccgtttgtacatggccttgaaccattttcgtttccgcttgtttttttttttttttggttttcacttgttttcatatatccaccggagctacctacaaagagtaaatccctactcgcactgtactacttctcgtatatttggactaaattttggcgggtagccatcgctt

SEQ ID NO: 647 - protein, 200 aa, Zea mays
  misc_feature: Ceres CLONE ID no.991178
  misc_feature: Bit score of 120.0 for HMM based on sequences of FIGURE 8.
  misc_feature (43)..(94): Pfam Name: AP2 Pfam Description: AP2 domain
  misc_feature: Functional Homolog Of Ceres SEEDLINE ID no. ME15935 at SEQ ID NO. 644
MDMAMSQHSSDTSSTSSYSSDPSSTSSTTSGKKRPRPHAAAAPAYRGVRMRAWGKWVSEIREPRKKSRIWLGTFPRPEMAARAHDAAALSVKGARAVLNFPALARHLPRPASLAPRDVQAAAARAAVMHEPEPQQPDEPGRQPVEEVALAAELVFDDLAPLWVEDVVELGPCPSQHSSWTPCDGLDAAACLHSLPLLWDY

SEQ ID NO: 648 - DNA, 793 bp, Glycine max
  misc_feature: Ceres CLONE ID no.1626038
  misc_feature: Encodes the peptide sequence at SEQ ID NO. 649
aagagccgttactactgatatgtacattaaaatctccgattaatggagcaagagcttccacgcagtagcgtccccgacgacgccaccgccgccaccacgagctccgttgacaagcccgccactcctcacgccggaggcacccgccacccgctcttccgcggcgtccgcaagcgccgctggggcaaatgggtctccgaaatccgggagccgaggaaaaagtcacgcatatggctcggctccttcccggcgccggagatggcggcgaaggcctacgacgttgccgcctactgcctcaagggctgcaaggcgcagctcaacttccccgacgaggtccaccggcttccgccgctcccctcctcctgcaccgcccgggacatccaggccgccgcagccaaggccgcccacatgatgatggtccaggctgcctccgccgactcgccggagaaaagcagcagcattacctccgactgcgacggcagcggtggtgacgacttctggggcgaaattgagctgccagaactgctcaacggcaagtggtgggcctccgaccgccacgtaacgccgtggccggagactgagcttccgccccagctgcccttcaccacggcgtgcttgtagtagtttgtaataatcaataatgctcttcccatgctctcatgacttggttggtatattagttacatatattattgctcatataattaagtaactctctttgtgttctcttcacaataattaataattttaattgtgatgatcaatgttagtgctgtaaaaaaaaaaaaaaaaaaaa

SEQ ID NO: 649 - protein, 191 aa, Glycine max
  misc_feature: Ceres CLONE ID no.1626038
  misc_feature: Bit score of 91.6 for HMM based on sequences of FIGURE 8.
  misc_feature (36)..(87): Pfam Name: AP2 Pfam Description: AP2 domain
  misc_feature: Functional Homolog Of Ceres SEEDLINE ID no. ME15935 at SEQ ID NO. 644
MEQELPRSSVPDDATAATTSSVDKPATPHAGGTRHPLFRGVRKRRWGKWVSEIREPRKKSRIWLGSFPAPEMAAKAYDVAAYCLKGCKAQLNFPDEVHRLPPLPSSCTARDIQAAAAKAAHMMMVQAASADSPEKSSSITSDCDGSGGDDFWGEIELPELLNGKWWASDRHVTPWPETELPPQLPFTTACL

SEQ ID NO: 650 - DNA, 1049 bp, Zea mays
  misc_feature: Ceres CLONE ID no.341615
  misc_feature: Encodes the peptide sequence at SEQ ID NO. 651
ttttagcaccacctctcatgactatcacatttctttcgggaaagtagaaaaaaatctattacccatgaggccatgatactttccacttggacgaagcgaaattgttaattcctcccttccagtatatagctcgctcgctcacactcggagctcgtaacaaagtcatcactcatcacatgagcttgcttgtgactgccagctttgcccagtgttcatcgcccatggaagagcgggcactgttcccggtgtccgattccagcaccacctgcagcagctctggctgtaccggccccaactcccctgtctcgtcgtcgcagtatttggacgacaccagcgacggcgccggcagctcgagcagccggaagcggccgcgccgggagctgaagcatccaacgtaccgcggcgtgcgcatgcgtgcgtggggcaagtgggtgtccgagatccgggagccccgcaagaagtcgcgcatctggctgggcaccttcgacactcccgagatggccgcgcgcgcgcatgacgtcgccgcgctcgccatcaagggccgcgccgcgcacctcaacttcccggagatgtcccacgagctgccccgcgccgcatcggcggcccccgaggacgtgcgtgcggcggcggcgctcgcggccgcgatggagatggagagcgtggcgccgcccacttctagcgagtctcgcgacggcgcccgcaatgacgaaaatgaagggccggccgcatctagctcgtccggcaacgacgccgacaatgcccagaccgaagagcgggctgcgccgtccgagcattcgatgctggctgacgggcacatccttaatctcgcggtcttcgagctgccggacgtcctactcgagttcggcttcgcgccgccgccgccgtcgacgtcttgtggctatgatttgtcctgggacgagccgttgctgctctgggagcactgacgagcaagagggggcaacgtgacatgcatgccaatgtgaagttagataggtgcagctgatgatccgcatacaagcatacttttactaatcagcattgatttgtac

SEQ ID NO: 651 - protein, 255 aa, Zea mays
  misc_feature: Ceres CLONE ID no.341615
  misc_feature: Bit score of 134.2 for HMM based on sequences of FIGURE 8.
  misc_feature (72)..(123): Pfam Name: AP2 Pfam Description: AP2 domain
  misc_feature: Functional Homolog Of Ceres SEEDLINE ID no. ME15935 at SEQ ID NO. 644
MSLLVTASFAQCSSPMEERALFPVSDSSTTCSSSGCTGPNSPVSSSQYLDDTSDGAGSSSSRKRPRRELKHPTYRGVRMRAWGKWVSEIREPRKKSRIWLGTFDTPEMAARAHDVAALAIKGRAAHLNFPEMSHELPRAASAAPEDVRAAAALAAAMEMESVAPPTSSESRDGARNDENEGPAASSSSGNDADNAQTEERAAPSEHSMLADGHILNLAVFELPDVLLEFGFAPPPPSTSCGYDLSWDEPLLLWEH

SEQ ID NO: 652 - DNA, 932 bp, Gossypium hirsutum
  misc_feature: Ceres CLONE ID no.1832518
  misc_feature: Encodes the peptide sequence at SEQ ID NO. 653
aaccattctttcactcactctacctactacgcatacatacatgcacgcaaatgtagaattacagatatggccaatttgtcccccgaagtgaacccaccaacccctcaaatccccgactctacgctcgatcttgtgcagttgccaaatcacagcaacctaccttccatcccgacgccaaaccctgttcaatatagctggcctggttccggaaggcattctagttatcggggaatacgaagcaggagcggcaaatgggtatctgaaatacgcgagccgcgtaaaaccacgcgtatatggctcggaacgtaccccactcctgaaatggcagccaccgcgtatgatgtggctgctattgctctaaaaggtcccgacacggatttgaactttccggatatgattctttcgtatccaaaagtggcttctacatccgcagccgatattcgagcggctgctgctagtgctgccgcttccaggctacccatgccagatacggggtcatcaaaacaggatcaaggcaaccttcaaaatgagggtaccgcgtcgacgtttagcacttgcatggagtctggttcaggtcaggaatatattgacgaggaagagcttttaaactttcccaatttgatggtggacatggcaggaggaatgctcgtaacccctcccaggatcaactcactcgcttcagatgattcaccagagatttcagatatagaaagcctatggacttatccttaaaggggctctaaatttactaagatagcagaaagtacaaaataagaaatgtgattgaaaaagtagatgagatgatcacaaatgtgaaggtatttgtcctttttgatctcttttgggctgtttctgtcatgccctgtatctgtatgcattcctgagtattgctagttaaagtttgcttgaggtaaaaaaaaaaaaaaaaaaaa

SEQ ID NO: 653 - protein, 221 aa, Gossypium hirsutum
  misc_feature: Ceres CLONE ID no.1832518
  misc_feature: Bit score of 145.4 for HMM based on sequences of FIGURE 8.
  misc_feature (51)..(101): Pfam Name: AP2 Pfam Description: AP2 domain
  misc_feature: Functional Homolog Of Ceres SEEDLINE ID no. ME15935 at SEQ ID NO. 644
MANLSPEVNPPTPQIPDSTLDLVQLPNHSNLPSIPTPNPVQYSWPGSGRHSSYRGIRSRSGKWVSEIREPRKTTRIWLGTYPTPEMAATAYDVAAIALKGPDTDLNFPDMILSYPKVASTSAADIRAAAASAAASRLPMPDTGSSKQDQGNLQNEGTASTFSTCMESGSGQEYIDEEELLNFPNLMVDMAGGMLVTPPRINSLASDDSPEISDIESLWTYP

SEQ ID NO: 654 - DNA, 1337 bp, Gossypium hirsutum
  misc_feature: Ceres CLONE ID no.1832588
  misc_feature: Encodes the peptide sequence at SEQ ID NO. 655
tcctcaaatcaaaccttttccctctcattcttccttccttccttccctccaaaccaactgcaaccataagcaactcaatcctctctgttcattaactgctcatttcacactgtttactaagttaggtgttagcactttgcattcattatatattcatactgaataggttttattttgaactcaagtgtgtagagggaaaccctggatcagaactagataatgggtgactcaccaaactcagaaaccgagtcaagcactcttagcaacaactcctctactctgtctccaccttcaccatgctcttatggcggtaaaagggattcgggaactgaccccacccccgactccaagaggcaaaagcgtcagagggatagtagcaagcatccggtttaccgtggggtaagaatgcgggcatggggcaaatgggtatccgaaatccgagagccccgtaagaagaaccggatctggttaggcactttttccactcccgaaatggccgcacgtgcccatgacgttgcagccttaagcatcaaaggcaacgccgccattctcaacttccctgagctcgccgagtcgttgccccgaccagcctccaacgccccccgcgacgtccaagccgccgctgccaaagctgcctcaatggacttcttaagtaacagcattagtagtaacaacagcaacgccacgtcatcttcatcgctgtcgtcctcagcttccacgtcgtcatcgtcgaatgtggatgacgtgtcgacaccggaggagctgagccagatagtggagctgccaagtctagggacgagcttcgaatcggccgagttagggaacgagttcgtgtacgtggacgcggtcgatggatggttttttaatccgagtggcatgccttggtattacgaagaaaactgtgggtattttggggaagagatttcaatccaaattcaagaaagtgagatgatcaccgggtttggccctttactatgggatcactaaaaacaaaaaatcactagtatgtgccctttttgttaaaaacaaaatactcatataatttttatttgacgaaatcgccctttttacattttttttcctagatggaacgggcataagaaaagaaaaaataaataaatcttgcatggtttactccattgtgcttagagatttagcatggattggtaaaaatttctactttttttcccttctcaaaggaagtcaaatataatggggattcttcatttctattcttgtaattatattttgtgagattgacatgtgttgtggagtaattaaaggtcatatgttcctgtttgggttcattcaattctcaaaaaaaaaaaaaaaaaaaa

SEQ ID NO: 655 - protein, 255 aa, Gossypium hirsutum
  misc_feature: Ceres CLONE ID no.1832588
  misc_feature: Bit score of 128.4 for HMM based on sequences of FIGURE 8.
  misc_feature (56)..(107): Pfam Name: AP2 Pfam Description: AP2 domain
  misc_feature: Functional Homolog Of Ceres SEEDLINE ID no. ME15935 at SEQ ID NO. 644
MGDSPNSETESSTLSNNSSTLSPPSPCSYGGKRDSGTDPTPDSKRQKRQRDSSKHPVYRGVRMRAWGKWVSEIREPRKKNRIWLGTFSTPEMAARAHDVAALSIKGNAAILNFPELAESLPRPASNAPRDVQAAAAKAASMDFLSNSISSNNSNATSSSSLSSSASTSSSSNVDDVSTPEELSQIVELPSLGTSFESAELGNEFVYVDAVDGWFFNPSGMPWYYEENCGYFGEEISIQIQESEMITGFGPLLWDH

SEQ ID NO: 656 - DNA, 972 bp, Gossypium hirsutum
  misc_feature: Ceres CLONE ID no.1936806
  misc_feature: Encodes the peptide sequence at SEQ ID NO. 657
ataatcaaacctcgcttttcactctgttttcttttcccgagaaacaaacaacaaatataagccaaaacccttcatccaaaaaaccttacctttattgcttaaatttatataaagtttcttactttgcatatatatatatagttagcattatatcgagtagcttcttttttgtttcagttacaatgggtgactcactgaactcggaaactgagtctagcacggttagtaacaactcgtctccttcaacgtcaccatatgggaaaagattgggtactgagttaatgcccgacccgaaaagggaaaagcgtccgagagataatagtaagcatccggtttaccgtggggtccgaatgagggcttggggtaaatgggtatccgaaatccgagagccccgaaaaaagaaccggatctggttaggtactttctccacacccgaaatggcagcacgagcacatgacgtggcagctttgagtatcaaaggtaactcggcgatccttaacttccctgaactcgctgagtcgttgcctcgtccggcttctaactcgccgcgtgatgtacaagccgccgccgctaaagctgccgcaatggagttcttgagtaacaaaaacaacagcgtcgacgatgccacttcatcttcggattcaacgtcgtcatcgtcgaatgtggatgatatgtcatcgacaccggaagagctgagtgagatagtggagctgccgagtttagggacgagctatgagtcggctgagtcagggaacgagttcgtgtacgtggaccgctttgatgggtggctttttaatccttgtggtatcccttgggattatgaagaaaattgtgggtacttcggggatgaaacttcaatgcaaatacaagatagtctcattacaaatgggtttagtcctttactatgggatcattaatgcataattaataataaatcaaattttgtttgactaaaaaaaaaaaaaaaaaaaa

SEQ ID NO: 657 - protein, 211 aa, Gossypium hirsutum
  misc_feature: Ceres CLONE ID no.1936806
  misc_feature: Bit score of 93.3 for HMM based on sequences of FIGURE 8.
  misc_feature (17)..(68): Pfam Name: AP2 Pfam Description: AP2 domain
  misc_feature: Functional Homolog Of Ceres SEEDLINE ID no. ME15935 at SEQ ID NO. 644
MPDPKREKRPRDNSKHPVYRGVRMRAWGKWVSEIREPRKKNRIWLGTFSTPEMAARAHDVAALSIKGNSAILNFPELAESLPRPASNSPRDVQAAAAKAAAMEFLSNKNNSVDDATSSSDSTSSSSNVDDMSSTPEELSEIVELPSLGTSYESAESGNEFVYVDRFDGWLFNPCGIPWDYEENCGYFGDETSMQIQDSLITNGFSPLLWDH

SEQ ID NO: 658 - DNA, 848 bp, Brassica napus
  misc_feature: Ceres CLONE ID no.973892
  misc_feature: Encodes the peptide sequence at SEQ ID NO. 659
atcattttggaacactgctataaatgctgagtacagtgagtgaaaccacatcacaagaaagaatgaaactatcaccaccaccacttaccaacaacgaacaaccagccgcagatactgcagttaaatcttgcggtggaggcggtagagaaactttctcggcgacgaggcatccagtgtaccacggagttcgcaaacgtcgatggggaaaatgggtttccgagatcagagagccccgaaagaaatctcggatttggctcggatcttttccgataccggagatggcagctaaagcttacgacgtggcggcgctttgtctgaaaggaagaaaagctcagctaaacttccccgacgaaatcgacgatttacctcgcccgtcgacgtgtacggccagagatatccaagtcgcggcggccaaagcggccaacgccgtcaagatcattaaaacgggagatgacgtggcaaatatcggagatggagatgatttctgggaaggcatagagctgccagagcttatgatgaccagatgtgggtggtcgccggagcctttcgttgccggagatgatgccacgtggttggtggacgaagactcgtatcagtatcagttcatggcgtgtctgtgagtgcatgtagttgtcgactgtgttctgcgtattcmctatacgtgtgcgctgtatcgttactgtcttggctagatcgattagatgcatgcaagtatatttttatgcattttattatttgtctctagtttattgttttacgtgacggtgacgtgattaatattatatagatactatcagagcacctccgatgaggttatacccattggagttctaaaaattcatgtgtat

SEQ ID NO: 659 - protein, 198 aa, Brassica napus
  misc_feature: Ceres CLONE ID no.973892
  misc_feature: Bit score of 122.6 for HMM based on sequences of FIGURE 8.
  misc_feature (50)..(101): Pfam Name: AP2 Pfam Description: AP2 domain
  misc_feature: Functional Homolog Of Ceres SEEDLINE ID no. ME15935 at SEQ ID NO. 644
MLSTVSETTSQERMKLSPPPLTNNEQPAADTAVKSCGGGGRETFSATRHPVYHGVRKRRWGKWVSEIREPRKKSRIWLGSFPIPEMAAKAYDVAALCLKGRKAQLNFPDEIDDLPRPSTCTARDIQVAAAKAANAVKIIKTGDDVANIGDGDDFWEGIELPELMMTRCGWSPEPFVAGDDATWLVDEDSYQYQFMACL

SEQ ID NO: 660 - DNA, 907 bp, Glycine max
  misc_feature: Ceres CLONE ID no.565251
  misc_feature: Encodes the peptide sequence at SEQ ID NO. 661
agcactgactaagtagtaaccaacttggtccaatccaaaacattaaaaagagagagcgtaatggctgagctacctagctcagaagcatcatcatcagcttccactcgcaagcactcgcattccgtctacagaggggtccgaatgcgggcctgggggaagtgggtatccgaaatccgcgagcccagaaagaagaaccggatctggctcggcacctttgccaccgccgagatggccgcgcgtgcacacgacgtcgcggcgctcgccatcaaaggcaactccgccattctcaacttccccgaactcgcctcctccctgccccgacccgactccaactcgccaagagacgttcaggccgccgccgccaaagccgccgccatggaggttaacgatgctccgacgacgccaacttcgtcgtcgtcggcgtcactgtcgcagtcgtcatcttggtcgtcattggcggttagttcttcctccggcgaagacccgtcgacgccggaggagcttggggagatagtggagctgccgagtctggggacgagttttgaaatacccgacccgagtggggagttggtatttttcgacccgtggccgtattctcaggcgtggagtcacggcatttatgatgagagtgagagttatttttttggggatcagatttcaatgcaggactcagagacagagagcatggttctttgtggctttgcctttgaggcttcattgtggcagcattaatacatgggtgctgttaacatgtgcccttagggcacatgttaatgtgtaataaatgatggttggtccccatttattatattttggaaaaaacagcatcataaatgtgggaccacttattatactttggaagttaattttctctttgtccaaaataaaataggtgggaccatgagcc

SEQ ID NO: 661 - protein, 223 aa, Glycine max
  misc_feature: Ceres CLONE ID no.565251
  misc_feature: Bit score of 95.6 for HMM based on sequences of FIGURE 8.
  misc_feature (21)..(72): Pfam Name: AP2 Pfam Description: AP2 domain
  misc_feature: Functional Homolog Of Ceres SEEDLINE ID no. ME15935 at SEQ ID NO. 644
MAELPSSEASSSASTRKHSHSVYRGVRMRAWGKWVSEIREPRKKNRIWLGTFATAEMAARAHDVAALAIKGNSAILNFPELASSLPRPDSNSPRDVQAAAAKAAAMEVNDAPTTPTSSSSASLSQSSSWSSLAVSSSSGEDPSTPEELGEIVELPSLGTSFEIPDPSGELVFFDPWPYSQAWSHGIYDESESYFFGDQISMQDSETESMVLCGFAFEASLWQH

SEQ ID NO: 662 - DNA, 686 bp, Glycine max
  misc_feature: Ceres CLONE ID no.681088
  misc_feature: Encodes the peptide sequence at SEQ ID NO. 663
tgccactctatacactgtgaatggaccatcaacctccaccgtgccccgccgccgcctccgcaacggacaaccctcgtggcggaacgcgccaccccatgtaccgcggcgtccgcaagcgccggtggggcaaatgggtctccgaaatccgggagccacggaagaagaaccgcatatggttggggtcgtttccggtgccggagatggcggcacgagcatacgacgtcgcagcctactgcctcaaaggccggaaggcgcagctcaactttcccgacgacgtcgactccctgccgcttccgtcgtcccgcacggcaagagacattcagaccgccgcggcccaggcggcgcgtatgatgaaagcttccggcaatgatgagaaaagcggcattgcctccgacgacggcgatagcggttgcgatgatttttggggcgagattgagttgccagagctgatggacggcgagtgctactggggttgtccggccggcgcttcctcctggacttcctccggcgatctcgccgagtggccggaggaggagctttcgccgcagcaaccgtcgtttatggcatgtctataatctactgtatctctgtattaatgctgcatgttcagttgttgttggtatgtttcttgtattatatatcctattcctaatgttatatcctatgtgccaactgttcctgttgtc

SEQ ID NO: 663 - protein, 184 aa, Glycine max
  misc_feature: Ceres CLONE ID no.681088
  misc_feature: Bit score of 103.2 for HMM based on sequences of FIGURE 8.
  misc_feature (25)..(76): Pfam Name: AP2 Pfam Description: AP2 domain
  misc_feature: Functional Homolog Of Ceres SEEDLINE ID no. ME15935 at SEQ ID NO. 644
MDHQPPPCPAAASATDNPRGGTRHPMYRGVRKRRWGKWVSEIREPRKKNRIWLGSFPVPEMAARAYDVAAYCLKGRKAQLNFPDDVDSLPLPSSRTARDIQTAAAQAARMMKASGNDEKSGIASDDGDSGCDDFWGEIELPELMDGECYWGCPAGASSWTSSGDLAEWPEEELSPQQPSFMACL

SEQ ID NO: 664 - DNA, 958 bp, Glycine max
  misc_feature: Ceres CLONE ID no.707775
  misc_feature: Encodes the peptide sequence at SEQ ID NO. 665
cattactttcaggtttcatttcaaaatattctctctctcctcttaaagcaaaacccttaattattaccaacgaccacacaccacagccactttcatcaatttccttaatccccacctccacataacaacaacaacgaactaacgccaccacattcattctttccttctttgtgcctacaatactactactactactactaattctacatggatggcaactcttttggaaacgtgccacccccaccaatacaagttcctgataacttggctatctcctcctcctcttcgccaactcccacgacatcatctccgtctccgacaccctctggaggctttcggtaccgcgggacgcggtgccggagcggaaagtgggtgtcggagataagggagccacgtaaaacgaatcgcatttggctggggacttacccgacagcggaaatggctgcggcggcatatgatgtcgccgcactcgcgttgaagggtcccgacacgcccgtcaacttccctaattcgatactgtcgtaccctattcctgcttcattgtcctccacggacattcgcgccgcggctgcggccgcggcgcaggctaggatcgtgagggcgccgcaggagagtgaggaaacggtaaaccctgatgatggcgggcaagggttatcggagaggcgtgaggagtacatttatgaggatgagttgttgaacatgccgaatttgctcgatgaaatggccagaggaatgcaggttagtccccttaggatcacttcctattcttcagatgattcgcctgggaattctgatggagataacctttggagttataccctttgatcactgatttgttgtttgttcagtgagtgagtatggtaatttgttttgtgtttgtttgaaagttcgagtcttgattatgtatgttcaaccttgttaaatatttgaaaggagggctttataacgggattgtggg

SEQ ID NO: 665 - protein, 205 aa, Glycine max
  misc_feature: Ceres CLONE ID no.707775
  misc_feature: Bit score of 131.4 for HMM based on sequences of FIGURE 8.
  misc_feature (43)..(93): Pfam Name: AP2 Pfam Description: AP2 domain
  misc_feature: Functional Homolog Of Ceres SEEDLINE ID no. ME15935 at SEQ ID NO. 644
MDGNSFGNVPPPPIQVPDNLAISSSSSPTPTTSSPSPTPSGGFRYRGTRCRSGKWVSEIREPRKTNRIWLGTYPTAEMAAAAYDVAALALKGPDTPVNFPNSILSYPIPASLSSTDIRAAAAAAAQARIVRAPQESEETVNPDDGGQGLSERREEYIYEDELLNMPNLLDEMARGMQVSPLRITSYSSDDSPGNSDGDNLWSYTL

SEQ ID NO: 666 - DNA, 1081 bp, Zea mays
  misc_feature: Ceres CLONE ID no.453357
  misc_feature: Encodes the peptide sequence at SEQ ID NO. 667
aaatcaacacccatctccgagctggaccaagtcttctagcctagctcttacggcaccaagcaggcctgcacagcatttccgttgcccgcgcgcgcacacactgcaggcctcacttcttggtggcactggcagtggcactggcggcaatgccggactcggatgtccccagcccagcatcgtcgccgcttggcagcgtgcagaagattgccaggggtcggaaaagcaggcgcggcggcgggcggagcccggcgtaccgcggcgtgcggatgcgggcgtgggggaagtgggtgtccgagatccgcgagccgcgcaagaagtcccgcatctggctcggcaccttcccgacggccgagatggcggcgcgcgcccacgacgccgccgcgctagtggtcaagggccgcggcgcggtgctcaacttccctgagatggcggcgtccctgccgcgcccggcttccgccgcgccgcgcgacgtgcaggccgcggccgcgcgcgccgccgccatggacgttcccgtgggcgcggcggagccgctgccgtcctcgtcgccgcagcaggtgctggggcagccgttagttgtaggcgaccccgatgtggagctcctggaggagatcgtggagctaccgttgatcgacgaggatgtcatggcgtcggacgacgtgttctgctggacggcgtcgttccacgactgtgccgccgacgacccgctgtcgtacgagccgaacgcgtggatgcaggcaggcggcagcattgcggcgcaggtcgcggagatgatggtgcccgggaccgggctcgccacggaccagctctggacggcgcagccagacggcattatgccttcggagctcggtgcgttcttatggaacccctgtagttaactacgcaactagctaatcgatctgcccgtctctctctttgctctctttgcagtatatataaatataaatcgcatgctttgttaatagctcagaaagcatctgcatcgaacgacggcttgctacgtacgtaccgttggcacggcagtagcaaacatacggacgcatctgggtacctttccaaaaaaaaaaaaaaaaaaaaaaaaaaa

SEQ ID NO: 667 - protein, 242 aa, Zea mays
  misc_feature: Ceres CLONE ID no.453357
  misc_feature: Bit score of 107.0 for HMM based on sequences of FIGURE 8.
  misc_feature (34)..(85): Pfam Name: AP2 Pfam Description: AP2 domain
  misc_feature: Functional Homolog Of Ceres SEEDLINE ID no. ME15935 at SEQ ID NO. 644
MPDSDVPSPASSPLGSVQKIARGRKSRRGGGRSPAYRGVRMRAWGKWVSEIREPRKKSRIWLGTFPTAEMAARAHDAAALVVKGRGAVLNFPEMAASLPRPASAAPRDVQAAAARAAAMDVPVGAAEPLPSSSPQQVLGQPLVVGDPDVELLEEIVELPLIDEDVMASDDVFCWTASFHDCAADDPLSYEPNAWMQAGGSIAAQVAEMMVPGTGLATDQLWTAQPDGIMPSELGAFLWNPCS

SEQ ID NO: 668 - DNA, 684 bp, Gossypium hirsutum
  misc_feature: Ceres CLONE ID no.1916958
  misc_feature: Encodes the peptide sequence at SEQ ID NO. 669
aaaacggttctcacgtaatggaacaaccaccgtatacggaggatgacttaaacgcctccaccgcctcaccggaatccgccatgaaacacgacacgaaaggaggcggcggaactcggcatccagtataccgtggcgttcgtaaacgacggtggggcaaatgggtgtcggagattagagagccccgcaagaagtcacgcatttggttaggctcattcccggtgccggaaatggccgctaaagcttacgacgtagcggcgttttgtttgagaggacgtaaagctcaactgaacttccccgacgaagtagacgatttacccatacccttgacgtccactgctcgtgacatccaagccgccgccgcgaaagcggcacatttagtagtatcttcgtcgaagaaaattccagaatcatccgaagacggtagtgatgatttctggggtgaaatagaattgcctgaattaatgaataacggcggttgtcaatggaattcttgtggatggactttcgccggcgattcatcgtggcttgacggagaaacccaaacacaacaacacttcctagcatgtctttgatgtgtagggatcccactttgtgtagtaaaaaacaaaaaacaccgccattaatgtttcaacaacctcttgtgttctttgctgtttatgtacttattacaaagcattataccat

SEQ ID NO: 669 - protein, 184 aa, Gossypium hirsutum
  misc_feature: Ceres CLONE ID no.1916958
  misc_feature: Bit score of 105.3 for HMM based on sequences of FIGURE 8.
  misc_feature (35)..(86): Pfam Name: AP2 Pfam Description: AP2 domain
  misc_feature: Functional Homolog Of Ceres SEEDLINE ID no. ME15935 at SEQ ID NO. 644
MEQPPYTEDDLNASTASPESAMKHDTKGGGGTRHPVYRGVRKRRWGKWVSEIREPRKKSRIWLGSFPVPEMAAKAYDVAAFCLRGRKAQLNFPDEVDDLPIPLTSTARDIQAAAAKAAHLVVSSSKKIPESSEDGSDDFWGEIELPELMNNGGCQWNSCGWTFAGDSSWLDGETQTQQHFLACL

SEQ ID NO: 670 - DNA, 934 bp, Gossypium hirsutum
  misc_feature: Ceres CLONE ID no.1940632
  misc_feature: Encodes the peptide sequence at SEQ ID NO. 671
aacaaaaaactaggcatctatctatctgtcatggaaagggatatcgacattgagaatgatgctcattataataacccgcttacttcttgttccgtcatctctaccactaccaccgtggccacctccatctcattctccgtttcgggtcctaaacaaaacaagaaaacttcaaaaaacagtgtagctattaaaggttcaaagaaagctgtaggagacttggaaaggaagcaaccggtataccgtggtgtacgaatgcggagttggggcaaatgggtgtccgaaatccgacaaccaaaaaagaaatcgagaatatggctcgggacttaccccaccgcagaaatggcagctcgagcccacgatgtagccgcactagccatcaaaggctgctcggctcaccttaacttccccgaacttgcaaaaacacttccacgccccgctagtacatctcctaaggaaatccaagccgctgcttcccaagctgctgcttcaacatatctcgacacatcgcggtggagcaacaacattgaacccgaagacaaagttagtcgtcgaccaaggcaagaacaagttccggtttcacgttcggacaatatgtgtggtacttcaccctttgaagacgatgctgccttgtttgatttgcccgatctcacgattgatgccatcgatcgaagcgatgggctctgctcttattcttcaacgtggcaagtatgtgcagtcgatgctggtttcaggatcgaggagccattcgcgtgggagtactactaagaaaagaccgtatcttttcagtacatgcaatatcttcttttttaatctttgacatggttaatattaaccaatcatatggttaaaatatatatgtaaaatatgagcatgtcagatcaataaacatttaataaatggagattaggttcttcaaaaaaaaaaaaaaaaaaaa

SEQ ID NO: 671 - protein, 244 aa, Gossypium hirsutum
  misc_feature: Ceres CLONE ID no.1940632
  misc_feature: Bit score of 136.2 for HMM based on sequences of FIGURE 8.
  misc_feature (68)..(119): Pfam Name: AP2 Pfam Description: AP2 domain
  misc_feature: Functional Homolog Of Ceres SEEDLINE ID no. ME15935 at SEQ ID NO. 644
MERDIDIENDAHYNNPLTSCSVISTTTTVATSISFSVSGPKQNKKTSKNSVAIKGSKKAVGDLERKQPVYRGVRMRSWGKWVSEIRQPKKKSRIWLGTYPTAEMAARAHDVAALAIKGCSAHLNFPELAKTLPRPASTSPKEIQAAASQAAASTYLDTSRWSNNIEPEDKVSRRPRQEQVPVSRSDNMCGTSPFEDDAALFDLPDLTIDAIDRSDGLCSYSSTWQVCAVDAGFRIEEPFAWEYY

SEQ ID NO: 672 - DNA, 693 bp, Glycine max
  misc_feature: Ceres CLONE ID no.476784
  misc_feature: Encodes the peptide sequence at SEQ ID NO. 673
aatatgtacattaaaatctacgaataatggagcaagagcttcaacgcaacagtgtccacgacgacgaagccgccaccaccacgagctccggcgacaagcccgccacccctcgcggcggcggaacccgacaccccctcttccgcggcgttcgcaagcgccgctggggcaaatgggtctccgaaatccgggagccgaggaaaaagtcacgcatatggctcggctccttcccggcgccggagatggcggccaaggcctacgacgtcgccgcctactgcctcaagggccgcaaggcgcagctcaacttccccgacgaggtccaccgtcttccgctgctcccctccgcctgcaccgcccgcgacatccaggccgccgccgccaaggccgcccacatgatgatagtccaggccgcctctgtcaccgccgactcgccggagaaaagcagcagcattacctccgactgcggcgacggtggcggtggagacgacttctggggcgaaattgagctgccagagttgctcaacgccaagtggtgggcctccgaccacgacgtcacgccgtggcccgagtccgagctcccgccccagcagcccttcaccacggcgtgcttgtagtttgtaataatcaataatgctcttctctcaagctccgacttggttggtatattaattatatatattagtattttgctcatat

SEQ ID NO: 673 - protein, 194 aa, Glycine max
  misc_feature: Ceres CLONE ID no.476784
  misc_feature: Bit score of 99.0 for HMM based on sequences of FIGURE 8.
  misc_feature (36)..(87): Pfam Name: AP2 Pfam Description: AP2 domain
  misc_feature: Functional Homolog Of Ceres SEEDLINE ID no. ME15935 at SEQ ID NO. 644
MEQELQRNSVHDDEAATTTSSGDKPATPRGGGTRHPLFRGVRKRRWGKWVSEIREPRKKSRIWLGSFPAPEMAAKAYDVAAYCLKGRKAQLNFPDEVHRLPLLPSACTARDIQAAAAKAAHMMIVQAASVTADSPEKSSSITSDCGDGGGGDDFWGEIELPELLNAKWWASDHDVTPWPESELPPQQPFTTACL

SEQ ID NO: 674 - DNA, 719 bp, Gossypium hirsutum
  misc_feature: Ceres CLONE ID no.1869284
  misc_feature: Encodes the peptide sequence at SEQ ID NO. 675
atgattcaaatttctgccatattacacacaaacaatgtctgaatctgatccttcttcaaccaatgtgcccccgaaagaccagccaccaccaccaactgttccaatccctgacgctcctccgcaagagcagtcgccgaaaccatcatccactccattggtctcatcgaaagaaggcgtaagtgggaatcccacatcgagaaagttgtcggcggtttatcggggagtaagaagcaggagtgggaaatgggtgtcggaaatacgtgagccgcgtaaaacgacgcgtatatggctagggacataccctacacctgaaatggcagccaccgcgtatgacgtggctgctcttgccctaaaaggtcccgacgcggaactgaactttccggatatggttcattcgtatccgaaagtgggttctacatcggcaactgatattcgtgccgccgctgctagtgccgccgcttctagactactacccaagtctgttaccaatactgggtccttatcaaaaaacgaggacaccacatcgactactgctatggagattacctgttcaggtcaagaatttatcgacgaggaagagcttttaaactttcccaatttgatggtggatatggcagggggaatgctagttagccctccaaactggataaactcaccaccttctgatgattcaccagataattcagatgtagatacactatggacttacacttaaaata

SEQ ID NO: 675 - protein, 226 aa, Gossypium hirsutum
  misc_feature: Ceres CLONE ID no.1869284
  misc_feature: Bit score of 144.4 for HMM based on sequences of FIGURE 8.
  misc_feature (59)..(109): Pfam Name: AP2 Pfam Description: AP2 domain
  misc_feature: Functional Homolog Of Ceres SEEDLINE ID no. ME15935 at SEQ ID NO. 644
MSESDPSSTNVPPKDQPPPPTVPIPDAPPQEQSPKPSSTPLVSSKEGVSGNPTSRKLSAVYRGVRSRSGKWVSEIREPRKTTRIWLGTYPTPEMAATAYDVAALALKGPDAELNFPDMVHSYPKVGSTSATDIRAAAASAAASRLLPKSVTNTGSLSKNEDTTSTTAMEITCSGQEFIDEEELLNFPNLMVDMAGGMLVSPPNWINSPPSDDSPDNSDVDTLWTYT

SEQ ID NO: 676 - protein, 261 aa, Oryza sativa subsp. indica
  misc_feature: Public GI ID no.125540662
  misc_feature: Bit score of 159.9 for HMM based on sequences of FIGURE 8.
  misc_feature (69)..(119): Pfam Name: AP2 Pfam Description: AP2 domain
  misc_feature: Functional Homolog Of Ceres SEEDLINE ID no. ME15935 at SEQ ID NO. 644
MADLTEHPSPTAPPQVQTAGLPVAASPGPASPHSPSEQGDKTAPGAATASTMTTASSGEPSPRSSGKHAFYRGIRCRSGKWVSEIREPRKARRIWLGTYPTAEMAAAAYDVAARALRGADAVLNFPDATASRPVPASASPADIRAAAAAAAAAAAHLERPHGPTGTAYPATAAAEHHQQQQQQQYGSGSPAADDVSGYPPMEGGIGNDDFMDEEAIFELPQLLRNMAAGMMMSPPRLSPTTSDVSPEPSEAGESLWSYRDP

SEQ ID NO: 677 - DNA, 1498 bp, Glycine max
  misc_feature: Ceres CLONE ID no.1648272
  misc_feature: Encodes the peptide sequence at SEQ ID NO. 678
cattttcgtcccttcctctctactaaaacccccccttccccccacaccctcttcacctcattttcattcatttttctcactctctctgtgtcactgtcattcattttcacattcacacatcaaacccaagaactttctattccttaaaacaatggtcgagcctcctgcggcagcagcaacctcagaatcagacacaacaggaaacaccaacactccttcaccgtcttcttcatcctcgtcgtcaagttctaagaagcgagcaagagacaacaacaataatagtaacagcagcagtaacaagcattctgtgtatagaggtgtccgaatgcgcacgtgggggaaatgggtgtcggaaatccgcgagccgcgaaagaagaacagaatctggctcggaacgttcgccacagccgagatggcggcgcgtgcgcacgacgtggcggcgctgacgataaaaggctcctccgccatccttaacttccccgaactggcggccacgctgccccggccggcctccaactccccccgcgacgtgcaggccgcggccgccaaggcggcgtccatggaggcgccgccgaggacccctccctcgccggcctccacgccggcggaggatgacctcggcgagattgtggagctgccgccgctgggaacgagtttcgactcgcccatcgacccgatgagtaccgagttcgtgttcctggacatggacgacgggtggccctattctcacccatggtaccacggcatttatgatggtgggtacttgattagcgacatcaacaacatggtttcaatgcaagagtcagagagcatgcttctttccttgtggccttcaacttaagccaatgctatactcattccagtatgattatttttgcgtcagtgatatgattaacagatcatcatgctttgatctctttcttaagtatgcgattagaggttgaatttccaagtccgtatatatgaaataacatttatcggccaacatcagtctcttgaatggacatcatggcatcagaaattaatcttccactctccatggatattctgggtttagtatttttttttataaatattttctccttttttttttctgaattgcatagtatatttattacttaacctttccatgtggacccttcgccaatttttcttttcaagggccataatatatatagtttttcttgtttctcaagtgagctactttgtgtttgtaatttgtaatttgtaattacttgatttgcctgctcttttctctctctctttctttttgtattttttttgtttatgatccttgtcgttgtaatgagctatacatacaatgctagtagcggaactggtgtggtggttttatgatgatgatgcaaatgaagtgaaagatacgtgtagaaagtagttctaagcttacattatatagttctgcttttagaggacaagaataaaggctaaaggaagattctccattggagtttttatttctaaaaaaaaaaaaaaaaaa

SEQ ID NO: 678 - protein, 229 aa, Glycine max
  misc_feature: Ceres CLONE ID no.1648272
  misc_feature: Bit score of 120.1 for HMM based on sequences of FIGURE 8.
  misc_feature (52)..(103): Pfam Name: AP2 Pfam Description: AP2 domain
  misc_feature: Functional Homolog Of Ceres SEEDLINE ID no. ME15935 at SEQ ID NO. 644
MVEPPAAAATSESDTTGNTNTPSPSSSSSSSSSKKRARDNNNNSNSSSNKHSVYRGVRMRTWGKWVSEIREPRKKNRIWLGTFATAEMAARAHDVAALTIKGSSAILNFPELAATLPRPASNSPRDVQAAAAKAASMEAPPRTPPSPASTPAEDDLGEIVELPPLGTSFDSPIDPMSTEFVFLDMDDGWPYSHPWYHGIYDGGYLISDINNMVSMQESESMLLSLWPST

SEQ ID NO: 679 - DNA, 648 bp, Panicum virgatum
  misc_feature: Ceres CLONE ID no.1987804
  misc_feature: Encodes the peptide sequence at SEQ ID NO. 680
atccgtctctgctttctcctcgaagcaggtccatcttcaagaaacgttccatgcgagctcgtaatttagcagagctcgcaattgccatcgatttgcaatgtcggacgcgggcgaggtgtccagcccggcgtcgtccggggcctcgtcctcgccgccgcagtcgccagctgaggcagagccccggcgcagccgccggggaggcgagaagcgagcgcgggacggcggcgggaaccacccgtcgttccgcggcgtgcggatgcgggcgtgggggaagtgggtgtcggagatccgggagccgcgcaagaagtcgcgcatctggctcggcacgttccccacgcccgagatggcggcgcgcgcgcacgacgccgccgcgctcgtcgtgaagggccccgccgccgtgctcaacttcccggagatggccacggcgctcccgcgcccggcctccgccgcaccgcgcgacgtccaggcggcggcggcgcgcgccgctaccatggaaccgcctccggtgccgggcgccaccgccgcggccgttgccgcattgcccacctcggcgccggcgcccccggtggcggggcagcaggcggacgacgagctcgaggcgatcgtccagctcccgccgctcgacgaggacgcccggtgagctcgtga

SEQ ID NO: 680 - protein, 180 aa, Panicum virgatum
  misc_feature: Ceres CLONE ID no.1987804
  misc_feature: Bit score of 86.2 for HMM based on sequences of FIGURE 8.
  misc_feature (47)..(98): Pfam Name: AP2 Pfam Description: AP2 domain
  misc_feature: Functional Homolog Of Ceres SEEDLINE ID no. ME15935 at SEQ ID NO. 644
MSDAGEVSSPASSGASSSPPQSPAEAEPRRSRRGGEKRARDGGGNHPSFRGVRMRAWGKWVSEIREPRKKSRIWLGTFPTPEMAARAHDAAALVVKGPAAVLNFPEMATALPRPASAAPRDVQAAAARAATMEPPPVPGATAAAVAALPTSAPAPPVAGQQADDELEAIVQLPPLDEDAR

SEQ ID NO: 681 - DNA, 1154 bp, Zea mays
  misc_feature: Ceres CLONE ID no.1675695
  misc_feature: Encodes the peptide sequence at SEQ ID NO. 682
aatcatatttatatatatccaatccttcccacatcgcatccatccgctcagctcagctcgatcgaacttcgcacacgcgtacattaattctcaagaacgtactggttggtggtggtagtagctactagctactataaacgatggaccagatgctgggcaagcacctgcagatgccttccgtgactacgagcgccgcctgccagcagccgcagtcgccgccgccgtcgccgcagcagcagcagcagtaccggggcgtgcggaagcgcaagtggggcaagtgggtgtcggagatccggcagccgggcaccaagacgcgcatctggctcggcagcttcgagtcggccgagatggccgcggtggcgcacgacgtggcggcgcttcgcctgcggggccgcgacgcgcagctcaacttcccgggctgcgtcgcctggctgccccgcccggcgacctcgcacgcgcgcgacgtccgcgccgcggcggccgaggccgccgaccgcgtgcgctgcgacccggcgctgctgctgctccagcaggcggcggcagcgcggtgccacgaccacgaccacgaccacgaccgcgagttcggggccgggccggcgccggtggtcgagctcgggagcgacgaggagttcgagctggacctggactcgcccagcctctgggccgagatggcggaggccatgctcctggacccgccgggctgggccaccggcgtcgtcggcgacgcggcggaggtggccctgtgctggccacacggctccctctgggacgcctgctagctcggccaggcacccccgctctggctctgcctgcgagtgtttggccatggccgatgtggccaccggacgctgtttggtctcacaagtgtcgcagtgcttttggtgtgtgccactgtgagcgcgtctctgttgattctcccccgcgtgtggttttgctttacgtctgctgctgttgggcttgctgttttcgttcctgttatcatcttacctgtatcactaccattagctaggcaaaaatgatgacagtccagatcatttgaaaaccaacaaaattagtacggctgtgccctgctgatactgatattatggtttggtctattcctgcattttgtactaatttgtgcagtcacattattggaaaaaaaaaaaaaaaaa

SEQ ID NO: 682 - protein, 202 aa, Zea mays
  misc_feature: Ceres CLONE ID no.1675695
  misc_feature: Bit score of 89.6 for HMM based on sequences of FIGURE 8.
  misc_feature (24)..(75): Pfam Name: AP2 Pfam Description: AP2 domain
  misc_feature: Functional Homolog Of Ceres SEEDLINE ID no. ME15935 at SEQ ID NO. 644
MPSVTTSAACQQPQSPPPSPQQQQQYRGVRKRKWGKWVSEIRQPGTKTRIWLGSFESAEMAAVAHDVAALRLRGRDAQLNFPGCVAWLPRPATSHARDVRAAAAEAADRVRCDPALLLLQQAAAARCHDHDHDHDREFGAGPAPVVELGSDEEFELDLDSPSLWAEMAEAMLLDPPGWATGVVGDAAEVALCWPHGSLWDAC

SEQ ID NO: 683 - DNA, 960 bp, Glycine max
  misc_feature: Ceres CLONE ID no.1169111
  misc_feature: Encodes the peptide sequence at SEQ ID NO. 684
gaccccgggaaaaagaaaagaaaagaaactcacagctattgaatttcacttcacttcacttgcatgccaaatgaaaacaacctcttcccagaatcttgtcggtatttaactccctcgatttcacaacaccaataacaatgagagtttcaacagagacagagccggagactaaaaagataaaacgcattcgcggcggcggggactcgagcaagcaccctttgtaccgcggcgtgcggatgcggaactgggggaagtgggtgtcggaaatccgcgagccgaggaagaaatcgcggatatggctaggcacattccccacgccggaaatggcggcgagagcgcacgacgtcgccgctctcagcatcaaaggccccgccgccattctcaacttccctcacttggccaactcgctcccccgcccggcttcgctggcgccgcgcgacgttcaagctgcggcggcgaaggcggcgcacatggacccttcctccctctcctccttggtctccgcaatggacttgtcctctgcctctgacgagttgagccaaatcatagagcttccttctttggaaagcaccgatgatggctctgttgacttaaagaaggagtttgtttttgttgattcccttgatgcttggatgtatcagccaccctttggttttgacaccgaacaagacactggtttcgagggtttgatgtggaattactaggttcgatccaagtttctattctatgtcttgtgtttgtataaatttatatcgatctcttttatgttttggtttgtgtgtgtctataagcagtaagcagccacttgtggtttttctttcgggggctgccagtgctactgatcactctcgtattcatcatcatgtctctgtgtccttttcttaattcctctgattttaattgtaaatggctagatgaataaagtaagaggagaaattttctgtaaaaaaaaaaaaaaaa

SEQ ID NO: 684 - protein, 188 aa, Glycine max
  misc_feature: Ceres CLONE ID no.1169111
  misc_feature: Bit score of 114.0 for HMM based on sequences of FIGURE 8.
  misc_feature (27)..(78): Pfam Name: AP2 Pfam Description: AP2 domain
  misc_feature: Functional Homolog Of Ceres SEEDLINE ID no. ME15935 at SEQ ID NO. 644
MRVSTETEPETKKIKRIRGGGDSSKHPLYRGVRMRNWGKWVSEIREPRKKSRIWLGTFPTPEMAARAHDVAALSIKGPAAILNFPHLANSLPRPASLAPRDVQAAAAKAAHMDPSSLSSLVSAMDLSSASDELSQIIELPSLESTDDGSVDLKKEFVFVDSLDAWMYQPPFGFDTEQDTGFEGLMWNY

SEQ ID NO: 685 - DNA, 920 bp, Glycine max
  misc_feature: Ceres CLONE ID no.572121
  misc_feature: Encodes the peptide sequence at SEQ ID NO. 686
aacataagagaaggtttcgtggcagtggcgagtgaagaagctatgcctgatgagtgagtcatttttttctctctggtgggtcccatcctcttctgctctgagaacctttataagtgttatatgagtcattgagaagtgaccccaggaaaaagaaaagaaaagaaaaacttcacttcacttgcatgccaaatgagaacaacctcttcttagaataatttcctcggtgtttaagccttgtcgatttccgaacaccaatccgagttaattaaacaatgagagtttcgacagaaaagttagagacagagccggagagcaaaaagataaaacgcattcgtggcggcggcggcggggactcgagcaataagcaccctttgtaccgcggcgtgcggatgcggaactgggggaaatgggtgtcggaaatccgcgagccgcggaagaagtcgcggatatggctaggcacattcccgacgccggaaatggcggcgagggcgcacgacgtggcggctctcagcatcaaaggctccgccgccattctcaacttccctcactttgccaactcgctccctcgcccggcttctctcgcgccgcgcgacgttcaagccgcggcggccaaagcggcgcacatggacccttcttccctctcctcccttgtctccgcaatggacttgtcctctgcctctgacgagttgagccaaatcatagagcttccttctttggaaagcaccgatgatggctccgtcgtcttagagaaagagtttgtttttgttgactcccttgatgcttggatgtatcagccaccctttggttttgacaccgaacaagacactggtttcgagggtttgatgtggaattactagtttcgatccatgtttctgttctattctatgtcttatgttgtataaattaatattgatcgtcag

SEQ ID NO: 686 - protein, 194 aa, Glycine max
  misc_feature: Ceres CLONE ID no.572121
  misc_feature: Bit score of 120.6 for HMM based on sequences of FIGURE 8.
  misc_feature (33)..(84): Pfam Name: AP2 Pfam Description: AP2 domain
  misc_feature: Functional Homolog Of Ceres SEEDLINE ID no. ME15935 at SEQ ID NO. 644
MRVSTEKLETEPESKKIKRIRGGGGGDSSNKHPLYRGVRMRNWGKWVSEIREPRKKSRIWLGTFPTPEMAARAHDVAALSIKGSAAILNFPHFANSLPRPASLAPRDVQAAAAKAAHMDPSSLSSLVSAMDLSSASDELSQIIELPSLESTDDGSVVLEKEFVFVDSLDAWMYQPPFGFDTEQDTGFEGLMWNY

SEQ ID NO: 687 - DNA, 1189 bp, Zea mays
  misc_feature: Ceres CLONE ID no.1674836
  misc_feature: Encodes the peptide sequence at SEQ ID NO. 688
aatcatatttatatatatccaatccttcccacatcgcatccatccgctcagctcgatcgaacttcgcacacgcgtacattaattctcaggaacgtactggttggtggtggtagtagctactagctactataaactatggaccagatgctgggcaagcacctgcagatgccttccgtgactacgagcgccgcctgccagcagccgcagtcgccgccgccgtcgccgcagcagcagcagcagtaccggggcgtgcggaagcgcaagtggggcaagtgggtgtcggagatccggcagccgggcaccaagacgcgcatctggctcggcagcttcgagtcggccgagatggccgcggtggcgcacgacgtggcggcgctgcgcctgcggggccgcgacgcgcagctcaacttcccgggctgcgtcgcctggctaccccgcccggcgacctcgcacgcgcgcgacgtccgcgccgcggcggccgaggccgccgaccgcgtgcgctgcgacccggcgctgctgctgctccagcaggcggcggcggcgtcagcgcggtgccacgaccacaaccacgagttcggggccgggccggcgccggtggtcgagctcgggagcgacgaggagttcgagctggacctggactcgcccagcctctgggccgagatggccgaggccatgctcctggacccgccgggctgggccaccggcgtcgtcggcgacgcggcggaggtggccctgtgctggccacacggctccctctgggacgcctgctagctcggccaggcaccccggctctggctctgcctgcgagtgtttggccatggccgatgtggccaccggacgctgtttggtctcacaagtgtcgcagtgcttttggtgtgtgccactgtgagcgcgtctctgttgattctcccccgcgtgtggttttgctttacgtctgctgctgttgggcttgctgttttcgttcctgttatcatcttaccagtatcactaccattagctaggcaaaatgataacagtccagatcatctgaagacaaacaaaattagtacggctgtgccctgctgatactgatattatggtttggtctattcctgcattttgtactaatttgtgcagtcacattattcgagatgaccgtgcatgcaagtaccccacagaaaatgatcttgtattgtaaaaaaaaaaaaaaaaa

SEQ ID NO: 688 - protein, 200 aa, Zea mays
  misc_feature: Ceres CLONE ID no.1674836
  misc_feature: Bit score of 93.2 for HMM based on sequences of FIGURE 8.
  misc_feature (24)..(75): Pfam Name: AP2 Pfam Description: AP2 domain
  misc_feature: Functional Homolog Of Ceres SEEDLINE ID no. ME15935 at SEQ ID NO. 644
MPSVTTSAACQQPQSPPPSPQQQQQYRGVRKRKWGKWVSEIRQPGTKTRIWLGSFESAEMAAVAHDVAALRLRGRDAQLNFPGCVAWLPRPATSHARDVRAAAAEAADRVRCDPALLLLQQAAAASARCHDHNHEFGAGPAPVVELGSDEEFELDLDSPSLWAEMAEAMLLDPPGWATGVVGDAAEVALCWPHGSLWDAC

SEQ ID NO: 689 - DNA, 810 bp, Populus balsamifera subsp. trichocarpa
  misc_feature: Ceres ANNOT ID no.1486207
  misc_feature: Encodes the peptide sequence at SEQ ID NO. 690
atggaaaaacatatcatccttgagattgatgcacaagacaattcccttacatcatcttccacttccaccaccaccaccaccaccaccacttcttcctcctcctcttctttttctaccaccatttcatacactgatcgaatctcaaaaaaagaagagaattctattgctgatccaaagggatcgagaaaatctcaagagttgcaaagtggcaatgagggtaataaaaagcgaaagactaccagaaatgagaataatgggaagcatccaacatacagaggagtaagaatgaggagctggggcaaatgggtgtgtgagatcagagagccaaggaagaagtcaagaatatggcttggaacataccctacagccgaaatggctgctcgagcccatgatgtagccgccttagccattaaaggcggctcagcctacctcaatttccctgaattggttgatgaactgcctcgtccactcagcaagtctcctaaggacattcaagctgcagctgccaaggcagccgccgcttcattccccgaaacaagacactgtgaagcagaagctgaagctgaagctgatatgagccatgccgagcttaacgtttccaatttatcagataatttggccatggacaacatacaagagtcaagcagttctccttcaactgatgttgatgacaagttgtttgaccttcctgatctcttcatcgacggcgttaatcacagtgatggattttgttattattctccaccatggcaattatgttctgctgatactggcttccggcttgaagagccatttttatgggagtactag

SEQ ID NO: 690 - protein, 269 aa, Populus balsamifera subsp. trichocarpa
  misc_feature: Ceres ANNOT ID no.1486207
  misc_feature: Bit score of 154.6 for HMM based on sequences of FIGURE 8.
  misc_feature (89)..(140): Pfam Name: AP2 Pfam Description: AP2 domain
  misc_feature: Functional Homolog Of Ceres SEEDLINE ID no. ME15935 at SEQ ID NO. 644
MEKHIILEIDAQDNSLTSSSTSTTTTTTTTSSSSSSFSTTISYTDRISKKEENSIADPKGSRKSQELQSGNEGNKKRKTTRNENNGKHPTYRGVRMRSWGKWVCEIREPRKKSRIWLGTYPTAEMAARAHDVAALAIKGGSAYLNFPELVDELPRPLSKSPKDIQAAAAKAAAASFPETRHCEAEAEAEADMSHAELNVSNLSDNLAMDNIQESSSSPSTDVDDKLFDLPDLFIDGVNHSDGFCYYSPPWQLCSADTGFRLEEPFLWEY

SEQ ID NO: 691 - DNA, 705 bp, Panicum virgatum
  misc_feature: Ceres CLONE ID no.2023610
  misc_feature: Encodes the peptide sequence at SEQ ID NO. 692
  misc_feature (641)..(641): n is a, c, t, g, unknown, or other
gtctccaagctctctccactccccagcacaagtgcggagtgcccaacaacaactccaccgccgctccgcaccgcatatagcagcagccagcagccatggacacggacgacactcacgagcccgcctccccgacctccgcgtcctcgacgtcgtcgtcgtcgtctggctcgtcgtcctcccaggccccgaagaagcgggcgcgccaggacgggacccggcacccgacgtaccgcggcgtgcgcatgcggagctggggcaagtgggtgtccgagatcagggagccccgcaagaagtcgcgcatctggctgggcacgttcgccaccgcggagatggcggcgcgcgcgcacgacgtggccgcgctcgccatcaagggccgcgccgcgcacctcaacttcccggagcaggcgcacctgctcccgcgcccggccaccgcgtcccccaaggacgtgcaggccgccgccacgctcgccgcggccaccgacttccccgctccgccgccgccgccgccgttctccccctcccccggcggcgccaatgccaagagccccgagagcagcagctccgacggcgccagcgccgccgcctcgccgccccacgaggcgcccccgcaggacgccgagccggaccccgacgaggcgctngtcgacctcccggacctgctcctggacctgagatgctgcggcccgtcctcgtgggccgtcgacg

SEQ ID NO: 692 - protein, 203 aa, Panicum virgatum
  misc_feature: Ceres CLONE ID no.2023610
  misc_feature: Bit score of 124.1 for HMM based on sequences of FIGURE 8.
  misc_feature (43)..(94): Pfam Name: AP2 Pfam Description: AP2 domain
  misc_feature: Functional Homolog Of Ceres SEEDLINE ID no. ME15935 at SEQ ID NO. 644
  misc_feature (182)..(182): Xaa is any aa, unknown, or other
MDTDDTHEPASPTSASSTSSSSSGSSSSQAPKKRARQDGTRHPTYRGVRMRSWGKWVSEIREPRKKSRIWLGTFATAEMAARAHDVAALAIKGRAAHLNFPEQAHLLPRPATASPKDVQAAATLAAATDFPAPPPPPPFSPSPGGANAKSPESSSSDGASAAASPPHEAPPQDAEPDPDEAXVDLPDLLLDLRCCGPSSWAVD

SEQ ID NO: 693 - DNA, 786 bp, Populus balsamifera subsp. trichocarpa
  misc_feature: Ceres ANNOT ID no.1496976
  misc_feature: Encodes the peptide sequence at SEQ ID NO. 694
atggaaaaacatatcaaccttgagattgatgctcaagacaatccccttgcctcatcttccaccaccacctccaccaccaaggggaacatctcttcctcctccacgcccatttcatgcataaagcaccaaggctcaaagaaagaagagaattgtattgctccaagagtatcaagaaaagctcaagaattacagagtagtggcaacgagggtggtaaaaggcgaaagaccaccgagaatgagaaaaatgggaagcatccgacatatagaggagtgaggatgagaagttggggcaaatgggtgtccgaaatcagagagccaaggaagaagtcgagaatatggcttggaacataccctacagctgaaatggcagctcgagcacatgatgtagccgcgttagccatcaaagggggctcagcttatctcaattttcctgaattcgctcatgaactccctcccccactcagcaagtcccctaaggacattcaagctgcagccgccaaggcagcggctgcttcgttcactgaaacaagatactgtgaaggtgaaggtgggggcgaagccgagcttaacgtttcgaatttatcagatagtttggccatggacaacacacaagaatcaagcagttctccttctactgattctgatgacacgttatttgaccttcctgacctcttcatcgatggcgttcatcacagtgatggattttgctattattcttcatcatggcaattatgtgcagccgatactggcttccggcttggagagccatttttattggagtactag

SEQ ID NO: 694 - protein, 261 aa, Populus balsamifera subsp. trichocarpa
  misc_feature: Ceres ANNOT ID no.1496976
  misc_feature: Bit score of 136.2 for HMM based on sequences of FIGURE 8.
  misc_feature (86)..(137): Pfam Name: AP2 Pfam Description: AP2 domain
  misc_feature: Functional Homolog Of Ceres SEEDLINE ID no. ME15935 at SEQ ID NO. 644
MEKHINLEIDAQDNPLASSSTTTSTTKGNISSSSTPISCIKHQGSKKEENCIAPRVSRKAQELQSSGNEGGKRRKTTENEKNGKHPTYRGVRMRSWGKWVSEIREPRKKSRIWLGTYPTAEMAARAHDVAALAIKGGSAYLNFPEFAHELPPPLSKSPKDIQAAAAKAAAASFTETRYCEGEGGGEAELNVSNLSDSLAMDNTQESSSSPSTDSDDTLFDLPDLFIDGVHHSDGFCYYSSSWQLCAADTGFRLGEPFLLEY

SEQ ID NO: 695 - protein, 206 aa, Oryza sativa subsp. indica
  misc_feature: Public GI ID no.116310031
  misc_feature: Bit score of 131.7 for HMM based on sequences of FIGURE 8.
  misc_feature (16)..(66): Pfam Name: AP2 Pfam Description: AP2 domain
  misc_feature: Functional Homolog Of Ceres SEEDLINE ID no. ME15935 at SEQ ID NO. 644
MSDHGPASPRSSGKHPFYRGIRSRSGKWVSEIREPRKARRIWLGTFPTAEMAAVAYDVAARALRGPDAALNFPDLAASRTAPPASSSADDIRAAAAAAAASLQHDRAGGGIAPAASGSAHQQRGGSSAAARTTAGSGGAQQEGSSGAGAGSHQYFLDEEALFETPQFLRNMAAGMMMSPPRLSPSSSDDSPDPSEAGGSLWSYRDP

SEQ ID NO: 696 - DNA, 1166 bp, Glycine max
  misc_feature: Ceres CLONE ID no.1626363
  misc_feature: Encodes the peptide sequence at SEQ ID NO. 697
tcactcactcactctcacacgctcagaacgccactacgcaactatagtctatataaatatataccacacgcattacattctagcaccgagtagtaagtagaatccaaacattaagtactgttccttaacaaaaaaaaaaaacagaatggctgagctacctagctcagaagcatcgtcatcatccgcttccagtcggaagcactcgtcttcggaggcccatttacccgccccggatcagaaaaggcccaagcaggcccgagatagcagcagcaagcaccccgtctacagaggggtccgaatgcgggcctggggaaagtgggtatccgaaatacgcgagcccagaaagaagaaccggatctggctcggaacctttgccaccgccgagatggccgcacgtgcgcacgacgtggcggcgctcgccatcagaggcaactccgccattctcaacttcccagaactcgcggcctcccttccccgacccgactccaactcgccaagagacgttcaggccgccgccgccaaagccgccgccatggaggttaacgatgttccgacgacgccttcgtcttcgtcgtcgtcggcgtctctgtcgctatcgcaatcgtcatcttggtcttcattggcggtttcttcttcctccggcgatggcccgtcgacgccggaggagctgggggagatagtggagctgccgagtctggggacgagtttcgaaatacccgacccgagtggggagttggtgtatttggacccgtggccgtattctcaggcgtggagtcacggcatttatgatgagagtgaggggtattttattggggactctgagactgagagcatgatactttgtggcttcgagggttcattgtggcagcattaatgcttgtgctttccttttttttctttttttgtcttattgactttccaatgtgtgagagccctttcccaatttttcacttcaagggctgctaaatacattactactactactactactactactgttgtttccccaccttaggtttctcaatgtcatcctccttctccttccgcgtgttgcacaacacgacaggtatgcctgccatcctcctcaatattcaatgtcttgtttcatgtaatcaatgtaatgcaaatgatttatgctcaattcacaaaaaaaaaaaaaaaaaaaa

SEQ ID NO: 697 - protein, 242 aa, Glycine max
  misc_feature: Ceres CLONE ID no.1626363
  misc_feature: Bit score of 138.5 for HMM based on sequences of FIGURE 8.
  misc_feature (45)..(96): Pfam Name: AP2 Pfam Description: AP2 domain
  misc_feature: Functional Homolog Of Ceres SEEDLINE ID no. ME15935 at SEQ ID NO. 644
MAELPSSEASSSSASSRKHSSSEAHLPAPDQKRPKQARDSSSKHPVYRGVRMRAWGKWVSEIREPRKKNRIWLGTFATAEMAARAHDVAALAIRGNSAILNFPELAASLPRPDSNSPRDVQAAAAKAAAMEVNDVPTTPSSSSSSASLSLSQSSSWSSLAVSSSSGDGPSTPEELGEIVELPSLGTSFEIPDPSGELVYLDPWPYSQAWSHGIYDESEGYFIGDSETESMILCGFEGSLWQH

SEQ ID NO: 698 - DNA, 867 bp, Populus balsamifera subsp. trichocarpa
  misc_feature: Ceres ANNOT ID no.1483747
  misc_feature: Encodes the peptide sequence at SEQ ID NO. 699
atgactgatccgccgacttcgaactccaactccaagaaagactcttcaagcatttactcctactcctcctcttcgccaaccccatcttcaacatcttcatccgggttatcaccaaaccccgtatctaaacccgacccggaaaaaaacctgagaaaaccaaagaggccaagggaaactaacagtagcaacaacagcaagcacccggtgttcaggggggtacgaatgcggacatggggaaaatgggtgtcggagatccgggagcccagaaagaagaatcggatctggctaggaactttctccaccccagaaatggcagcacgtgcccatgacgttgcagccttgagcataaaaggcaactcagccatcctcaacttccccggactagccgggtcgcttccccgacccgcttctaactctccacgtgatgtccaagctgccgccgctaaagccgcttctatggacttcaacagtactgtcactacagtcaccaccaatgtctgcaacgacgaaaacaacagtaataataacagtacggccagtaataataatgggtcatcgtcctcacaaatgacacagtcctcctcctcctcctcctcctcctcatcttcaacagtaagggtgacaagtgacgtggcgactcctgaggaactgagtgagatagttgagctgccgagtttggaaacgagttacgaggaatctcccgagtttgttttatttggtgactcgtggccgtacattaatcaatcttggtgttatgaagattatggcgtgaagagtaatgggtattttagcgatcagtacttgtcaataattccagaaaataacgtaattactagtggttttgagactttattgtgggaacattaa

SEQ ID NO: 699 - protein, 288 aa, Populus balsamifera subsp. trichocarpa
  misc_feature: Ceres ANNOT ID no.1483747
  misc_feature: Bit score of 141.2 for HMM based on sequences of FIGURE 8.
  misc_feature (68)..(119): Pfam Name: AP2 Pfam Description: AP2 domain
  misc_feature: Functional Homolog Of Ceres SEEDLINE ID no. ME15935 at SEQ ID NO. 644
MTDPPTSNSNSKKDSSSIYSYSSSSPTPSSTSSSGLSPNPVSKPDPEKNLRKPKRPRETNSSNNSKHPVFRGVRMRTWGKWVSEIREPRKKNRIWLGTFSTPEMAARAHDVAALSIKGNSAILNFPGLAGSLPRPASNSPRDVQAAAAKAASMDFNSTVTTVTTNVCNDENNSNNNSTASNNNGSSSSQMTQSSSSSSSSSSSTVRVTSDVATPEELSEIVELPSLETSYEESPEFVLFGDSWPYINQSWCYEDYGVKSNGYFSDQYLSIIPENNVITSGFETLLWEH

SEQ ID NO: 700 - DNA, 597 bp, Populus balsamifera subsp. trichocarpa
  misc_feature: Ceres ANNOT ID no.1471330
  misc_feature: Encodes the peptide sequence at SEQ ID NO. 701
atggagcaaccaccatacactgaagatgacccgaccacaaactctccagaggcagccaccgccaaaacccaccaaaattctgagactccacggggcagcggcactcgaaatcctgtctatcgcggtgtccgaaaacggaggtgggggaaatgggtgtctgaaattagagagccacgcaagaaatcacgtatctggctaggctcatttcctgtgccagaaatggcagccaaggcatatgatgtggcagcgtattgtcttaaaggttgtaaagcgcagcttaattttcccgacgaagtggatgacttgcctagaccgtccacgtgtacggccagggacatccaagcagcagcagcaaaggcagcacattcagtgctgcttccaacgaaaaagagcatcgaaacaaatagtgataatagtgttgacggagaagttgccgatgatgatttctggggcgagatagaattgccggaattgttgacgagtaacagtgggtgctgttggaattcttgtggatggagtactacttttgcaagtgatagttcaacgtggcagcaggatggagagggtctaccacagttcatggcatgtctttattag

SEQ ID NO: 701 - protein, 198 aa, Populus balsamifera subsp. trichocarpa
  misc_feature: Ceres ANNOT ID no.1471330
  misc_feature: Bit score of 100.2 for HMM based on sequences of FIGURE 8.
  misc_feature (38)..(89): Pfam Name: AP2 Pfam Description: AP2 domain
  misc_feature: Functional Homolog Of Ceres SEEDLINE ID no. ME15935 at SEQ ID NO. 644
MEQPPYTEDDPTTNSPEAATAKTHQNSETPRGSGTRNPVYRGVRKRRWGKWVSEIREPRKKSRIWLGSFPVPEMAAKAYDVAAYCLKGCKAQLNFPDEVDDLPRPSTCTARDIQAAAAKAAHSVLLPTKKSIETNSDNSVDGEVADDDFWGEIELPELLTSNSGCCWNSCGWSTTFASDSSTWQQDGEGLPQFMACLY

SEQ ID NO: 702 - protein, 228 aa, Zea mays
  misc_feature: Ceres CLONE ID no.101144964
  misc_feature: Bit score of 106.1 for HMM based on sequences of FIGURE 8.
  misc_feature (91)..(142): Pfam Name: AP2 Pfam Description: AP2 domain
  misc_feature: Functional Homolog Of Ceres SEEDLINE ID no. ME15935 at SEQ ID NO. 644
MAQELHETSSCSATTTSSCTTSCCSSTVTDSSSSPPSPAAANAVPATRKRQAAEAEAEAEAEAGGEEEEGCAGNKAAPAKKRPRGSEGKHPTFRGVRMRAWGKWVSEIREPRKKSRIWLGTFPTAEMAARAHDVAALAIKGRAAHLNFPDLAGALPRAASAAPKDVQAAAALAAAFTSPSSEPGAGAHDEPAANDGAAPDVAAADAQAPVPVALPPPAASRPGTPSSG

SEQ ID NO: 703 - DNA, 702 bp, Populus balsamifera subsp. trichocarpa
  misc_feature: Ceres ANNOT ID no.1439439
  misc_feature: Encodes the peptide sequence at SEQ ID NO. 704
atgacgaaagaagaaagcagtaacaggtcatgtagttcaatatgtacaacatcgtcgtcgtcgtcgtcgtcgtttgccactaccatcaccaacaagctcaagaaacaaaacccagtggaccaaaaatcgagaaaggcgagagactgcagcaagcacgcagtttataggggtgttagaaggcgagcctggggcaaatgggtgtccgaaatccgccaacctcgcaagaaatcacgtatttggctcggaacattccccacgccagaaatggcagctcgtgctcacgacgtggctgccctgagtattaaaggtgactctgccattttgaattttccagaacttgctgcctcattaccgcgcccagtgtcattaatgccacgtgacattcaagcagctgcggcgaaagctgctgccatggtcgactttaactcatcgtcaccaccctcatcattgtcgtcgtcatcggtatcggtgtctgaagatgtggcagaatccgaggaagaatacttgagtgaaatcgtggagttaccgaatatagaaggaagctttgactcccctgatcagtcacaaaccgagttcatgttgtttgactcggttgataggtgggtgtatccaccactagacttgagtggagaattttgcgatcagttactgggcctggagagcttgattccgagcaactttggaggatctgagttgaattaa

SEQ ID NO: 704 - protein, 233 aa, Populus balsamifera subsp. trichocarpa
  misc_feature: Ceres ANNOT ID no.1439439
  misc_feature: Bit score of 136.4 for HMM based on sequences of FIGURE 8.
  misc_feature (53)..(104): Pfam Name: AP2 Pfam Description: AP2 domain
  misc_feature: Functional Homolog Of Ceres SEEDLINE ID no. ME15935 at SEQ ID NO. 644
MTKEESSNRSCSSICTTSSSSSSSFATTITNKLKKQNPVDQKSRKARDCSKHAVYRGVRRRAWGKWVSEIRQPRKKSRIWLGTFPTPEMAARAHDVAALSIKGDSAILNFPELAASLPRPVSLMPRDIQAAAAKAAAMVDFNSSSPPSSLSSSSVSVSEDVAESEEEYLSEIVELPNIEGSFDSPDQSQTEFMLFDSVDRWVYPPLDLSGEFCDQLLGLESLIPSNFGGSELN

SEQ ID NO: 705 - DNA, 591 bp, Zea mays
  misc_feature: Ceres CLONE ID no.1446565
  misc_feature: Encodes the peptide sequence at SEQ ID NO. 706
ataacaaactcttttagtgttacaagaaagaatgaaactatctccaccacaaccaccagcacttaataacaacgacccaacagccgctgcttctgccgttaaatcttgcggcggaggtggtggagaaaccttctcgacgacgaggcatccagtgtaccacggagttcgcaaacgccgatggggaaagtgggtttccgagattagagagccccggaaaaaatctaggatttggctcggatcttttccggtgccggagatggcagctaaagcctacgacgtggccgcgctttgtctgaaaggaagaaaagctcagcttaatttccccgacgaaatcgacgatcttcctcgaccttcgacatgtacggccagggatatccaagtcgccgcggccaaagctgccaacgccgtcaagatcactaaaacgggagatgacgtggcagatatcgacgacggagatgatttctggtcaggcatagagctgcccgagcttattatgaccggaagtgggtggtcaccggagcttttcgtttccggagaagatgccacgtgggtggtcgacggtgactcgtatcagtatcagttcatggcgtg

SEQ ID NO: 706 - protein, 186 aa, Zea mays
  misc_feature: Ceres CLONE ID no.1446565
  misc_feature: Bit score of 104.1 for HMM based on sequences of FIGURE 8.
  misc_feature (40)..(91): Pfam Name: AP2 Pfam Description: AP2 domain
  misc_feature: Functional Homolog Of Ceres SEEDLINE ID no. ME15935 at SEQ ID NO. 644
MKLSPPQPPALNNNDPTAAASAVKSCGGGGGETFSTTRHPVYHGVRKRRWGKWVSEIREPRKKSRIWLGSFPVPEMAAKAYDVAALCLKGRKAQLNFPDEIDDLPRPSTCTARDIQVAAAKAANAVKITKTGDDVADIDDGDDFWSGIELPELIMTGSGWSPELFVSGEDATWVVDGDSYQYQFMA

SEQ ID NO: 707 - DNA, 1023 bp, Gossypium hirsutum
  misc_feature: Ceres CLONE ID no.1951962
  misc_feature: Encodes the peptide sequence at SEQ ID NO. 708
gctggttgtttccttccactttccctctctttcctttctctctttcctctcatttcctgttttttttttcctctcttagaaaatccaccaagaaaaaaaaaaacctaactgcatttcttgtcttcataaactcatagaaacttgcatgatttacgtagtaatttagcattatattgaatttttgtttgttaaaaaaaggcaatggctgactcaccaaactctgaaactgagttgatcactcgcagcaataagtcttatgatggtaaacagagatcgggaactgacccgatacccgaaaagcgtcgtccgagggatagtattagtaaacatccggtttaccgtggggtccgaatgcgggcgtggggtaaatgggtatccgaaattcgtgagccccgaaagaagaaccggatctggttaggtactttctcgacgccggaaatggctgcacgtgctcacgacgttgccgcgttgagcatcaagggtaactcggcgatcctcaacttccctgaattcgctgagttgttgccgcgtccggtttctaactctccccgtgatgtccaagccgccgccgctaaagcagccgcaatggagtttttaagtaataatactaataacaacgtcgatgctacgacgtcgtttttgtcttcttcgtcttcgtcatcgatgaacatggatgaagtgtcgacacctgaggagctgagccagatagtggagttgccgagtttagggacaagttacgaatctgttgagtcagggaccgagttcgtgtgcatggacccggttgacgggtggctgttgaatcccagtggcatgccttggtattatgaagataataatgggtatttcggggatgaaattccaatgcaaatgcaagaaaatacaattacaaatgggtttagtcctttaccatggaatcattaaggtcaaattatgtccttagtctatgaaaaattttgaaatttagtatttaaattaaaaaaatttaaattcttttaagattttcaaaaaaaaaaaaaaaaaaaa

SEQ ID NO: 708 - protein, 239 aa, Gossypium hirsutum
  misc_feature: Ceres CLONE ID no.1951962
  misc_feature: Bit score of 119.7 for HMM based on sequences of FIGURE 8.
  misc_feature (44)..(95): Pfam Name: AP2 Pfam Description: AP2 domain
  misc_feature: Functional Homolog Of Ceres SEEDLINE ID no. ME15935 at SEQ ID NO. 644
MADSPNSETELITRSNKSYDGKQRSGTDPIPEKRRPRDSISKHPVYRGVRMRAWGKWVSEIREPRKKNRIWLGTFSTPEMAARAHDVAALSIKGNSAILNFPEFAELLPRPVSNSPRDVQAAAAKAAAMEFLSNNTNNNVDATTSFLSSSSSSSMNMDEVSTPEELSQIVELPSLGTSYESVESGTEFVCMDPVDGWLLNPSGMPWYYEDNNGYFGDEIPMQMQENTITNGFSPLPWNH

SEQ ID NO: 709 - protein, 237 aa, Zea mays
  misc_feature: Ceres CLONE ID no.100960656
  misc_feature: Bit score of 109.8 for HMM based on sequences of FIGURE 8.
  misc_feature (93)..(144): Pfam Name: AP2 Pfam Description: AP2 domain
  misc_feature: Functional Homolog Of Ceres SEEDLINE ID no. ME15935 at SEQ ID NO. 644
MAQELHETSSCSATTTSSCTTSCCSSTVTDSSSSPPSPAAANAAPATRKRQALEAEAEAEAGGEEEEEEEEGCAGNKAAPAKKRPRGSEGKHPTFRGVRMRAWGKWVSEIREPRKKSRIWLGTFPTAEMAARAHDVAALAIKGRAAHLNFPDLAGALPRAASAAPKDVQAAAALAAAFTSPSSEPGAGAHEEPAAKDGAAPEEAAADAQAPVPVALPPPAASRPGTPSSGVEDERQL

SEQ ID NO: 710 - DNA, 1030 bp, Zea mays
  misc_feature: Ceres CLONE ID no.285154
  misc_feature: Encodes the peptide sequence at SEQ ID NO. 711
aggtctctagtctccactccgctgtcgctccggcccagcagctcgaccaccaccgctccgcaggcaggaagccgccaaggacatggacgacgctcaggagcctccctcccctccctccccctcgcagtcatcctcctcctcttcctcgtcgtcctccgtggccccgaacccgaagaagcgggcgcgcaaggacggcagccggcacccgacgtaccgcggcgtgcgcatgcggagctggggcaagtgggtgtcggagatcagggagccccgcaagaagtctcgcatctggctgggcaccttcgccaccgcggagatggcggcgcgcgcgcacgacgtggccgcgctcgccatcaagggcgcgcgcgacgcgcacctcaacttcccgggcctcgcgcacctgctcccgcgcccggccaccgcggcgcccaaggacgtgcaggccgcggccgcgctcgccgcggccgccgacttccctctgccgccgtcccccggcggcgccaatgccaagagccccgagagcagcagctccggctccgcctccgcctccgcctccgacgacgccagcgccgcctcgccggcggcgccgcaggacgccgagcccaacccggacgacgcgctgttcgacctcccggacctgcttctggacctgagatgctgcgggccgtcgtcgtgggccgtcgacgacgacgtggccggcggcggcgcgttccggatcatcgaggagccgctgctgtgggagtactgaactgatcaatgccaccgcgccagtcctgtccttgagcggttggcagtgatcagcgagttcatgcatcggtagctgttgagtgttagatcgaccggacggacacatgtaaatgcagctccttccgctcctctgtttcgtgctctggattactctgctgtttcttctctttatgccagatttaggtgccgcgcttgtataaagttagttcctttttttccctccttctcttgcttgatttggaagacaagaatatgtataaccataagaagcatcttatcttgtgcc

SEQ ID NO: 711 - protein, 220 aa, Zea mays
  misc_feature: Ceres CLONE ID no.285154
  misc_feature: Bit score of 141.1 for HMM based on sequences of FIGURE 8.
  misc_feature (42)..(93): Pfam Name: AP2 Pfam Description: AP2 domain
  misc_feature: Functional Homolog Of Ceres SEEDLINE ID no. ME15935 at SEQ ID NO. 644
MDDAQEPPSPPSPSQSSSSSSSSSSVAPNPKKRARKDGSRHPTYRGVRMRSWGKWVSEIREPRKKSRIWLGTFATAEMAARAHDVAALAIKGARDAHLNFPGLAHLLPRPATAAPKDVQAAAALAAAADFPLPPSPGGANAKSPESSSSGSASASASDDASAASPAAPQDAEPNPDDALFDLPDLLLDLRCCGPSSWAVDDDVAGGGAFRIIEEPLLWEY

SEQ ID NO: 712 - protein, 223 aa, Lolium perenne
  misc_feature: Public GI ID no.61968916
  misc_feature: Bit score of 182.6 for HMM based on sequences of FIGURE 8.
  misc_feature (51)..(104): Pfam Name: AP2 Pfam Description: AP2 domain
  misc_feature: Functional Homolog Of Ceres SEEDLINE ID no. ME15935 at SEQ ID NO. 644
MCQIKKEMSGESGSPCNGEYCSPSTSSEQKQQTVWTKRPAGRTKFRETRHPVYRGVRRRGNAGRWVCEVRVPGRRGSRLWVGTFDTAEIAARAHDAAMLALAAGDVCLNFADSAELLDMPASSYRSLDEVRHAVTEAVEEFERRQALGEEDALSGTESSTLTDDEESSTPFELDVLSDMGWDLYYASLAQGMLMSSPFLAASAALGDYGEANLADVPLWSYLS

SEQ ID NO: 713 - protein, 242 aa, Lolium perenne
  misc_feature: Public GI ID no.118026854
  misc_feature: Bit score of 171.4 for HMM based on sequences of FIGURE 8.
  misc_feature (45)..(98): Pfam Name: AP2 Pfam Description: AP2 domain
  misc_feature: Functional Homolog Of Ceres SEEDLINE ID no. ME15935 at SEQ ID NO. 644
MDMTGSEQWSSPSLSSSSQEQGVPVWVTPPKRPAGRTKFKETRHPVYRGVRRRGNAGRWVCEVRVPGQRGERLWLGTYLTAESAARAHDAAMLGLLGHSASSTCLNFADSAWLLDLPPTLSDLAHVRRAALAAVAGFLRQEADSGAATVRADEAAYSASVPSSVDNAGGLSATSQPYADGMFELPSALNSDMFELDMSGEMDLGTYYAGLAEGLLLDPPPPEHTSACWDTGDGGADSALWSY

SEQ ID NO: 714 - protein, 241 aa, Triticum monococcum
  misc_feature: Public GI ID no.63098612
  misc_feature: Bit score of 158.8 for HMM based on sequences of FIGURE 8.
  misc_feature (37)..(90): Pfam Name: AP2 Pfam Description: AP2 domain
  misc_feature: Functional Homolog Of Ceres SEEDLINE ID no. ME15935 at SEQ ID NO. 644
MDMTGSDQQRSSPSSPSSSSHLKRPAGRTKFKETRHPVYRGVRRRGSAGRWVCEVRVPGKRGERLWLGTHLTAEAAARAHDAAMLGLIGPSTPCLNFADSAWLLAVPSALSDFADVRRAALSAVADFQRREAASGAATTSLAATVPVDDGSCSQSAQSSMENTGSSWTSSSSSLPSGDGMFAVPATLGCNMFELDMSGEMDLDTYYAYFAEGLLLEPPQPPVAGACWDTEGGGADAALWSY

SEQ ID NO: 715 - DNA, 849 bp, Populus balsamifera subsp. trichocarpa
  misc_feature: Ceres ANNOT ID no.1522310
  misc_feature: Encodes the peptide sequence at SEQ ID NO. 716
atggcaaatactaattcaaatgtgcctcaagctgaccagtcaccaccacctcaaccttcaaacccatccatacaagtccctgaccctccatcctctattctgctcccaatcctccaagatgatcaatatgcacctcattccacctcctcgaacaagtctccaagattaattccttctccagctggatctctgggtcaaccattaacggtgagacaggatgaatattcaccaaggttcgggtttccaggccaacctgtgagtggaaggcaggatgaccaatcaccaaggtccaaccgatcctcaggtgggtcatcgactcagcccacaagcggaagacacccgagttataagggaattaggttacggagcgggaaatgggtatctgagatccgggaaccacgtaaaactacgcgtgtatggcttggtacgtatccaactcctgaaatggcagccgccgcttatgatgcggcggctctagcccttaaaggccctgatacaccactaaatttcccggaatcgattctttcctacccaataccagcctcagcatcctctagtgatataagggctgcagctgctagtgcagcatcaagcaggtcgccgagacctgaagctgggccaaatcctgaatgggaccggcttgaaacagaaggcacatcatccagtactaccactgctgacattcaatcaggacaggaattcatcgacgaggaagaacttttgaacctgcccaatttgctagttgacatggcaggaggaatgcttgtaagtccaccaagaataaacacgccatcttctgatgattcaccagggaattccgatgcagaaaacctatggtcctaccactaa

SEQ ID NO: 716 - protein, 282 aa, Populus balsamifera subsp. trichocarpa
  misc_feature: Ceres ANNOT ID no.1522310
  misc_feature: Bit score of 157.2 for HMM based on sequences of FIGURE 8.
  misc_feature (114)..(164): Pfam Name: AP2 Pfam Description: AP2 domain
  misc_feature: Functional Homolog Of Ceres SEEDLINE ID no. ME15935 at SEQ ID NO. 644
MANTNSNVPQADQSPPPQPSNPSIQVPDPPSSILLPILQDDQYAPHSTSSNKSPRLIPSPAGSLGQPLTVRQDEYSPRFGFPGQPVSGRQDDQSPRSNRSSGGSSTQPTSGRHPSYKGIRLRSGKWVSEIREPRKTTRVWLGTYPTPEMAAAAYDAAALALKGPDTPLNFPESILSYPIPASASSSDIRAAAASAASSRSPRPEAGPNPEWDRLETEGTSSSTTTADIQSGQEFIDEEELLNLPNLLVDMAGGMLVSPPRINTPSSDDSPGNSDAENLWSYH

SEQ ID NO: 717 - DNA, 914 bp, Gossypium hirsutum
  misc_feature: Ceres CLONE ID no.1854375
  misc_feature: Encodes the peptide sequence at SEQ ID NO. 718
gttataacaaactttgcttagttcttattccgtcatgtctaccaccgcctccacttccacttcttcctccaccggattttcatttccgggttttcggaaaaacaagaaaacttcaaaaaacagtgtagctcctcaagagtcgaagaaagctggagattactcggaagagaatggtaatgggaagaagaaaagaggcatgattagtgaagatggtggtagtaagcatccgacatatcggggagtacgtatacgaagctggggcaaatgggtgtctgaaatccgagagccaaggaagaaatcaagaatatggctgggaacatactccacagctgaaatggctgctcgagcccatgatgtggccgcactggccattaaaggccacaaggcttaccttaatttccctcaacttgcaaaggaacttccacgccctgcaagtacgtctcccaaggacatccaagcagccgcttcccaagcagcttcttcaacatttctggagacaagacgatgcaccattgaagacgaagctggaccaaaccaggaagaaatccctgtttcacattcatcattcacttcagcagcctccgataccttacaagaatcatcaacttcactcttcacccatgacgacgacacggtgtttgatctgcctgatctcatgattgattgctcttattcttcagcatggcaaatatgtgcagtcgatgctgtgttccggactgaggagccattcgtctgggattactactaggagagacgacatcatttcggtacatggaatcttcataaataaatataaacgatttaaaagtagtgaattccatatttgtgagtgtaattagtgttaactacacttaaggccaacttttgtttagcaaatacaagccacgttgctataaaaaaaaaaaaaaaaaaaa

SEQ ID NO: 718 - protein, 237 aa, Gossypium hirsutum
  misc_feature: Ceres CLONE ID no.1854375
  misc_feature: Bit score of 144.1 for HMM based on sequences of FIGURE 8.
  misc_feature (65)..(116): Pfam Name: AP2 Pfam Description: AP2 domain
  misc_feature: Functional Homolog Of Ceres SEEDLINE ID no. ME15935 at SEQ ID NO. 644
MSTTASTSTSSSTGFSFPGFRKNKKTSKNSVAPQESKKAGDYSEENGNGKKKRGMISEDGGSKHPTYRGVRIRSWGKWVSEIREPRKKSRIWLGTYSTAEMAARAHDVAALAIKGHKAYLNFPQLAKELPRPASTSPKDIQAAASQAASSTFLETRRCTIEDEAGPNQEEIPVSHSSFTSAASDTLQESSTSLFTHDDDTVFDLPDLMIDCSYSSAWQICAVDAVFRTEEPFVWDYY

SEQ ID NO: 719 - DNA, 1199 bp, Glycine max
  misc_feature: Ceres CLONE ID no.709819
  misc_feature: Encodes the peptide sequence at SEQ ID NO. 720
taccacaataatcaaagtctcaaccatgagaaaacgtatcaatatggaaagtgatgctgacttcaattcctttgccacatcctcctcttccaccacaccttcaatcttctttgacactaacacttctagcacatcctcctcctcaacatctcctacctcaaattcagaatcatgcaccaaagaacactccaaaacacctcaaaatgactcaaccacttctcaaacctcattggaaaatggaaaggactcaaaagggtgcaagaagaggcagatagacaatagcaaccagaatcaccaccctacttataggggtgtaaggatgaggaattggggcaaatgggtgtccgaaatccgtgagccgagaaagaagtcaagaatatggctaggaacataccctacagcagaaatggcagctagagcacatgatgtggctgccttagccatcaagggccattcagcatacctcaattttcctgaattggctcaagagcttccaaggccagttagcacatctcctaaggacattcaagctgcagctgcaaaagctgcaaatactgcctttgaggaggttaggcattgtcaaataactgaagaagaagcagaacaaaaccaagcagaacaagcttcatcttcaactctctcaatggacaatcctcaagagccttcaagttctcattctaccattgatgatgacactttgtttgaccttccagatcttttccctgatggaaacaatggactttgctccttttcttcttcttggcatttgtgtgcagttgatagtggctttaggcttgaggagtcatttttttatgagaaccattagaatttagaggctttttattttctttttaattcaagtaaaatacagagtttaataagaccaaaaggaaggagagcaacatgcggagtttttcttctttgtttggtcactgcaactgcattctgcgcagagaataaccagttgaggaagactttacatttttatctgtaaatggtgctgtctattgctaatattttgtccgatatagtttttttttctattttggggaataaaggtttaggtgagccgtgagcaaagactattccatcatcaagtaagttacgtattcaactaggagtgcataacatctgagacaaggtttctcttctactgtatatgaaaggtatttatgatttgagagaatatcctttcctct

SEQ ID NO: 720 - protein, 266 aa, Glycine max
  misc_feature: Ceres CLONE ID no.709819
  misc_feature: Bit score of 154.5 for HMM based on sequences of FIGURE 8.
  misc_feature (92)..(143): Pfam Name: AP2 Pfam Description: AP2 domain
  misc_feature: Functional Homolog Of Ceres SEEDLINE ID no. ME15935 at SEQ ID NO. 644
MRKRINMESDADFNSFATSSSSTTPSIFFDTNTSSTSSSSTSPTSNSESCTKEHSKTPQNDSTTSQTSLENGKDSKGCKKRQIDNSNQNHHPTYRGVRMRNWGKWVSEIREPRKKSRIWLGTYPTAEMAARAHDVAALAIKGHSAYLNFPELAQELPRPVSTSPKDIQAAAAKAANTAFEEVRHCQITEEEAEQNQAEQASSSTLSMDNPQEPSSSHSTIDDDTLFDLPDLFPDGNNGLCSFSSSWHLCAVDSGFRLEESFFYENH

SEQ ID NO: 721 - protein, 287 aa, Oryza sativa subsp. japonica
  misc_feature: Public GI ID no.115447695
  misc_feature: Bit score of 163.8 for HMM based on sequences of FIGURE 8.
  misc_feature (97)..(148): Pfam Name: AP2 Pfam Description: AP2 domain
  misc_feature: Functional Homolog Of Ceres SEEDLINE ID no. ME15935 at SEQ ID NO. 644
MEAAAIHAPTTTTSSDSGSCVTNGTREKREISKHKQLKRKRSTSPAPPPGCGGGQGQEAAVETDADAGAAGEEESSSCGGAGAGEGERKRGDAGRHPSYRGVRRRSWGKWVSEIREPRKKSRIWLGTFPTAEMAARAHDVAALAIKGRAAHLNFPSLAHTLPRPASTSPSDIQAAAALAAAAAATDQCESSSSAVAAATATDAEAAESTSSAAASPCAATSSVEENALFDLPDLLLDLSDGLWCSPVWTTAPADQYDAGDDGDDAAAPLLWAEQCWMDAPAAPVQPD

SEQ ID NO: 722 - DNA, 815 bp, Panicum virgatum
  misc_feature: Ceres CLONE ID no.1726356
  misc_feature: Encodes the peptide sequence at SEQ ID NO. 723
atcgcaaaaaccactcgagcacaaccggaagaggcactccagagctaagcgttcgatcgacagccgatccagaacaagatgtgtcagatgaagatggagatgggcgccgagccgtcgggctcgccctcgacctcggagcaggagcaccaccggacggtgtggacgtcgccgccgaagcggccggcggggcggaccaagttccgggagacgcggcaccccgtgttccgcggcgtgcggcgccggggcaacgccgggcggtgggtgtgcgaggtgcgcgtgccgggccgccgcggctgcaggctctggctcggcaccttcgacgccgccgaggccgcggcgcgcgcgcacgacgccgccatgctcgccgtctcgggcccgggtgcgtgcctcaactttgcggactcggcgtggttgctcgcggtcccggcctcgtacgccagcctcgccgaggtgcgccgcgcggtcgccaaggccgtggaggagttccagcaccgggaggcgctcccggaggaggaggaggacgcgcgctcggccacgtcgtcgacgctgtcctcccccgccagcggcgaagacgaggcctccaccgacgaggacggggaggagtcctcgccggccgccgaggactcgccgttcgaactggacctgttcggtggcttgagctcggacttgtactacgcgagcttggcgcaggcgatgctcatggagccaccgtccacagtcgcggcgttctgcgacgagggcatggccgatgtgcctctctggagctattaggatcgaggccgccgctgggcttcattttccgccttttctttctc

SEQ ID NO: 723 - protein, 230 aa, Panicum virgatum
  misc_feature: Ceres CLONE ID no.1726356
  misc_feature: Bit score of 194.6 for HMM based on sequences of FIGURE 8.
  misc_feature (47)..(100): Pfam Name: AP2 Pfam Description: AP2 domain
  misc_feature: Functional Homolog Of Ceres SEEDLINE ID no. ME15935 at SEQ ID NO. 644
MCQMKMEMGAEPSGSPSTSEQEHHRTVWTSPPKRPAGRTKFRETRHPVFRGVRRRGNAGRWVCEVRVPGRRGCRLWLGTFDAAEAAARAHDAAMLAVSGPGACLNFADSAWLLAVPASYASLAEVRRAVAKAVEEFQHREALPEEEEDARSATSSTLSSPASGEDEASTDEDGEESSPAAEDSPFELDLFGGLSSDLYYASLAQAMLMEPPSTVAAFCDEGMADVPLWSY

SEQ ID NO: 724 - DNA, 930 bp, Panicum virgatum
  misc_feature: Ceres CLONE ID no.1762419
  misc_feature: Encodes the peptide sequence at SEQ ID NO. 725
atcgcaaaaaccactcgagcacaaccggcagaggcactccagagctaagcgttcgatcgacagccgatccagaacaagatgtgtcagatgaagatgaagatgaagatgaagatggagatgggcgccgagccgtcgggctcgccctcgacctcggagcaggagcaccaccggacggtgtggacgtcgccgccgaagcggccggcggggcggaccaagttccgggagacgcggcaccccgtgttccgcggcgtgcggcgccggggcaacgccgggcggtgggtgtgcgaggtgcgcgtgccgggccgccgcggctgcaggctctggctcggcaccttcgacgccgccgatgccgcggcgcgcgcgcacgacgccgccatgctcgccatcgcgggcccgggcgcctgcctcaacttcgcggactcggcgtggttgctcgcggtcccggcctcgtacgccagcctccccgaggtgcgccgcgcggtcgccgaggccgtggaggagttccagcgccgggaggcgctcccggaggaggaggacgcgcgctcggccacgtcgttgacgccgtcctcccccgccagcggcgaagacgaagcctccaccgacgaggacggggaggagtcctcgccggccgccgaggactcgccgttcgaactggacctgttcggtggcttgagctcggacttgtactacgcgagcttggcacaggcgatgctcatggagccaccgtccacagtcgcggcgttctgcgacgagggcatggccgatgtgcctctctggagctattaggacagaggccgccgctgggcttcaattttccgccttttctttctcttggactatccgaagccaaattttggtattgtaacggttactacttctggtaatgagacagagcaacttgggacagtagaaaaaaaaaaaaaaaaaaaa

SEQ ID NO: 725 - protein, 230 aa, Panicum virgatum
  misc_feature: Ceres CLONE ID no.1762419
  misc_feature: Bit score of 192.4 for HMM based on sequences of FIGURE 8.
  misc_feature (48)..(101): Pfam Name: AP2 Pfam Description: AP2 domain
  misc_feature: Functional Homolog Of Ceres SEEDLINE ID no. ME15935 at SEQ ID NO. 644
MKMKMKMEMGAEPSGSPSTSEQEHHRTVWTSPPKRPAGRTKFRETRHPVFRGVRRRGNAGRWVCEVRVPGRRGCRLWLGTFDAADAAARAHDAAMLAIAGPGACLNFADSAWLLAVPASYASLPEVRRAVAEAVEEFQRREALPEEEDARSATSLTPSSPASGEDEASTDEDGEESSPAAEDSPFELDLFGGLSSDLYYASLAQAMLMEPPSTVAAFCDEGMADVPLWSY

SEQ ID NO: 726 - protein, 246 aa, Triticum monococcum
  misc_feature: Public GI ID no.63098606
  misc_feature: Bit score of 188.2 for HMM based on sequences of FIGURE 8.
  misc_feature (46)..(99): Pfam Name: AP2 Pfam Description: AP2 domain
  misc_feature: Functional Homolog Of Ceres SEEDLINE ID no. ME15935 at SEQ ID NO. 644
MDMGLEVSSSSPSSSSASSSPEHAAGRASLAKRPAGRTKFRETRHPVYRGVRRRGNAERWVCEVRVPGKRGARLWLGTYATAEIAARANDAAMLALGGRSAACLNFADSAWLLAVPPALADLGDVRRAAVEAVADFQRREAANGSLTVTATVTEEASCGAPEESSSESDSVGSSETSEPSADGEFEVPVAVDTDMFRLDLFPELDLCSYYASLAEALLVDPPAPVTTTYAYWDNGDGGADVALWSY

SEQ ID NO: 727 - DNA, 934 bp, Panicum virgatum
  misc_feature: Ceres CLONE ID no.1766572
  misc_feature: Encodes the peptide sequence at SEQ ID NO. 728
atcgcaaaaaccactcgagcacaaccggcagaggcactccagagctaagcgttcgatcgacagccgatccagaacaagatgtgtcagatgaagatgaagatgaagatgaagatgaagatggagatgggcgccgagccgtcgggctcgccctcgacctcggagcaggagcaccaccggacggtgtggacgtcgccgccgaagcggccggcggggcggaccaagttccgggagacgcggcaccccgtgttccgcggcgtgcggcgccggggcaacgccgggcggtgggtgtgcgaggtgcgcgtgccgggccgccgcggctgcaggctctggctcggcaccttcgacgccgccgatgccgcggcgcgcgcgcacgacgccgccatgctcgccatcgcgggcccgggcgcctgcctcaacttcgcggactcggcgtggttgctcgcggtcccggcctcgtacgccagcctcaccgaggtgcgccgcgcggtcgccgaggccgtggaggagttccagcgccgggaggcgctcccggaggaggaggaggaggacgcgcgctcggccacgtcgtcgacgccgtcctcccccgccagcggcgaagacgaggcctccaccgacgaggacggggaggagtcctcgccggccgccgaggactcgccgttcgaactggacctgttcggtggcttgagctcggacttgtactacgcgagcttggcgcaggcgatgctcatggagccaccgtccacagtcgcggcgttctgcgacgagggcatggccgatgtgcctctctggagctattaggacagaggccgccgctgggcttcaattttccgccttttctttctcttggactatccgaagccaaattttggtactgtaacggttactacttgtggtaatgagacagagcaacttggaaaaaaaaaaaaaaaaaaaa

SEQ ID NO: 728 - protein, 239 aa, Panicum virgatum
  misc_feature: Ceres CLONE ID no.1766572
  misc_feature: Bit score of 193.4 for HMM based on sequences of FIGURE 8.
  misc_feature (55)..(108): Pfam Name: AP2 Pfam Description: AP2 domain
  misc_feature: Functional Homolog Of Ceres SEEDLINE ID no. ME15935 at SEQ ID NO. 644
MCQMKMKMKMKMKMEMGAEPSGSPSTSEQEHHRTVWTSPPKRPAGRTKFRETRHPVFRGVRRRGNAGRWVCEVRVPGRRGCRLWLGTFDAADAAARAHDAAMLAIAGPGACLNFADSAWLLAVPASYASLTEVRRAVAEAVEEFQRREALPEEEEEDARSATSSTPSSPASGEDEASTDEDGEESSPAAEDSPFELDLFGGLSSDLYYASLAQAMLMEPPSTVAAFCDEGMADVPLWSY

SEQ ID NO: 729 - DNA, 905 bp, Zea mays
  misc_feature: Ceres CLONE ID no.281871
  misc_feature: Encodes the peptide sequence at SEQ ID NO. 730
aaatcgaaaaccactcgaacacaaactcaggcaaggcaaaaggaacccgcaccatccgaggctcaagcagggaagtgatcatcatcatcatcagaagaagatgtgcccaaccaagaaggggatgaccggagagccgagctcgccatgcagctcggcatcagcctcgaccttaccggagcaccaccagacggtgtggacgtcgccgccgaagcggccagcggggcggaccaagttccgggagacgcggcacccggtgttccgcggcgtccggcgccggggcagcgccgggcggtgggtgtgcgaggtgcgcgtgccggggaggcgcggctgcaggctctggctcggcaccttcgacacggccgaggcggcggcccgcgcgcacgacgccgccatgctcgccctcgccggcgcgggcgcctgctrcctcaacttcgccgactcggcctggctcctcgcggtcccggcctcgtgcgccagcctcgccgaggtccgccacgcggtcgcggacgccgtggaggacttcctccgccatcaggtggtcccggaggacgacgccctcgcggccacgccgtcgtcgccttccagcgaagacggcagcacctctgatggcggggagtcctcctctgattcctctccgcccacacggggcctcgccgttcgaattggatgtgttcaacgacatgagctgggacctgcactacgcgagcttggcgcagggattgctcgtggagccaccgtccgcggtcacsgcgctcatggacgaaggcttcgccgatgtgccgctctggagctactagagactctgaaattttccgtttctttgcttggcctctggtgcctaattttggcagtgtaaaacggtttcttcttttggtaatgagatggaatcatggaacaagtttgcg

SEQ ID NO: 730 - protein, 251 aa, Zea mays
  misc_feature: Ceres CLONE ID no.281871
  misc_feature: Bit score of 141.4 for HMM based on sequences of FIGURE 8.
  misc_feature (51)..(104): Pfam Name: AP2 Pfam Description: AP2 domain
  misc_feature: Functional Homolog Of Ceres SEEDLINE ID no. ME15935 at SEQ ID NO. 644
  misc_feature (108)..(108): Xaa is any aa, unknown, or other
  misc_feature (217)..(217): Xaa is any aa, unknown, or other
MCPTKKGMTGEPSSPCSSASASTLPEHHQTVWTSPPKRPAGRTKFRETRHPVFRGVRRRGSAGRWVCEVRVPGRRGCRLWLGTFDTAEAAARAHDAAMLALAGAGACXLNFADSAWLLAVPASCASLAEVRHAVADAVEDFLRHQVVPEDDALAATPSSPSSEDGSTSDGGESSSDSSPPTRGLAVRIGCVQRHELGPALRELGAGIARGATVRGHXAHGRRLRRCAALELLETLKFSVSLLGLWCLILAV

SEQ ID NO: 731 - DNA, 1378 bp, Zea mays
  misc_feature: Ceres CLONE ID no.1560970
  misc_feature: Encodes the peptide sequence at SEQ ID NO. 732
aaacttgggacttggcactcccctctcctagtcctagccatccatggacgctacagcccaacgagccatggcagtagacacaagcaatgcaccaaccacatcttgctcttcttcgtcttgtacatcctcgtcctcactcgtcaatgaggcgccgcaagaggttccctgcaagaagtccaaaggcacgaacaagcggaagagggcgtcttcgccggactcccaagaagtagaagccaacaacaacggcagcggcaataacagtaatggccagcaaggcgaggagagcagcagctgctgcagcacggaggacaacgaggcgtcggcgagtgtcggcgaaaaggccgaggcggcggcggccgccaccgccaccggcgcggcgtcgagaagccggagcgggtacaagcacccgtcgtaccgcggcgttcggcggcggagctggggcaagtgggtgtcggagatccgggagccccgcaagaagtcgcgcatctggctgggcaccttccccacggccgagatggcggcgcgcgcgcacgacgtggcggcgctggccatcaagggccgcggcgcgcacctcaacttcccggagcgcgcgcacgagctgccgcggccggcgtccacctcccccgcggacgtccaggccgcggcggcccaggcggcagcggccgcggacgtgcagtgcgacgcgccgccgtcgccgtcgccgtcccccgaagcggccgccgcgtcgccggacgacgctgcctgctgcctcgaggcgacgacgacgacgacgacggtgcacagcggcgacggtgggcagggccaggagaacgcgctgttcgacctgccggacctcctcctcgacctgagggacgggctgtggtggccgccggtgtggcccgcggcggcaataatggccgccgaggagtacgacggctgcgacgtcgtcgggatgcacgagccgctcttgtgggccgagtagttagttactcgatcgccttgcgtttctactaccgagtggtgaagtacatgggtcttctccaagaaaaagagtgggaaaaaaaaccaccagacacatactagtatgtttaggccctgttcggtttcaccggaatagaccaggatttattccagctcatcaaaatctatataaattagagaagtaatccggctaggaatcaatccggggcttccatccctaacaaccgaacagggccttactgttcttgaattagcagtacgagtattgcctgtctgtgcttgatttgggcatggagcagctggcccgtcgtcccccgtgtgtgtttttttttctgtaccagtttgtgaggagtagagacgtcgactgatagcagtctgcaaatcgcaattattttctagtgaaaaaaaaaaaaaaaaa

SEQ ID NO: 732 - protein, 297 aa, Zea mays
  misc_feature: Ceres CLONE ID no.1560970
  misc_feature: Bit score of 147.9 for HMM based on sequences of FIGURE 8.
  misc_feature (114)..(165): Pfam Name: AP2 Pfam Description: AP2 domain
  misc_feature: Functional Homolog Of Ceres SEEDLINE ID no. ME15935 at SEQ ID NO. 644
MAVDTSNAPTTSCSSSSCTSSSSLVNEAPQEVPCKKSKGTNKRKRASSPDSQEVEANNNGSGNNSNGQQGEESSSCCSTEDNEASASVGEKAEAAAAATATGAASRSRSGYKHPSYRGVRRRSWGKWVSEIREPRKKSRIWLGTFPTAEMAARAHDVAALAIKGRGAHLNFPERAHELPRPASTSPADVQAAAAQAAAAADVQCDAPPSPSPSPEAAAASPDDAACCLEATTTTTTVHSGDGGQGQENALFDLPDLLLDLRDGLWWPPVWPAAAIMAAEEYDGCDVVGMHEPLLWAE

SEQ ID NO: 733 - DNA, 938 bp, Panicum virgatum
  misc_feature: Ceres CLONE ID no.1760747
  misc_feature: Encodes the peptide sequence at SEQ ID NO. 734
atcgcaaaaaccactcgagcacaacacaaccggcagaggcactccagagctaaagcgctcgctcgacagccgatccagaacaagatgtgtcagatgaagagggagatgggcgccgagccgtcgggctccccgcgcagctgggcgtcgccctcgccctcgacctcggagcaggagcagcaccggacggtgtggacgtcgccgccgaagcggccggcggggcggaccaagttccgcgagacgcggcaccccgtgttccgcggcgtgcggcgccggggcaaggccgggcggtgggtgtgcgaggtgcgcgtgccgggccgccgcgggtgcaggctctggctcggcaccttcgacgccgccgaggccgccgcgcgcgcgcacgacgccgccatgctcgccatcgccggcccgggcgcgtgcctcaacttcgccgactcggcgtggctgctcgcggtcccggcctcgtacgccagcctcgccgaggtgcgccacgcggtcgccgaggcgatcgaggagttccagcgccgggaggcgctcccgggggaggaggaggaggaggaggcgcgctcggccacgtcgtcgacgacgttctctcccaccagcgtcggagacgagggctccaccgacggggaggcgtcctcgccggccgccgaggactcgccgttcgaactggacctgttcggtgacttgagctcggacttgtactacgcgagcttggcgcaggcgatgctcatggagccaccgtccacagtcgcggcgttctgcgacgagggcatggccgatgtgcctctctggagctattaggacagacgccgctgtgcttcaattttgcgccttttctttctcttggattcggaagccaaattttggtcctgtaactgttactacttttggtaatgttgagacagagcaacttgggacaaaaaaaaaaaaaaaaaaaa

SEQ ID NO: 734 - protein, 238 aa, Panicum virgatum
  misc_feature: Ceres CLONE ID no.1760747
  misc_feature: Bit score of 189.6 for HMM based on sequences of FIGURE 8.
  misc_feature (55)..(108): Pfam Name: AP2 Pfam Description: AP2 domain
  misc_feature: Functional Homolog Of Ceres SEEDLINE ID no. ME15935 at SEQ ID NO. 644
MCQMKREMGAEPSGSPRSWASPSPSTSEQEQHRTVWTSPPKRPAGRTKFRETRHPVFRGVRRRGKAGRWVCEVRVPGRRGCRLWLGTFDAAEAAARAHDAAMLAIAGPGACLNFADSAWLLAVPASYASLAEVRHAVAEAIEEFQRREALPGEEEEEEARSATSSTTFSPTSVGDEGSTDGEASSPAAEDSPFELDLFGDLSSDLYYASLAQAMLMEPPSTVAAFCDEGMADVPLWSY

SEQ ID NO: 735 - DNA, 534 bp, Populus balsamifera subsp. trichocarpa
  misc_feature: Ceres ANNOT ID no.1438772
  misc_feature: Encodes the peptide sequence at SEQ ID NO. 736
atggccacgacttcttctaactccaaaaggcacccaatgtatcatggaatccggtgccgcggtggtaaatgggtgtctgaaatccgggagccacgcaaaaccactcgtatatggcttggcacattcccaaagccggagatggcggcagcagcctatgatgttgcagccctggccctaaaaggtaatggtgcagttcttaacttcccaagttctgttgggacttatccagtgcctgctacggcatcatccactgatattcgcaatgcagcagctgctgctgctgcattaaaaaaggctgaactgagctacaatgaagcgttagttgatcaaccaagaaatgaccataatgccatcggtgcgtatttggcatcaagtggagaagaatttgttgatgaggaggcactgtttgatatgccaaatttgctggtggacatggcaggaggaatgctgctttcgccaccaagaataacctcgccaccgtctgatgattcacagggaaattctgatggagaaagtctgtggagctatttttaa

SEQ ID NO: 736 - protein, 177 aa, Populus balsamifera subsp. trichocarpa
  misc_feature: Ceres ANNOT ID no.1438772
  misc_feature: Bit score of 135.5 for HMM based on sequences of FIGURE 8.
  misc_feature (12)..(62): Pfam Name: AP2 Pfam Description: AP2 domain
  misc_feature: Functional Homolog Of Ceres SEEDLINE ID no. ME15935 at SEQ ID NO. 644
MATTSSNSKRHPMYHGIRCRGGKWVSEIREPRKTTRIWLGTFPKPEMAAAAYDVAALALKGNGAVLNFPSSVGTYPVPATASSTDIRNAAAAAAALKKAELSYNEALVDQPRNDHNAIGAYLASSGEEFVDEEALFDMPNLLVDMAGGMLLSPPRITSPPSDDSQGNSDGESLWSYF

SEQ ID NO: 737 - DNA, 531 bp, Populus balsamifera subsp. trichocarpa
  misc_feature: Ceres ANNOT ID no.1447378
  misc_feature: Encodes the peptide sequence at SEQ ID NO. 738
atggccacaacttcatctagctccaaaaggcacccaatgtatcgtggaatccggagccgcagtggcaaatgggtttccgaaatccgggagccacgaaaaaccactcgtatttggcttggcacattcccaaagccggagatggcagcagccgcctatgatgtggctgtcctagccctaaaaggtgctgatgcagttcttaacttcccgagttctgttgggacttatcctgttccagcatcaacatcacccactgatattcgtaatgcagctaatgctgctgctgcattaaaaaaggctgaaatgagctacaatgaagcattagttgaacaacctaggaatgactgtgccgttggtacctttttggcatcaggtggagaagaatttgtcgatgaggaggcactgtttgatatgccaaatttgctggtggacatggcaggaggaatgctgctttcgccaccaagaataaccccatcgccatctgatgactcacagggaacttctgatggagaaagtctgtggagctattcttaa

SEQ ID NO: 738 - protein, 176 aa, Populus balsamifera subsp. trichocarpa
  misc_feature: Ceres ANNOT ID no.1447378
  misc_feature: Bit score of 142.9 for HMM based on sequences of FIGURE 8.
  misc_feature (12)..(62): Pfam Name: AP2 Pfam Description: AP2 domain
  misc_feature: Functional Homolog Of Ceres SEEDLINE ID no. ME15935 at SEQ ID NO. 644
MATTSSSSKRHPMYRGIRSRSGKWVSEIREPRKTTRIWLGTFPKPEMAAAAYDVAVLALKGADAVLNFPSSVGTYPVPASTSPTDIRNAANAAAALKKAEMSYNEALVEQPRNDCAVGTFLASGGEEFVDEEALFDMPNLLVDMAGGMLLSPPRITPSPSDDSQGTSDGESLWSYS

SEQ ID NO: 739 - DNA, 627 bp, Populus balsamifera subsp. trichocarpa
  misc_feature: Ceres ANNOT ID no.1453360
  misc_feature: Encodes the peptide sequence at SEQ ID NO. 740
atgcaatattatcaacaaagcaacacctcaagtgctgacagtagcagtagcagtggaagtagcagaactgcttctgctgctgctgctgctgctggggctattgcacctaaagtttcaggccaccatcatgttttccgtggagttcggcgtaggagtagtggaaaatgggtgtctgagattagagagcctaagaagcctaacagaatctggttaggcacatttcctaaccctgaaatggctgctgttgcgtatgatgtggcagcgcttgcacttaaaggccaggatgcagagcttaatttcccaaactcagctgcttctctgcctgttcctgcttccacgtcaccacgtgatattcaggcggccgcagcttctgcggctgctgctataggtgctgcaaaggatgctttagggattcgaagtatgggggatactaatcaaatggaacaggaaattaggccaatggtcaatgatcagtttgttgacgaggatttgatgtttgatatgcctaatgttcttgtgaacatggcagaagcgatgcttcttagccctccccgcttggacattgcaggtgatgatgctacagcctatgacagcactggagaccagaacctttggaaattcccttga

SEQ ID NO: 740 - protein, 208 aa, Populus balsamifera subsp. trichocarpa
  misc_feature: Ceres ANNOT ID no.1453360
  misc_feature: Bit score of 189.1 for HMM based on sequences of FIGURE 8.
  misc_feature (43)..(94): Pfam Name: AP2 Pfam Description: AP2 domain
  misc_feature: Functional Homolog Of Ceres SEEDLINE ID no. ME15935 at SEQ ID NO. 644
MQYYQQSNTSSADSSSSSGSSRTASAAAAAAGAIAPKVSGHHHVFRGVRRRSSGKWVSEIREPKKPNRIWLGTFPNPEMAAVAYDVAALALKGQDAELNFPNSAASLPVPASTSPRDIQAAAASAAAAIGAAKDALGIRSMGDTNQMEQEIRPMVNDQFVDEDLMFDMPNVLVNMAEAMLLSPPRLDIAGDDATAYDSTGDQNLWKFP

SEQ ID NO: 741 - protein, 238 aa, Oryza sativa
  misc_feature: Public GI ID no.33637698
  misc_feature: Bit score of 176.3 for HMM based on sequences of FIGURE 8.
  misc_feature (49)..(102): Pfam Name: AP2 Pfam Description: AP2 domain
  misc_feature: Functional Homolog Of Ceres SEEDLINE ID no. ME15935 at SEQ ID NO. 644
MCGIKQEMSGESSGSPCSSASAERQHQTVWTAPPKRPAGRTKFRETRHPVFRGVRRRGNAGRWVCEVRVPGRRGCRLWLGTFDTAEGAARAHDAAMLAINAGGGGGGGACCLNFADSAWLLAVRRSYRTLADVRHAVAEAVEDFFRRRLADDALSATSSSSTTPSTPRTDDDEESAATDGDESSSPASDLAFELDVLSDMGWDLYYASLAQGMLMEPPSAALGDDGDAILADVPLWSY

SEQ ID NO: 742 - protein, 252 aa, Lolium perenne
  misc_feature: Public GI ID no.118026860
  misc_feature: Bit score of 161.7 for HMM based on sequences of FIGURE 8.
  misc_feature (45)..(98): Pfam Name: AP2 Pfam Description: AP2 domain
  misc_feature: Functional Homolog Of Ceres SEEDLINE ID no. ME15935 at SEQ ID NO. 644
MDAGHDNWISTPSSSTSSHEHATAPWSPSPKRPAGRTKFKETRHPVYRGVRRRGSAGRWVCEVRVPGRRGERLWLGTHVTAESAARAHDAAMLAMRGSSAASCLNFADSASLLAVSSAVFEFADVRRAALAAVADFQRRNAANGAATASAGAVVEATSSASAPSPGDNAGSSATSSEATADGMFEVPAALGSDMFELDMSGEMDLGTYYADLAEGLLLDPPSPAAGTEACWDWENGDYGDHGGADAALWSYY

SEQ ID NO: 743 - protein, 293 aa, Hordeum vulgare subsp. spontaneum
  misc_feature: Public GI ID no.60116232
  misc_feature: Bit score of 187.2 for HMM based on sequences of FIGURE 8.
  misc_feature (90)..(143): Pfam Name: AP2 Pfam Description: AP2 domain
  misc_feature: Functional Homolog Of Ceres SEEDLINE ID no. ME15935 at SEQ ID NO. 644
MSPTLSLKLKKSSHTPQSSVSSSTMLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 744 - protein, 251 aa, Oryza sativa subsp. japonica
  misc_feature: Public GI ID no.115477639
  misc_feature: Bit score of 180.8 for HMM based on sequences of FIGURE 8.
  misc_feature (53)..(106): Pfam Name: AP2 Pfam Description: AP2 domain
  misc_feature: Functional Homolog Of Ceres SEEDLINE ID no. ME15935 at SEQ ID NO. 644
MCTSKLEEITGEWPPPALQAASTTSSSEPCRRLSPPSSKRPAGRTKFHETRHPVFRGVRRRGRAGRWVCEVRVPGRRGCRLWLGTFDAADAAARAHDAAMLALRGRAAACLNFADSAWLLAVPPPATLRCAADVQRAVARALEDFEQRESSSSVFPLAIDVVAEDAMSATSEPSAASDDDAVTSSSSTTDADEEASPFELDVVSDMGWSLYYASLAEGLLMEPPASGASSDDDDDAIVDSSDIADVSLWSY

SEQ ID NO: 745 - protein, 287 aa, Hordeum vulgare subsp. vulgare
  misc_feature: Public GI ID no.126567023
  misc_feature: Bit score of 181.3 for HMM based on sequences of FIGURE 8.
  misc_feature (84)..(137): Pfam Name: AP2 Pfam Description: AP2 domain
  misc_feature: Functional Homolog Of Ceres SEEDLINE ID no. ME15935 at SEQ ID NO. 644
MSPTLSLKLKKSSHTPQSSVSSSTKLRLFKKEAACQSPSTLPVAMDMGLEVSSPSPFSSSVSSSPEHTAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSPNGVFEGPVVMDSEMFRLDLFPEMDLGSYYMSLAEALLMDPPPTATIIHAYEDNGDGGADVRLWSYSVDM

SEQ ID NO: 746 - DNA, 994 bp, Zea mays
  misc_feature: Ceres CLONE ID no.988971
  misc_feature: Encodes the peptide sequence at SEQ ID NO. 747
atcgcaaaaaccacccaaggccaagtcgcatcgcagcagccaggcagatcgatcaacaccttaaaatcgagcgagctaagatgtgcccaatcaagagggagacgacgagcgccgagtccggctcgccgtgcagtagctccacctccacctcgtcgtcgtcggaacaccaccagaccgcgtgggcgtcgccgccgaagaagcggccggcggggcgcaccaagttccgggagacgcggcacccggtgttccgcggcgtgcggcgccggggccgcgccgggcggtgggtctgcgaggtgcgcgtgcccgggaggcgcggctgcaggctctggctcggcaccttcgacaccgccgaggccgcggcccgcgcgcacgacgccgcgatgctcgccgtcgccgccggcgccgcgcgcctcaacttcgcggactcggcgtggctgctcgccgtgccgacggcctcgtacgccagcctcgccgacgtccgccgcgccgtggcggaggccgtggagagcttcctgcgccgccgcgaggaggaggagggggacgcgctctcggccgcgtcctcgacgtcgcccaacgacaaggacggcgacgagtcctcctcggccaccaccaccgacgacgactcgccgttcgagctggacatgttcggtggcatgagctgggacctgtactacgcgaacttggcgcaggcgatgctcgtggagccaccgcccattgtccccgcgttatgcgacgacggcgtggcttccgaattgccgctctggagctactaggctaggactagtggtcgctgtactttcggtttttaccttttctcgttctcgtcgtgtcctgtgccacaatttggtaactgcacaaaggttactgctgcttctattaacgaaacagagcagattgggaaaaaaacagagcatggccgttgactttgtaatggtagcaaaaagtcttgagcttattattattatagtgttgactctcaaaaaaaaaaaaaaaa

SEQ ID NO: 747 - protein, 230 aa, Zea mays
  misc_feature: Ceres CLONE ID no.988971
  misc_feature: Bit score of 176.2 for HMM based on sequences of FIGURE 8.
  misc_feature (54)..(107): Pfam Name: AP2 Pfam Description: AP2 domain
  misc_feature: Functional Homolog Of Ceres SEEDLINE ID no. ME15935 at SEQ ID NO. 644
MCPIKRETTSAESGSPCSSSTSTSSSSEHHQTAWASPPKKRPAGRTKFRETRHPVFRGVRRRGRAGRWVCEVRVPGRRGCRLWLGTFDTAEAAARAHDAAMLAVAAGAARLNFADSAWLLAVPTASYASLADVRRAVAEAVESFLRRREEEEGDALSAASSTSPNDKDGDESSSATTTDDDSPFELDMFGGMSWDLYYANLAQAMLVEPPPIVPALCDDGVASELPLWSY

SEQ ID NO: 748 - DNA, 920 bp, Zea mays
  misc_feature: Ceres CLONE ID no.1464521
  misc_feature: Encodes the peptide sequence at SEQ ID NO. 749
gcaaaataccactcgagcacaattcaagcagcagcgaaggtagccacaacatccactctactactggagagctaagaaatcgttcaacaggtgatccagaacaagatgtgtccgaccaagaaggagatgagtgccgattcgtcgggctcggcgagcagctggacttcgccggagcaccagaccgtgtggacttcgccgaagcggcccgcggggcggaccaagttccgcgagacgcggcaccccgtgttccgtggcgtccggcgccgcggcagcgccgggcggtgggtgtgcgaggtgcgcgtgcccgggaggcgcgggtgcaggctctggctcggcacgttcgacgccgccgaggccgccgcgcgcgcgcacgacgccgccatgctcgccatcgccggcgcgagcgcgtgcctcaacttcgccgactccgcgtggctgctcgcggtccccgcctcgtacgccagccttgccgaggtccgccgtgcggtcgccgaggccgtggaggactttcagcgccgcgaggcggccgccggggacgacgcgcgctcggccacatcgccggcgccgtccacctcgggcaccgacgacgacgctaccactgacggcgaggagtcgtcaccggccacggaagactcgtcgttccagctcgacgtgttcgatgacatgagctgggatctatactacgcgagcatggcgcagggaatgctcatggagctgccgtccgcagttccggcgttcggagacgacggctacaccaatatcgccgatgttccactgtggagctactagaattgaggacgttgataccttgaatttctcttctttttcctgttggctccccatgccaaattttgggactaggtaatgaaaacagagcaagtttggaaaaggaaaacagaggatgaaaaaaaaaaaaaaaa

SEQ ID NO: 749 - protein, 227 aa, Zea mays
  misc_feature: Ceres CLONE ID no.1464521
  misc_feature: Bit score of 199.5 for HMM based on sequences of FIGURE 8.
  misc_feature (46)..(99): Pfam Name: AP2 Pfam Description: AP2 domain
  misc_feature: Functional Homolog Of Ceres SEEDLINE ID no. ME15935 at SEQ ID NO. 644
MCPTKKEMSADSSGSASSWTSPEHQTVWTSPKRPAGRTKFRETRHPVFRGVRRRGSAGRWVCEVRVPGRRGCRLWLGTFDAAEAAARAHDAAMLAIAGASACLNFADSAWLLAVPASYASLAEVRRAVAEAVEDFQRREAAAGDDARSATSPAPSTSGTDDDATTDGEESSPATEDSSFQLDVFDDMSWDLYYASMAQGMLMELPSAVPAFGDDGYTNIADVPLWSY

SEQ ID NO: 750 - protein, 239 aa, Triticum monococcum
  misc_feature: Public GI ID no.63098610
  misc_feature: Bit score of 179.0 for HMM based on sequences of FIGURE 8.
  misc_feature (41)..(94): Pfam Name: AP2 Pfam Description: AP2 domain
  misc_feature: Functional Homolog Of Ceres SEEDLINE ID no. ME15935 at SEQ ID NO. 644
MDLSSSSPSSSASSSPEHASGRASPAKRPAGRTKFRETRHPVYRGVRRRGNAGRWVCEVRVPGKRGSRLWLGTYLTAEAAARANDAAMLALGGRSARCLNFADSAWLLAVPSALSDLADVRRAALQAVADFQRWEAANGLVTRTAAEQAPSSAPAQSSSESDSADSSETSEASADGEFEVLATMDIDMFRLDLFPEMDLGSYYVSLAEALLMDPPSTATIIDAYRDNRDGGADVALWSY

SEQ ID NO: 751 - protein, 293 aa, Hordeum vulgare subsp. spontaneum
  misc_feature: Public GI ID no.126566972
  misc_feature: Bit score of 182.8 for HMM based on sequences of FIGURE 8.
  misc_feature (90)..(143): Pfam Name: AP2 Pfam Description: AP2 domain
  misc_feature: Functional Homolog Of Ceres SEEDLINE ID no. ME15935 at SEQ ID NO. 644
MSPTLSLKLKKSSHTPQSSVSSSTKLRLFKKEAACQSPSTLPVAMDMGLEVSSPSPFSSSVSSSPEHTARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSANGVFEGPVVMDSEMFRLDLFPEMDLGPYYMSLAEALLMDPPPTATIIHAYEDNGDGGADVRLWSYSVDM

SEQ ID NO: 752 - DNA, 1216 bp, Zea mays subsp. mays
  misc_feature: Ceres CLONE ID no.1556129
  misc_feature: Encodes the peptide sequence at SEQ ID NO. 753
agaacctgctgcaggccacacccacccacgcacacacacacaatccaaaacgctcctccttctccagtcgactgatcgatcgatggactgggcgtactacggcagtggctactcgacgccggcgagcggcggcggcggcggggacgaggacgcctacatgacggtgtcgtcggcgccgccgaagcggcgcgcggggcggaccaagttcaaggagacgaggcacccggtgtacaagggcgtgcgcagcaggaaccccgggcggtgggtctgcgaggtgcgggagccgcacggccggcagcggatctggctcggcaccttcgagaccgccgagatggcggcgcgcgcgcacgacgtggccgcgctggcgctgcgcggccgcgccgcctgcctcaacttcgccgactcgccgcgcaggctgcgcgtgcccgcgcagggcgccggccacgacgagatacgccgcgccgcggtggaggcggccgagctgttccgcccgcagcccggggagcgcaatgtgggaggttccgaggcggcggccgaggcggcggcggcggcgccctgcgcgatggggagcggcgacctcggcggcggcgaattcccttactacccggtggacgacgggctggagttcgagatgcgtgggtaccttgacatggcgcaggggatgctcatcgacccgccgcagccggccgctgggcagtcggcgtggatcgaggacgagtacgaatgcgaggtcagtctttggagctactgatcgagcgcgtctggtaccaacaaggaccctgtgtacatacagcttatggtgtgctgatgatgtctgtactgtttccctgctcttctgacgaatcgcaatcgcaatgcagtcagaaggagcagaggagtgtgcttaggttttgagcggctgtctctgcacatttggcgctaacacggccaaggtagccttggcgccagatatggcacttggtgcggacgccctcttataagttacgtaagataagaaccacatggtgtaataaacagcagagcctgctgagcgtttgaacctgcagcgatgtcaatcaagttgccgtgtgatgtttagtggaatttacctgaactgaaaacatatgtgctctatggatgaatgtccactgcaggagcaaaatatatggattggaaaaaagggaggcaaagacttgtttgtccctaccctgtatgttccaacaaaaaaaaaaaaaaa

SEQ ID NO: 753 - protein, 222 aa, Zea mays subsp. mays
  misc_feature: Ceres CLONE ID no.1556129
  misc_feature: Bit score of 239.4 for HMM based on sequences of FIGURE 8.
  misc_feature (48)..(99): Pfam Name: AP2 Pfam Description: AP2 domain
  misc_feature: Functional Homolog Of Ceres SEEDLINE ID no. ME15935 at SEQ ID NO. 644
MDWAYYGSGYSTPASGGGGGDEDAYMTVSSAPPKRRAGRTKFKETRHPVYKGVRSRNPGRWVCEVREPHGRQRIWLGTFETAEMAARAHDVAALALRGRAACLNFADSPRRLRVPAQGAGHDEIRRAAVEAAELFRPQPGERNVGGSEAAAEAAAAAPCAMGSGDLGGGEFPYYPVDDGLEFEMRGYLDMAQGMLIDPPQPAAGQSAWIEDEYECEVSLWSY

SEQ ID NO: 754 - DNA, 840 bp, Panicum virgatum
  misc_feature: Ceres CLONE ID no.1761385
  misc_feature: Encodes the peptide sequence at SEQ ID NO. 755
  misc_feature (816)..(816): n is a, c, t, g, unknown, or other
aaattcgaaacaatccagaagctctccttgacaggactgaccgacgatggactggccgtactccggcggcggcggaggcgaggatggcgcgtacatgacggtgtcgtcggcgccgccgaagcggcgcgcggggcggaccaagttcaaggagacgcggcacccggtgtacaagggcgtgcgcagccggaaccccgggcgctgggtctgcgagctgcgggagccgcacggcaggcaccgcatctggctcggcaccttcgagaccgccgagatggcggcgcgcgcgcacgacgtcgccgcgctggcgctgcgcggcagggccgcctgcctcaacttcgccgactcgccgcgcaggctccgcgtcccgccgcagggcgccggccacgacgagatacgccgcgccgccgtggaggccgccgagctcttccgcccgcagcgcaatgcgggctctcccgaggcggcggcggcggcggcgatcgcggcgcccgacgcccaggcgaccgggggcctcggcggcgacttcgcttactacccgccggacgacggcctggacttcgaaatgcaggggtacctggacatggcgcaggggatgctgatcgacccgccgccggcgaacgcggggcagtcggcgtggatcgacgacgagtacgactgcgaggtcagcctgtggagctactgacgatcgcgggcgttcggaccgagccggcattagtgtgcttagtgtgtaccgtttccctgctattctgacgaaatgtgatgcgatcaggaggagcagaggagtgtgcttaggttttcagaggctgcttctgcacatgtggnggtggcgttagcaaggccaaggta

SEQ ID NO: 755 - protein, 209 aa, Panicum virgatum
  misc_feature: Ceres CLONE ID no.1761385
  misc_feature: Bit score of 227.6 for HMM based on sequences of FIGURE 8.
  misc_feature (39)..(90): Pfam Name: AP2 Pfam Description: AP2 domain
  misc_feature: Functional Homolog Of Ceres SEEDLINE ID no. ME15935 at SEQ ID NO. 644
MDWPYSGGGGGEDGAYMTVSSAPPKRRAGRTKFKETRHPVYKGVRSRNPGRWVCELREPHGRHRIWLGTFETAEMAARAHDVAALALRGRAACLNFADSPRRLRVPPQGAGHDEIRRAAVEAAELFRPQRNAGSPEAAAAAAIAAPDAQATGGLGGDFAYYPPDDGLDFEMQGYLDMAQGMLIDPPPANAGQSAWIDDEYDCEVSLWSY

SEQ ID NO: 756 - DNA, 858 bp, Populus balsamifera subsp. trichocarpa
  misc_feature: Ceres ANNOT ID no.1488325
  misc_feature: Encodes the peptide sequence at SEQ ID NO. 757
atggaatttgagaatcactcaccatcaatatcttcattgcgtcaaaatttatcatgcaagccatgcaacaaccctattaattatatttataatctaaagcaagcacaagaaaggccggttacagtcttgaagaagaagaaagcaggaaggaagaagttcaaggagactcggcacccggtatataggggggtacggaagagaaatgggaataaatgggtatgtgaagtgcgagaaccgaacaagaaatcaagaatttggttagggaccttcactagcccagaaatggcagctagggcacatgacgttgctgccttagcactgaagggagaaactgctactttaaattttcctgattcagctttgatacttcctcgagcgaagtcgtcttctgctggagatatacgaagagctgcgcgtgatgctgttgaggcctttatacctagtgcttctttgtgttctcccccctcaccatctcatcataagaacttttcatgcgtgacaagctcaagtaaagttttgagtccagctttaagcgatctcaatccacatgagaagggcatagaaaatgttttcaaaccttcattaattggcatgcaaggtgttgaggtatatggaaagaaggctcttaatgatgaccctttttcaatggtcatgatgtcatgccctaacaattgctcggagaaggtgtcccatcaacccaatgcactgttctttgatgaggaggcattgtttaacatgccaggattacttgatagcatggcagagggtttgatcctaaccccaccagttatgcaaagaggatttaattgggatgacatggcgtgttctacggacttgacattatgggaggaggactag

SEQ ID NO: 757 - protein, 285 aa, Populus balsamifera subsp. trichocarpa
  misc_feature: Ceres ANNOT ID no.1488325
  misc_feature: Bit score of 222.2 for HMM based on sequences of FIGURE 8.
  misc_feature (59)..(110): Pfam Name: AP2 Pfam Description: AP2 domain
  misc_feature: Functional Homolog Of Ceres SEEDLINE ID no. ME15935 at SEQ ID NO. 644
MEFENHSPSISSLRQNLSCKPCNNPINYIYNLKQAQERPVTVLKKKKAGRKKFKETRHPVYRGVRKRNGNKWVCEVREPNKKSRIWLGTFTSPEMAARAHDVAALALKGETATLNFPDSALILPRAKSSSAGDIRRAARDAVEAFIPSASLCSPPSPSHHKNFSCVTSSSKVLSPALSDLNPHEKGIENVFKPSLIGMQGVEVYGKKALNDDPFSMVMMSCPNNCSEKVSHQPNALFFDEEALFNMPGLLDSMAEGLILTPPVMQRGFNWDDMACSTDLTLWEED

SEQ ID NO: 758 - DNA, 870 bp, Populus balsamifera subsp. trichocarpa
  misc_feature: Ceres ANNOT ID no.1460483
  misc_feature: Encodes the peptide sequence at SEQ ID NO. 759
atggaatttgagaattattcatcgtcacaatcttcaattcgtcagactttatcttgcaagcaatgcaacagccctgatatttataatcttccacgagggcaagagcggccagttgcagttttgaagaagaacaaagcgggaaggaagaagttcaaggagacgaggcatccggtatataggggggtacggagaagaaatgggaataaatgggtatgtgaagtgcgtgaaccaaacaagaaatcaagaatttgggtggggaccttcaagagcccagaaatggcagctagggcacatgatgttgctgctttagcacttaaaggagagcttgctgccttgaactttctcgattcagctttgatacttcctcgagcaaagtcgtcttctgctagagatatacaaagggctgcccttgctgctacagaggtcttaggacgaagtgcttcttcgtgttcttcttcctcatcacctgatcataagaaactttcatgcgtgacaaggtcaaggaaagtcttgagtccatctttaagtgatcttccagtacatgagaagggcacagaaaatgtcttaagaccttcattaattgacacacaaagtgttgagatatatgaaaagaaggtttctaatgaagagcctttttcaaatatggtcatgtcatgctctaataactgctgctcagagaaggtgcctaatcattccaatgcaacgttctttgatgaggaggcattgtttaacatgccaggattacttgatagcatggcagagggtttgatccttaccccgccagctatggcaagaggagtttattgggatgacatggcttgttctacggacttgacattatgggaggacgactacttagattctcagtga

SEQ ID NO: 759 - protein, 289 aa, Populus balsamifera subsp. trichocarpa
  misc_feature: Ceres ANNOT ID no.1460483
  misc_feature: Bit score of 216.5 for HMM based on sequences of FIGURE 8.
  misc_feature (57)..(108): Pfam Name: AP2 Pfam Description: AP2 domain
  misc_feature: Functional Homolog Of Ceres SEEDLINE ID no. ME15935 at SEQ ID NO. 644
MEFENYSSSQSSIRQTLSCKQCNSPDIYNLPRGQERPVAVLKKNKAGRKKFKETRHPVYRGVRRRNGNKWVCEVREPNKKSRIWVGTFKSPEMAARAHDVAALALKGELAALNFLDSALILPRAKSSSARDIQRAALAATEVLGRSASSCSSSSSPDHKKLSCVTRSRKVLSPSLSDLPVHEKGTENVLRPSLIDTQSVEIYEKKVSNEEPFSNMVMSCSNNCCSEKVPNHSNATFFDEEALFNMPGLLDSMAEGLILTPPAMARGVYWDDMACSTDLTLWEDDYLDSQ

SEQ ID NO: 760 - DNA, 998 bp, Gossypium hirsutum
  misc_feature: Ceres CLONE ID no.1837825
  misc_feature: Encodes the peptide sequence at SEQ ID NO. 761
atcactctcttcacttacacttgtcttgcttttcttcactactaaatctgatactaatattttcaaatttacttccaagttatcgttccgggtattcagatccagagctaaaaatggagtatttggagattgattcttcttcatgcaagccatgcagccctgactcagagttatcctcctcctcatctacctcatcagcttatgatctgccattaatggttgtttcgagttcccataagcgaaaagctggtcgaaagaagtttaaagagactcgtcatccggtatttagaggtgtacggcaaaggagagggagtaaatgggtgtctgaaattcgtgaaccttacaagaaatcaaggatttggttgggcactttccttagccctgaaatggcagctagggcttatgacgttgccgtcttagcgcttaggggcaaatccgccgctcttaattttccagactcggcttctgttctccctagggctaagtcttcttcgccaaaagacatacaaatcgctgcgtttgccgctgccgaggcttttaaaccaataacttcaacggatattgatcctcaaccagtgggatgctcatcatcaacctcagtttccactgagaacgacgaagaaaagagccttttagatgatggctcgatgtgggatcgtagttggagcttggaggccaccaacactaatgataatgagtggaattatggtttcatggacgaggaggcattgtttaatatgccaggcttactcgatagcatggctgagggtttgctcctctcttcacctgctgctttgcaggcacaagtttatgattgcgacgatgacgtagcttccacctttaacattgatttatggcgacattactaattacaagcctgcctttgctatgttgtgttttttctagtttctttgttttcgcttcatttttccagtttcctttaaaaaaaattagtagaaaaagtataccaattaaaccaaaaaaaaaaaaaaaaaaaa

SEQ ID NO: 761 - protein, 251 aa, Gossypium hirsutum
  misc_feature: Ceres CLONE ID no.1837825
  misc_feature: Bit score of 248.6 for HMM based on sequences of FIGURE 8.
  misc_feature (56)..(107): Pfam Name: AP2 Pfam Description: AP2 domain
  misc_feature: Functional Homolog Of Ceres SEEDLINE ID no. ME15935 at SEQ ID NO. 644
MEYLEIDSSSCKPCSPDSELSSSSSTSSAYDLPLMVVSSSHKRKAGRKKFKETRHPVFRGVRQRRGSKWVSEIREPYKKSRIWLGTFLSPEMAARAYDVAVLALRGKSAALNFPDSASVLPRAKSSSPKDIQIAAFAAAEAFKPITSTDIDPQPVGCSSSTSVSTENDEEKSLLDDGSMWDRSWSLEATNTNDNEWNYGFMDEEALFNMPGLLDSMAEGLLLSSPAALQAQVYDCDDDVASTFNIDLWRHY

SEQ ID NO: 762 - protein, 218 aa, Oryza sativa subsp. indica
  misc_feature: Public GI ID no.27228310
  misc_feature: Bit score of 172.3 for HMM based on sequences of FIGURE 8.
  misc_feature (31)..(88): Pfam Name: AP2 Pfam Description: AP2 domain
  misc_feature: Functional Homolog Of Ceres SEEDLINE ID no. ME15935 at SEQ ID NO. 644
MEVEEAAYRTVWSEPPKRPAGRTKFRETRHPVYRGVRRRGGRPGAAGRWVCEVRVPGARGSRLWLGTFATAEAAARAHDAAALALRGRAACLNFADSAWRMPPVPASAALAGARGVRDAVAVAVEAFQRQSAAPSSPAETFADDGDEEEDNKDVLPVAAAEVFDAGAFELDDGFRFGGMDAGSYYASLAQGLLVEPPAAGAWWEDGELAGSDMPLWSY

SEQ ID NO: 763 - protein, 219 aa, Triticum aestivum
  misc_feature: Public GI ID no.117653881
  misc_feature: Bit score of 167.9 for HMM based on sequences of FIGURE 8.
  misc_feature (42)..(94): Pfam Name: AP2 Pfam Description: AP2 domain
  misc_feature: Functional Homolog Of Ceres SEEDLINE ID no. ME15935 at SEQ ID NO. 644
MDQYSYGGGDGDQAGQGGYATVTSAPPKRPAGRTKFRETRHPVYRGVRRRGAAGRWVCEVREPNKKSRIWLGTFASPEAAARAHDVAALALRGRAACLNFADSATLLAVDPATLRTPDDIRAAAIALAETACPAAPVAAEASAPAPAMMAMMQEPSAVEYDDYPMQYGGIGDFDQHSYYYDGLSAGGGDWQSSSHMDGADDDSNCGGGYGAGEVPLWSY

SEQ ID NO: 764 - protein, 218 aa, Oryza sativa subsp. japonica
  misc_feature: Public GI ID no.115480233
  misc_feature: Bit score of 172.6 for HMM based on sequences of FIGURE 8.
  misc_feature (31)..(88): Pfam Name: AP2 Pfam Description: AP2 domain
  misc_feature: Functional Homolog Of Ceres SEEDLINE ID no. ME15935 at SEQ ID NO. 644
MEVEEAAYRTVWSEPPKRPAGRTKFRETRHPVYRGVRRRGGRPGAAGRWVCEVRVPGARGSRLWLGTFATAEAAARAHDAAALALRGRAACLNFADSAWRMPPVPASAALAGARGVRDAVAVAVEAFQRQSAAPSSPAETFANDGDEEEDNKDVLPVAAAEVFDAGAFELDDGFRFGGMDAGSYYASLAQGLLVEPPAAGAWWEDGELAGSDMPLWSY

SEQ ID NO: 765 - protein, 216 aa, Festuca arundinacea
  misc_feature: Public GI ID no.37694048
  misc_feature: Bit score of 185.4 for HMM based on sequences of FIGURE 8.
  misc_feature (41)..(94): Pfam Name: AP2 Pfam Description: AP2 domain
  misc_feature: Functional Homolog Of Ceres SEEDLINE ID no. ME15935 at SEQ ID NO. 644
MDAAVAASLSLQSGEQEYRTVWSEPPKPRSGRTKFQETRHPVYRGVRRRGRAGQWVCEMRVHGTKGSRLWLGTFDTAEMAARAHDAAALALSGRDACLNFADSAWRMQPVLPAGAGSVCFGGAQEVKDAVAAAVEAFQEEEHHVESTAETAKDEESALSMSSDLSEHDDERWIDGMDAGSYYASLAQGMLVEPPDAGAWREDGEHGGVETSLWSYL

SEQ ID NO: 766 - DNA, 993 bp, Gossypium hirsutum
  misc_feature: Ceres CLONE ID no.1849479
  misc_feature: Encodes the peptide sequence at SEQ ID NO. 767
aacaacttcatatacatataaacccctttcatttcacacttcaaattcataaacttatcttttattttacaactttgggtttgattttattctactgggagtgaaagttcaatgtcaagctccttgttcaaatgctaaaagtcaaatatttgtttaattgaaagttgaattcacggttttattccttgttatggattctttgagtttagattatgggtcggtttcgtcaccgatgtcagatagtgggagtggaaatggagcttctcgtccgccgaatttttccgatgaagacgtgatgttagcttcgtgttaccccaagaagcgagcgggaaggaagaaattccgggagactcgacacccggtgttccgaggagttcgccggaggaactccggaaaatgggtttgtgaagtaagggaaccttacaaaaagtcaaggatttggctcgggacttttccgacagaagagatggcggcgcgtgcccacgacgtggcggcgttagctctgagaggaaggttggcttgtttgaacttcgcggactctgcttggagactccctgtaccagcttctaccgatccaaaagacatccagaaagcggcggcggaggcagcggaagttttccgacctgttgattccgccggagatagctcaaagacagctgaaaacacggcggtggagggaactaaagagtcggaagaagtgttttttttggacgaagaagcagtgtttgggagagaaaagtttttggcaaacatggcggcggggatgatgatgtctccgcctcacagtggatatgaaaaagatgaacaagaacttgagtttgtcgatgattgtgtgcagctgtggagctattctatttaaaagtataaatatatcagactcaatagaatttgatcaatccttttttctgtcgttaaggtggagaactgaaccaagaattctctttctttatcatcaatcgaatcactgttcgcgaaaaaaaaaaaaaaaaaaaa

SEQ ID NO: 767 - protein, 222 aa, Gossypium hirsutum
  misc_feature: Ceres CLONE ID no.1849479
  misc_feature: Bit score of 394.6 for HMM based on sequences of FIGURE 8.
  misc_feature (57)..(108): Pfam Name: AP2 Pfam Description: AP2 domain
  misc_feature: Functional Homolog Of Ceres SEEDLINE ID no. ME15935 at SEQ ID NO. 644
MDSLSLDYGSVSSPMSDSGSGNGASRPPNFSDEDVMLASCYPKKRAGRKKFRETRHPVFRGVRRRNSGKWVCEVREPYKKSRIWLGTFPTEEMAARAHDVAALALRGRLACLNFADSAWRLPVPASTDPKDIQKAAAEAAEVFRPVDSAGDSSKTAENTAVEGTKESEEVFFLDEEAVFGREKFLANMAAGMMMSPPHSGYEKDEQELEFVDDCVQLWSYSI

SEQ ID NO: 768 - DNA, 759 bp, Gossypium hirsutum
  misc_feature: Ceres CLONE ID no.1934653
  misc_feature: Encodes the peptide sequence at SEQ ID NO. 769
attcactcaactcaatactattatggtatccttttcttaaaaagctttcctttggcttttactcaactcacacttcactctcagcctttactcaaatggaacctttcgctctagattgcgatatgctcgattctgggtctgtttcgtcgccgttatcggattctggaagtggtacttctcgtccggcaaatttctccgatgaagatgtgatgttagcttcgatttgtccgaagaaacgagcgggacggaagaaattccgcgagactcggcatccggtttaccgtggagtccgccggaagaactcggggaagtgggtttgtgaagtgagggagcctaataagaagtcgaggatttggctgggtacttttctcacagcggagatggcagctcgtgcccacgacgtagcggccatagctctgagggggaggtcggcttgcctgaacttcgcggactcagcttggaggcttccggttccggcttctgctgatcccaaggatatccagaaggcggcggcagaggcggcggaggcatttagacaaccggctgagcaatgggacggaaactctgaagctaatgcaaagggagatgaaaacaaagggagtttgtgtgagaatgggttttatttggacgaggaggcggtttttggaacacaaagttatctggaaaacatggcggcagggatgatgatgtcacccccctcgtgtgggtacaatggggatgaactagaatacgatgctgccgatgatttcatacctcttt

SEQ ID NO: 769 - protein, 221 aa, Gossypium hirsutum
  misc_feature: Ceres CLONE ID no.1934653
  misc_feature: Bit score of 356.8 for HMM based on sequences of FIGURE 8.
  misc_feature (60)..(111): Pfam Name: AP2 Pfam Description: AP2 domain
  misc_feature: Functional Homolog Of Ceres SEEDLINE ID no. ME15935 at SEQ ID NO. 644
MEPFALDCDMLDSGSVSSPLSDSGSGTSRPANFSDEDVMLASICPKKRAGRKKFRETRHPVYRGVRRKNSGKWVCEVREPNKKSRIWLGTFLTAEMAARAHDVAAIALRGRSACLNFADSAWRLPVPASADPKDIQKAAAEAAEAFRQPAEQWDGNSEANAKGDENKGSLCENGFYLDEEAVFGTQSYLENMAAGMMMSPPSCGYNGDELEYDAADDFIPL

SEQ ID NO: 770 - DNA, 753 bp, Parthenium argentatum
  misc_feature: Ceres CLONE ID no.1608106
  misc_feature: Encodes the peptide sequence at SEQ ID NO. 771
acttaaaacataaccaaaacaattcactcacaactgaaaacatatggacacctcttcagcttccgattgcagcagcagtaataccggcgattatgcggaaatggaactaaagcttgcttcgcaaaacccaaagaagagagcggcgagaaagaagttcaaagagactcgacacccggtttaccgaggagtgaggagaagaaactccgggaaatgggtgtgtgaggtgagagaaccaaataagcaatcgagagtgtggctggggacgtacccgactgccgaaatggcggcccgggcacacgatgtggcggttttggcaatgaggggacggtcggcttgtttaaattttgctgactcggtttggcggctgccagtacccgagtccagcaatgtaaaggatatacaaaaggcagcggccgaggcggcagaggcgtttagagagacggaggatattgcgatggaaacaaaggagatgccggaagttgtggtttatgctgatgaagaggagatgtttggaatgccggaatttattgccagcatggctgagggaatgatgttaccgccacctcagatggtggggtatgctaactttgtggaaaatgtggatttttgggaagacttgtgtttatggagtttttagggtcttatattgttttcttgtttgagtaagatacattcattgtttgttttggtgatggcttaaacctttttgtacacaagccaatattgaagtaaacatattaacaatcaacgttc

SEQ ID NO: 771 - protein, 197 aa, Parthenium argentatum
  misc_feature: Ceres CLONE ID no.1608106
  misc_feature: Bit score of 331.6 for HMM based on sequences of FIGURE 8.
  misc_feature (44)..(95): Pfam Name: AP2 Pfam Description: AP2 domain
  misc_feature: Functional Homolog Of Ceres SEEDLINE ID no. ME15935 at SEQ ID NO. 644
MDTSSASDCSSSNTGDYAEMELKLASQNPKKRAARKKFKETRHPVYRGVRRRNSGKWVCEVREPNKQSRVWLGTYPTAEMAARAHDVAVLAMRGRSACLNFADSVWRLPVPESSNVKDIQKAAAEAAEAFRETEDIAMETKEMPEVVVYADEEEMFGMPEFIASMAEGMMLPPPQMVGYANFVENVDFWEDLCLWSF

SEQ ID NO: 772 - DNA, 648 bp, Parthenium argentatum
  misc_feature: Ceres CLONE ID no.1604576
  misc_feature: Encodes the peptide sequence at SEQ ID NO. 773
aaaaaaacataaccaaaacaattcactcaacttgcaaattgtaaccaccaactgaaaacatatggacacaccttcagcctcagattgcagcagcagcaataccggcgattatggggaaatggaactaaagcttgcttcgcaaaacccgaagaagagagcggggagaaagaagttcaaggagacacgacacccgatttaccggggagtgaggagaagaaactccgagaaatgggtgtgtgaggtgagagaaccaaataagcaatcgagagtgtggctggggacgtacccgactgccgaaatggcggcccgggcacacgatgtggcggttttggcaatgaggggacggtcggcttgtttaaattttgctgactcggtttggcggctgccagtacccgagtccagcaatgtaaaggatatacaaaaggcagcggccgaggcggcggaggcgtttagagagaccgaggatattgcggtggaaacgaatgaggtgccggaagtcgtggtttatgccgatgaggaggagatgtttggaatgccggaatttattgatagcatggctgaggggatgatgttaccgccacctcagatggtgggggatgctaactttgtggataatgtggatttttggggagacttgtctttatggag

SEQ ID NO: 773 - protein, 195 aa, Parthenium argentatum
  misc_feature: Ceres CLONE ID no.1604576
  misc_feature: Bit score of 323.5 for HMM based on sequences of FIGURE 8.
  misc_feature (44)..(95): Pfam Name: AP2 Pfam Description: AP2 domain
  misc_feature: Functional Homolog Of Ceres SEEDLINE ID no. ME15935 at SEQ ID NO. 644
MDTPSASDCSSSNTGDYGEMELKLASQNPKKRAGRKKFKETRHPIYRGVRRRNSEKWVCEVREPNKQSRVWLGTYPTAEMAARAHDVAVLAMRGRSACLNFADSVWRLPVPESSNVKDIQKAAAEAAEAFRETEDIAVETNEVPEVVVYADEEEMFGMPEFIDSMAEGMMLPPPQMVGDANFVDNVDFWGDLSLW

SEQ ID NO: 774 - protein, 234 aa, Glycine soja
  misc_feature: Public GI ID no.55824656
  misc_feature: Bit score of 332.3 for HMM based on sequences of FIGURE 8.
  misc_feature (63)..(114): Pfam Name: AP2 Pfam Description: AP2 domain
  misc_feature: Functional Homolog Of Ceres SEEDLINE ID no. ME15935 at SEQ ID NO. 644
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVADTTTATAQGVFYMEEEEQVLDMPELLRNMVLMSPTHCLGYEYEDADLDAQDAEVSLWNFSI

SEQ ID NO: 775 - DNA, 1171 bp, Glycine max
  misc_feature: Ceres CLONE ID no.1620272
  misc_feature: Encodes the peptide sequence at SEQ ID NO. 776
agtatatccctcattcactctcttttctccggcagcaccaaaaccacccaacacttgaaatcaatatccattgttaccaaaaaagaaagatcaaaacaccctttacatcattatactcagttccctctttccctatcaaaaccctttcccacaacactactcactctagtagtacaagcaaaaccttctaactttggcttcagcggcacatatatatatatatatagaacatgtataccttgaaccactcttcatatttgtaccatgtttcccctgagctctcctcttccttggactcgtcctcgccggcttccgagggctctcgcggcgtggcattttccgacgaggaggtgcggctggcggtgaggcacccgaagaagcgggccgggcggaagaagttccgggagacgcgccacccggtgtaccggggcgtgaggaggaggaacacggataagtgggtaagtgaggtgagggagcccaacaaaaagaccaggatttggctggggacttttcccacgccggagatggcggcacgggcccacgacgtggcggcaatggccctgaggggccggtatgcctgtctcaacttcgctgactcgacgtggcggttaccaattcccgccactgctaacgcaaaggatatacagaaagcagcagcagaggctgccgaggctttcagaccaagtcagaccttagaaaatacgaatacaaagcaagagtgtgtaaaagtggtgacgacaacaacgatcacagaacaaaaacgaggaatgttttatatggaggaagaagagcaagtgttagatatgcctgagttgcttaggaatatggtgcttatgtccccaacacattgcatagggtatgagtatgaagatgctgacttggatgctcaagatgctgaggtgtccctatggagtttctcaatttaataacgtgcttttggtttggttttttatgttagttttggagtgtgactgtctgtactggttttttattagtagtacggatactagctataggtggcagattgaaagggaccaaaaggaattttcttttgaaaccctttttgtcaaagtaatcaatcgcgtatcatcaagtgaatcccttgatcaagtttatgtatgaattaaataaaagaagaatctagttttggtaaaaaaaaaaaaaaaaaaaa

SEQ ID NO: 776 - protein, 231 aa, Glycine max
  misc_feature: Ceres CLONE ID no.1620272
  misc_feature: Bit score of 333.9 for HMM based on sequences of FIGURE 8.
  misc_feature (63)..(114): Pfam Name: AP2 Pfam Description: AP2 domain
  misc_feature: Functional Homolog Of Ceres SEEDLINE ID no. ME15935 at SEQ ID NO. 644
MYTLNHSSYLYHVSPELSSSLDSSSPASEGSRGVAFSDEEVRLAVRHPKKRAGRKKFRETRHPVYRGVRRRNTDKWVSEVREPNKKTRIWLGTFPTPEMAARAHDVAAMALRGRYACLNFADSTWRLPIPATANAKDIQKAAAEAAEAFRPSQTLENTNTKQECVKVVTTTTITEQKRGMFYMEEEEQVLDMPELLRNMVLMSPTHCIGYEYEDADLDAQDAEVSLWSFSI

SEQ ID NO: 777 - DNA, 1235 bp, Gossypium hirsutum
  misc_feature: Ceres CLONE ID no.1853170
  misc_feature: Encodes the peptide sequence at SEQ ID NO. 778
atctttgcgcttggggcaatgacgcagctagtgaggttccaaccgaggcgcgtctattgctggttgaaaactatttccaaaccccctcttaggcctgggttcagccttggccttcgagaatttctggaagggctcccttcggggtaaagccctacgtagaaaaagaaagctcatttagttaatattttcccttgcatttccaaattcggaagttcatacagcaagtgatttcctaaaatacttggatcctaagtacgaatatccttttcttgaaatatactctttttaagtcaaaagctttgtttaactgaaacttaaactgattactgtttgggttttttttttaaatggattttgtagttcaagattatgatatggttgattctgggtcggtttctgaaagtggaactgatcgtccggtgaatttttccgatgaatatgtgatgttagcttcgagttatccaaagaggcgagctgggaggaagaagttccgggagactcgacacccggtgtaccgtggagttcgccggaggaatcccgggaagtgggtttctgaagtgagggagcctaataagaagtcgaggatttggcttggaactttcccgacggcggatatggcggcgcgtgctcacgacgtggcagctatagcactgagagggaagtcagcttgtttgaacttcgctgactcagcttggaatcttccggtcccggcttcttccgacccaaaggatattcaaaagacggcggcggaggtggcggagactttcagaacggctgagtgttcgtgcgggaattctagaaacgattcaaagagaagtgaaaacacggagatggagaaagggttttatttggacgaagaagcgttgtttgggacacaaagattttgggcaaatatggctgccggtatgatgatgtcacctcctcgttccggtcatgacggaggatgggaagaacatgaagtagatgattatgtacctttatggagttattctatttaaaagtaatttttttcagacattttcaagcattcattggaatttttagttcgtagaaatcgccaccggcaattgccctttatgttttgtacgtacaacggtttttttggattgtacgggtagtgttgtaagtaaaaagattaatgtgtatatatacgatgtatatatacgtcataacttctccaaacaataaatttatagcttcatatctattatattcaaaaaaaaaaaaaaaaaaaa

SEQ ID NO: 778 - protein, 216 aa, Gossypium hirsutum
  misc_feature: Ceres CLONE ID no.1853170
  misc_feature: Bit score of 350.9 for HMM based on sequences of FIGURE 8.
  misc_feature (54)..(105): Pfam Name: AP2 Pfam Description: AP2 domain
  misc_feature: Functional Homolog Of Ceres SEEDLINE ID no. ME15935 at SEQ ID NO. 644
MDFVVQDYDMVDSGSVSESGTDRPVNFSDEYVMLASSYPKRRAGRKKFRETRHPVYRGVRRRNPGKWVSEVREPNKKSRIWLGTFPTADMAARAHDVAAIALRGKSACLNFADSAWNLPVPASSDPKDIQKTAAEVAETFRTAECSCGNSRNDSKRSENTEMEKGFYLDEEALFGTQRFWANMAAGMMMSPPRSGHDGGWEEHEVDDYVPLWSYSI

SEQ ID NO: 779 - protein, 220 aa, Eucalyptus gunnii
  misc_feature: Public GI ID no.79013962
  misc_feature: Bit score of 346.1 for HMM based on sequences of FIGURE 8.
  misc_feature (60)..(111): Pfam Name: AP2 Pfam Description: AP2 domain
  misc_feature: Functional Homolog Of Ceres SEEDLINE ID no. ME15935 at SEQ ID NO. 644
MNPFSSHSHPNSCRFNFAEPPSDSRSATALGNFSHKEVLLASHHPKKRAGRKKFRETRHPVYRGVRLRDSGKWVCEVREPIKKSRIWLGTFPTVEMAARAHDVAALALRGRSACLNFADSAWRLPVPASADTKEIQKAAARAAEAFQSVESEDVMSGDEKKLRSEEGVFYDEEDIFGMPGLLADMAEGMLLSPPKWGGDIYGGEDEGNLGAHTSLWSYSI

SEQ ID NO: 780 - protein, 211 aa, Cocos nucifera
  misc_feature: Public GI ID no.98975385
  misc_feature: Bit score of 314.4 for HMM based on sequences of FIGURE 8.
  misc_feature (47)..(98): Pfam Name: AP2 Pfam Description: AP2 domain
  misc_feature: Functional Homolog Of Ceres SEEDLINE ID no. ME15935 at SEQ ID NO. 644
MESFSSDSMDTPLAQRSASDEEAYATVSSAPPKRRAGRTKFRETRHPVYKGVRRRNADKWVCEVREPNKKSRIWLGTFPTAEMAARAHDVAAIALRGRSACLNFADSAWLCPVPRSSNSKDIQRAAVEAAEAFRPQTERVDAAESREDAAMAMIAGPSLAAADDPFYMEDGLNSGMQGYLDMASGMLMEPPPIYADEEVSDGDVSLWSYSI

SEQ ID NO: 781 - DNA, 741 bp, Populus balsamifera subsp. trichocarpa
  misc_feature: Ceres ANNOT ID no.1438775
  misc_feature: Encodes the peptide sequence at SEQ ID NO. 782
atggtcatgggaggatcaaattcgttctcacctgacaagcaagaatcatctttatcatctttactatccgatagtagcggttctcagcaggactcgcccagttcgaacgagaaagtcttactagcaacaagtcgtccgaaaaagcgtgcagggcggaggatattcaaggagactcgtcatccaatctttagaggtgttaggaagaggaatggcgataaatgggtttgcgaattgcgtgaaccaaataagaagtcacgtatttggctaggcacatatcctacacccgaaatggcagcccgggcacatgatgtagctgctttggcgtttaggggaaaatcagcttgccttaattttgcggactcggcatggaggttgcctgtgcctatttcaaatgaggccaaggacatcaggagggcagcaagtgaggcagcagagttgtttaggacttcagaccttggtggtcaagtaatggaagatttcaggagggaggaccgtggtgaagtttgtagtagtactaatgatgacataagagatttgccatctgaaaatgtggggtatatagacgaagaggcagaatttaacatgccagggttgcttgctagtatggcagaaggccttctactctctcctccacattatactggggactggaatgacggggaaattgatgctgattggtcgttgtggagtaaaaacaagctgacaggctcgatggctattaaacatcagagcatgtcttga

SEQ ID NO: 782 - protein, 244 aa, Populus balsamifera subsp. trichocarpa
  misc_feature: Ceres ANNOT ID no.1438775
  misc_feature: Bit score of 317.2 for HMM based on sequences of FIGURE 8.
  misc_feature (59)..(110): Pfam Name: AP2 Pfam Description: AP2 domain
  misc_feature: Functional Homolog Of Ceres SEEDLINE ID no. ME15935 at SEQ ID NO. 644
MGGSNSFSPDKQESSLSSLLSDSSGSQQDSPSSNEKVLLATSRPKKRAGRRIFKETRHPIFRGVRKRNGDKWVCELREPNKKSRIWLGTYPTPEMAARAHDVAALAFRGKSACLNFADSAWRLPVPISNEAKDIRRAASEAAELFRTSDLGGQVMEDFRREDRGEVCSSTNDDIRDLPSENVGYIDEEAEFNMPGLLASMAEGLLLSPPHYTGDWNDGEIDADWSLWSKNKLTGSMAIKHQSMS

SEQ ID NO: 783 - protein, 240 aa, Prunus avium
  misc_feature: Public GI ID no.23495460
  misc_feature: Bit score of 317.0 for HMM based on sequences of FIGURE 8.
  misc_feature (59)..(111): Pfam Name: AP2 Pfam Description: AP2 domain
  misc_feature: Functional Homolog Of Ceres SEEDLINE ID no. ME15935 at SEQ ID NO. 644
MDMFFSQLSDSVDQPQSSLLSDASVTTRGASCSDGDVILASSRPKKRAGRRVFKETRHPVYRGVRRRNNDKWVCEMREPNKKKSRIWLGTYPTAEMAARAHDVAALAFRGKLACINFADSAWRLPVPASMDTMDIRRAAAEAAEGFRPVEFGGVCSGSSDEKERMVVQVEEKNKKGSVNLERSRSLSLSYWDEEEVFHMPRLLHDMAEGLLLSPSQCLGGYMNLDDMGTDADVKLWSFSI

SEQ ID NO: 784 - protein, 209 aa, Elaeis guineensis
  misc_feature: Public GI ID no.98975377
  misc_feature: Bit score of 311.5 for HMM based on sequences of FIGURE 8.
  misc_feature (47)..(98): Pfam Name: AP2 Pfam Description: AP2 domain
  misc_feature: Functional Homolog Of Ceres SEEDLINE ID no. ME15935 at SEQ ID NO. 644
MESFSSDSLDSPVARQSASDEETYATVWSVPPKRRAGRTKFRETRHPVYKGVRRRNADKWVCEVREPNKKSRIWLGTFPTAEMAARAHDVAAMALRGRSACLNFADSAWLCPVPSSSNPKDIQKAAVLAAEAFRPRTESDATESREDAAMAMSAGPSVAADDPFFTEDRLDFGMQGYLDMAEGLLIDPPPMNADEEESDGGVSLWSYSI

SEQ ID NO: 785 - DNA, 768 bp, Populus balsamifera subsp. trichocarpa
  misc_feature: Ceres ANNOT ID no.1438776
  misc_feature: Encodes the peptide sequence at SEQ ID NO. 786
atggataatttctgccaattctctgatcaacatcctttgaggtcaaattcaatgcccaatgacaggcaagaagcatcttctttctccgatagcagcacgtctcgacgagttgtccattctgatgaagaggtcttactagcaacaagttttccgaaaaaacgcgctggccgcagaatattcagggagactcggcacccggtttttagaggtgttcggaagaggaatggtaacaaatgggtgtgtgagatgcgggaaccaaacaagaagtcacgaatatggttaggaacatatcctacaccagaaatggcagctcgagctcatgatgttgctgctttggcacttagaggcaaatctgcttgccttaacttcgctgattctgcctggaggttgcctgtgccagtttcgaaggattctaaggatattacaagggcagcaaatgaggcagcagaattatttaggcctcaagagtttggtggtcatccggcaaaacaacaagatagcaatgcagtgctagaggattgctcaagtgaagtttgcagcgatgattgcaaaactttccaagaaaatgatgtcttcttcaaggaagcagtgtttgccatgccaggagaaaatgatgtcttcttcgaggaagcagtgtttgacatgccagggttgctcgtggacatggcagaaggtcttctactctctcctccacgttatgtaaggaatgattgcaacgacttggatcatatggagaatggttctgatttgtcgttatggagttattag

SEQ ID NO: 786 - protein, 255 aa, Populus balsamifera subsp. trichocarpa
  misc_feature: Ceres ANNOT ID no.1438776
  misc_feature: Bit score of 323.8 for HMM based on sequences of FIGURE 8.
  misc_feature (66)..(117): Pfam Name: AP2 Pfam Description: AP2 domain
  misc_feature: Functional Homolog Of Ceres SEEDLINE ID no. ME15935 at SEQ ID NO. 644
MDNFCQFSDQHPLRSNSMPNDRQEASSFSDSSTSRRVVHSDEEVLLATSFPKKRAGRRIFRETRHPVFRGVRKRNGNKWVCEMREPNKKSRIWLGTYPTPEMAARAHDVAALALRGKSACLNFADSAWRLPVPVSKDSKDITRAANEAAELFRPQEFGGHPAKQQDSNAVLEDCSSEVCSDDCKTFQENDVFFKEAVFAMPGENDVFFEEAVFDMPGLLVDMAEGLLLSPPRYVRNDCNDLDHMENGSDLSLWSY

SEQ ID NO: 787 - DNA, 992 bp, Gossypium hirsutum
  misc_feature: Ceres CLONE ID no.1853601
  misc_feature: Encodes the peptide sequence at SEQ ID NO. 788
gaaaaatccaaatccaaatccaaatccaaatccaaaaccaaaagattcaactcccaaaaccgaacccagacaccataatctcgaaaccgttttgaaaagtactttactgctccttttgctgcttaaaaacccaacacccataacttgttttttactcaattcaatggatattccaagtcaaacgtgtgacgtccccttctccaagtcttattctatgcgtgctgaaagggtagagccatcttcatcttctgaagggggcattggtggccagcgagctgttcactctgacgaggaagtgcttttactagcgaccaacaggcctaagaaacgagcagggaggagggtattcaaggagacgcggcatccggtttttagaggtgttcgaaggaggaataatgataaatgggtatgcgaattgcgggagcctaataaaaagactcgcatttggcttggaacgtatcccacccctgaaatggctgcccgggcacatgatgtagctgcattagcattcagaggcaaggctgcttgccttaacttcgctgactctgtttggaggttacccgtgcctgcttccaacgatgccgccgatatcaggagagccgcagctgaggcagctgaagcatttaggcctcaagtattccaggaactctccggtagcgacgtcaggcagggaagcttcaaggcttccgattgtgaagtttcgagcagtgacatcaagttggaaaacaagaaaaaaatggcagctgaaggtgaagtttcgacagagaaaattcacttcatggatgaagaagaaatgttctacatgcctaagctgcttgacagcatggctgaagcgcttctactttcaccaccaaggaatcgcgatgaagctgacagtgatatcgatgtgtctttatggagttactcaatctgaagtgtacaaactacaaactactgcaagtgtttgttttgtgtttttttttttttttttgtaatatatgatctttttgtgc

SEQ ID NO: 788 - protein, 249 aa, Gossypium hirsutum
  misc_feature: Ceres CLONE ID no.1853601
  misc_feature: Bit score of 311.4 for HMM based on sequences of FIGURE 8.
  misc_feature (68)..(119): Pfam Name: AP2 Pfam Description: AP2 domain
  misc_feature: Functional Homolog Of Ceres SEEDLINE ID no. ME15935 at SEQ ID NO. 644
MDIPSQTCDVPFSKSYSMRAERVEPSSSSEGGIGGQRAVHSDEEVLLLATNRPKKRAGRRVFKETRHPVFRGVRRRNNDKWVCELREPNKKTRIWLGTYPTPEMAARAHDVAALAFRGKAACLNFADSVWRLPVPASNDAADIRRAAAEAAEAFRPQVFQELSGSDVRQGSFKASDCEVSSSDIKLENKKKMAAEGEVSTEKIHFMDEEEMFYMPKLLDSMAEALLLSPPRNRDEADSDIDVSLWSYSI

SEQ ID NO: 789 - DNA, 901 bp, Glycine max
  misc_feature: Ceres CLONE ID no.1609048
  misc_feature: Encodes the peptide sequence at SEQ ID NO. 790
agctaaaaccagaaactccaaatacctcactccacagttgaacaacaacaccaacaccaacttctggaatgaacattttcaaatccccactggaccatgatttgaactgtggtggaatattccacgactcagcagaagcatcttattcgtctgaaacaaggagcaccccctcagacgaagaagtgattctagcgtcagcgcggccaaagaagcgagcgggaagaagagtcttcaaggagacaaggcaccccgtctaccgaggagtgcgtcgcaggaacaagaacaagtgggtctgcgagatgcgagtccccaacaacaactcacggatttggctcgggacatacccaacgcccgaaatggccgcacgtgcgcacgacgttgcggcgctcgcgctcaggggaaagtccgcgtgcctcaacttcgcggactccaggtggcggctgacggtgccggcgaccaccaacgcggaggagatacggcgagcggcgggggaggctgctgaggcatttgcagttgcagatggggacgacgttaatattgaccaacagcagagtgtgatggccacgaatgatgatgaagttcaagagcctctccagcaggaggaggttcaagacttgcatgatttgcttttgagtattgcgaatgagcctttgatgtctcctccaccctgtgcaagagatggtagggactggaatgacgtggacatatttgatgatgatgaaatctcactgtggaacttctcaatttgacgcgtacgtcattaagagtatgactgtatgcatgtttgatgataagcgaaaacacctttttgtgtgtatgcgattttctatatttttagggacctgttgtgtgtagataaattaagtagcactcgattgattaaaaaaaaaaaaaaaaaaaa

SEQ ID NO: 790 - protein, 226 aa, Glycine max
  misc_feature: Ceres CLONE ID no.1609048
  misc_feature: Bit score of 272.0 for HMM based on sequences of FIGURE 8.
  misc_feature (61)..(112): Pfam Name: AP2 Pfam Description: AP2 domain
  misc_feature: Functional Homolog Of Ceres SEEDLINE ID no. ME15935 at SEQ ID NO. 644
MNIFKSPLDHDLNCGGIFHDSAEASYSSETRSTPSDEEVILASARPKKRAGRRVFKETRHPVYRGVRRRNKNKWVCEMRVPNNNSRIWLGTYPTPEMAARAHDVAALALRGKSACLNFADSRWRLTVPATTNAEEIRRAAGEAAEAFAVADGDDVNIDQQQSVMATNDDEVQEPLQQEEVQDLHDLLLSIANEPLMSPPPCARDGRDWNDVDIFDDDEISLWNFSI

SEQ ID NO: 791 - DNA, 1079 bp, Zea mays subsp. mays
  misc_feature: Ceres CLONE ID no.322305
  misc_feature: Encodes the peptide sequence at SEQ ID NO. 792
tcaaatgctccgactcgttcctccccctgctcgccacgcccacggccactaccactcacacacacaggcagcagccatggacgccgccggctccttcagcgactactcctctggaaccccatcccctgtcgccgccgccggcggcggcgacgacttcggcggctccggctccggctcctcctcctacatgacagtgtcatcggcgccgcccaagcgccgagccgggcggaccaagttcaaggagacgcggcaccccgtgtacaagggcgtgcggcggaggaaccccgggaggtgggtctgcgaggtgcgggagccgcacggcaagcagcggatatggctcgggaccttcgagaccgccgagatggcggcgcgcgcgcacgacgtcgccgcgctcgcgctgcgcggccgcgccgcctgcctcaacttcgccgactcgccgcggctcctcagggtgcccccgacgggctccgggcacgacgagatacgccgcgcggccgccgtggcggcggaccagttccgcccggcgcccgatcagggcaatgtggccgccgaggaggaggcggccgatacaccaccaccggatgccttgcccagcgtgacgatgcagagcgtcgacgacgacccgtactgcattatcgacgacaggctcgacttcgggatgcaggggtacctcgacatggcgcaagggatgctcattgatccgccaccgatggccggttcctccaccagtggcggcggcggcgacgacgatgacgacgacggtgaggtcaagctctggagctactgatggccgatcgcacgtgtgtctgaaggaagacaggttgcattgggcaaataacttccctgtacagccttgggaagaaccggtaccggtgaaatgtactggccgtggccctttcccttcggttcgtctatgctatgtaatgttatgtatcctgctcttctgatgattaagggtattcaggagaagcagaagactgggtttactcggtttgatcgtttaatttaatttggagctagagatgtacctgcatatataatgcatgcacggtaactgtgatataatattcagagtgccg

SEQ ID NO: 792 - protein, 260 aa, Zea mays subsp. mays
  misc_feature: Ceres CLONE ID no.322305
  misc_feature: Bit score of 246.7 for HMM based on sequences of FIGURE 8.
  misc_feature (84)..(135): Pfam Name: AP2 Pfam Description: AP2 domain
  misc_feature: Functional Homolog Of Ceres SEEDLINE ID no. ME15935 at SEQ ID NO. 644
MLRLVPPPARHAHGHYHSHTQAAAMDAAGSFSDYSSGTPSPVAAAGGGDDFGGSGSGSSSYMTVSSAPPKRRAGRTKFKETRHPVYKGVRRRNPGRWVCEVREPHGKQRIWLGTFETAEMAARAHDVAALALRGRAACLNFADSPRLLRVPPTGSGHDEIRRAAAVAADQFRPAPDQGNVAAEEEAADTPPPDALPSVTMQSVDDDPYCIIDDRLDFGMQGYLDMAQGMLIDPPPMAGSSTSGGGGDDDDDDGEVKLWSY

SEQ ID NO: 793 - DNA, 1094 bp, Panicum virgatum
  misc_feature: Ceres CLONE ID no.1823713
  misc_feature: Encodes the peptide sequence at SEQ ID NO. 794
aaaccagatgctccggctcgccccgcccgccccccgccgccgcacccgggcagccatggacgccggcgcgttcgccagcagcgactactactcctcctcggggacgccgtcaccggtcggcggcggcggcggcgcggacggcgacggcgacggctcctccccctcgtcgtacatgacggtgtcgtcggcgccgcccaagcgccgcgccggacggaccaagttcaaggagacgcggcacccggtgtacaagggcgtgcgccggaggaaccccggccgctgggtctgcgaggtgcgggagccgcacggcaagcagcggatatggctcgggaccttcgagaccgccgagatggcggcgcgcgcgcacgacgtcgccgcgctcgcgctccgcggccgcgccgcatgcctcaacttcgccgactcgccgcgcctgctcagggtgcccccgatgggcgcggggcacgacgagatacggcgggcggccgccgtggccgctgagcagttccggccggctcccggtccgggcaatgcggccgccgaggaggtggccgccgcgccgccggaggccttgcctagcgcgccgcagaacttcgatgacccctactgcattgtcgacgacaggctcgacttcgggatgcaggggtacctcgacatggcgcaagggatgctcattgacccgccgccgatggctggttcatccgctagcggcggcgacgacgatgacgataacggtgaggttaagctctggagctactgatccaccgccgcgcgcgtttgaaacttccctgtacagcctatgggaacctagtactggtgaaatgtgtaccggttgccctttcccttctcaagttgccggtaatgttaatgtatcttccctgcgcttctgatgaagtgtgatcaggagaagcagaagactggggctgctcagtttggtagacggttgtgaaagtttggcgctagatcatcgcccttgttgctgcaggatgcatgaggtcagtgatctcgggagtgctgagagcacttgtgtaataagcagaaaaaacaagtggcttgatgtatggatttgcaaactcccccaaaaaaaaaaaaaaaaaaaa

SEQ ID NO: 794 - protein, 248 aa, Panicum virgatum
  misc_feature: Ceres CLONE ID no.1823713
  misc_feature: Bit score of 245.5 for HMM based on sequences of FIGURE 8.
  misc_feature (78)..(129): Pfam Name: AP2 Pfam Description: AP2 domain
  misc_feature: Functional Homolog Of Ceres SEEDLINE ID no. ME15935 at SEQ ID NO. 644
MLRLAPPAPRRRTRAAMDAGAFASSDYYSSSGTPSPVGGGGGADGDGDGSSPSSYMTVSSAPPKRRAGRTKFKETRHPVYKGVRRRNPGRWVCEVREPHGKQRIWLGTFETAEMAARAHDVAALALRGRAACLNFADSPRLLRVPPMGAGHDEIRRAAAVAAEQFRPAPGPGNAAAEEVAAAPPEALPSAPQNFDDPYCIVDDRLDFGMQGYLDMAQGMLIDPPPMAGSSASGGDDDDDNGEVKLWSY

SEQ ID NO: 795 - protein, 216 aa, Arabidopsis thaliana
  misc_feature: Public GI ID no.3660548
  misc_feature: Bit score of 445.9 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDYGFDMEETLVEAIYTAEQSENAFYMHDEAMFEMPSLLANMAEGMLLPLPSVQWNHNHEVDGDDDDVSLWSY

SEQ ID NO: 796 - protein, 216 aa, Nicotiana tabacum
  misc_feature: Public GI ID no.89275008
  misc_feature: Bit score of 449.0 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGSDMEETLVEAIYTAEQSENAFYMHDEAMFEMPSLLANMAEGMLLPLPSVQWNHNHEVDGDDDDVSLWSY

SEQ ID NO: 797 - protein, 216 aa, Capsella bursa-pastoris
  misc_feature: Public GI ID no.120400525
  misc_feature: Bit score of 444.7 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MNSFSAFSEMFGSDYESSVSSGGYYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 798 - protein, 216 aa, Arabidopsis thaliana
  misc_feature: Public GI ID no.56154991
  misc_feature: Bit score of 446.4 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MSSFSAFSEMFGSDYESSISSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDVTTDHGFDMEETLVEAIYTAEQSENAFYMHDEAMFEMPSLLANMAEGMLLPLPSVQWNHNHEVDGDDDDVSLWSY

SEQ ID NO: 799 - protein, 314 aa, Arabidopsis thaliana
  misc_feature: Public GI ID no.2980802
  misc_feature: Bit score of 439.8 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWNPFLEWNLHYVCKTEKRVKTKQISSVKKVYLSTLPENSTHGGVRRVFRPKRRLEEMKMKRRGQKIEMVVEQKKSKEDEDALSLSQGGEEEKRYEEEPYFC

SEQ ID NO: 800 - protein, 314 aa, Arabidopsis thaliana
  misc_feature: Public GI ID no.7269398
  misc_feature: Bit score of 439.0 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWDPFLEWNLHYVCKTEKRGKTKQISSVKKVYLSTLPENSTHGGVRRVFRPKRRLEEMKMKRRGQKIEMVVEQKKSKEDEDALSLSQGGEEEKRYEEEPYFC

SEQ ID NO: 801 - protein, 216 aa, Arabidopsis thaliana
  misc_feature: Public GI ID no.18416557
  misc_feature: Bit score of 436.3 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MNSFSAFSEMFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 802 - protein, 216 aa, Arabidopsis thaliana
  misc_feature: Public GI ID no.56154992
  misc_feature: Bit score of 431.3 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MNSFSAFSEMFGSDYESPVSSGGDYSPKLATSCPKKPAGRKKFRETRHTIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 803 - protein, 216 aa, Arabidopsis thaliana
  misc_feature: Public GI ID no.4091984
  misc_feature: Bit score of 435.2 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MNSCSAFSEMFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 804 - protein, 216 aa, Chorispora bungeana
  misc_feature: Public GI ID no.98980426
  misc_feature: Bit score of 432.9 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MNSFSAFSEMFGSDYESPVSSGGDYSPKLATSCPKKPAGRKKFRETRHPIYRGVRQRNSGKWVCELREPNKKTRIWLGTFQTAEMAARAHDVAAIALRDRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVKGDDDMSLWSY

SEQ ID NO: 805 - protein, 213 aa, Arabidopsis thaliana
  misc_feature: Public GI ID no.1899058
  misc_feature: Bit score of 439.1 for HMM based on sequences of FIGURE 8.
  misc_feature (46)..(97): Pfam Name: AP2 Pfam Description: AP2 domain
  misc_feature: Functional Homolog Of Ceres SEEDLINE ID no. ME15935 at SEQ ID NO. 644
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTDHGLDMEETMVEAIYTPEQSEGAFYMDEETMFGMPTLLDNMAEGMLLPPPSVQWNHNYDGEGDGDVSLWSY

SEQ ID NO: 806 - protein, 213 aa, Arabidopsis thaliana
  misc_feature: Public GI ID no.56154990
  misc_feature: Bit score of 437.9 for HMM based on sequences of FIGURE 8.
  misc_feature (46)..(97): Pfam Name: AP2 Pfam Description: AP2 domain
  misc_feature: Functional Homolog Of Ceres SEEDLINE ID no. ME15935 at SEQ ID NO. 644
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAKAALAFQDETCDTTTTDHGLDMEETMVEAIYTPEQSEGAFYMDEETMFGMPSLLDNMAEGMLLPPPSVQWNHNYDGEGDGDVSLWSY

SEQ ID NO: 807 - protein, 213 aa, Arabidopsis thaliana
  misc_feature: Public GI ID no.18416562
  misc_feature: Bit score of 438.6 for HMM based on sequences of FIGURE 8.
  misc_feature (46)..(97): Pfam Name: AP2 Pfam Description: AP2 domain
  misc_feature: Functional Homolog Of Ceres SEEDLINE ID no. ME15935 at SEQ ID NO. 644
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 808 - protein, 213 aa, Iris lactea var. chinensis
  misc_feature: Public GI ID no.71983373
  misc_feature: Bit score of 435.4 for HMM based on sequences of FIGURE 8.
  misc_feature (46)..(97): Pfam Name: AP2 Pfam Description: AP2 domain
  misc_feature: Functional Homolog Of Ceres SEEDLINE ID no. ME15935 at SEQ ID NO. 644
MNSFSAFSEMLGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTNHGLDMQETMVEAIYTPEQSEGAFYMDEETMFGMPTLLDNMAEGMLLPPPSVQWNHNYDGEGDGEVPLWSY

SEQ ID NO: 809 - protein, 216 aa, Thellungiella salsuginea
  misc_feature: Public GI ID no.41351817
  misc_feature: Bit score of 449.6 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MNSFSAFAEMFGSEYESPVTVGGDYCPTLATSCPKKPAGRKKFRETRHPIYRGVRRRNSGKWVCEVREPNKKSRIWLGTFPTAEMAARAHDVAAIALRGRSACLNFADSAWRLRIPESTCAKDIQKAAAEAAVAFQAEMSDTMTSDHGLDMEETTVEVIVTEEEQSEGFYMDEEAMFGMPRLLANMAEGMLLPPPSVQWGHNYDCDGDADVSLWSY

SEQ ID NO: 810 - protein, 219 aa, Capsella bursa-pastoris
  misc_feature: Public GI ID no.38683266
  misc_feature: Bit score of 418.2 for HMM based on sequences of FIGURE 8.
  misc_feature (51)..(102): Pfam Name: AP2 Pfam Description: AP2 domain
  misc_feature: Functional Homolog Of Ceres SEEDLINE ID no. ME15935 at SEQ ID NO. 644
MNSSFSAFSEMFGSEYESPVSSGGGDYCPTLATSCPKKPAGRKKFRETRHPVYRGVRRRNSGKWVCEVREPNKKSRIWLGTFPTADMAARAHDVAAIALRGRSACLNFADSAWRLRIPESTGAKEIQKAAAEAALAFQDEMMMSDTTTTDHGFDMEETFVEAIVTAEQSASLYIDEEDMFGMPSLMASMAEGMLLPLPSVQWNHNYDIDGDDDVSLWSY

SEQ ID NO: 811 - protein, 216 aa, Arabis pumila
  misc_feature: Public GI ID no.76446191
  misc_feature: Bit score of 428.0 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MSSFSAFSEMFGSDYESMISSVGDYSPTLATSCPKKPAGRKKFRETRHPVYRGVRQRNSGKWVSELREPNKKTRIWLGTFQTAEMAARAHDVAAIALRGRSACLNFADSVWRLRIPESACAKDIQKAAAEAALAFQNELMSDTATTDHGLDMEETLVEAIVTAEQIDTFYIDEETMFGMPSLMANMAEGMLLPLPSIQWINNYDVEGDADMPLWSY

SEQ ID NO: 812 - protein, 223 aa, Capsella bursa-pastoris
  misc_feature: Public GI ID no.39983638
  misc_feature: Bit score of 408.9 for HMM based on sequences of FIGURE 8.
  misc_feature (52)..(103): Pfam Name: AP2 Pfam Description: AP2 domain
  misc_feature: Functional Homolog Of Ceres SEEDLINE ID no. ME15935 at SEQ ID NO. 644
MNSSSFSAFSEMFGSDYESPGSSGGGDYCPTLATSCPKKPAGRKKFRETRHPIYRGVRQRNSGKWVSELREPNKKTRIWLGTFQTAEMAARAHDVAAITLRGRSACLNFADSAWRLRIPESTCAKEIQKAAAEAALAFQDEMGDTTTAATTTTDHGLDKEETMVEATVTPEQSDSLYIDEEAMFGMPSFLDSMAEGMLLPPPSVQWNTNYDVDGDDDLSLWSY

SEQ ID NO: 813 - protein, 214 aa, Brassica napus
  misc_feature: Public GI ID no.5616086
  misc_feature: Bit score of 424.5 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MTSFSTFSEMLGSEYESPVTLGGEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKEIQKAAAEAALAFQAEINNTTTDHGLDMEETIVEAIFTEENNDVFYMDEESMLEMPALLASMAEGMLLPPPSVHFGHNYDFDGDADVSLWSY

SEQ ID NO: 814 - protein, 214 aa, Brassica napus
  misc_feature: Public GI ID no.38426954
  misc_feature: Bit score of 420.8 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MTSFSAFSEMLGSEYESPVTLGGEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKEIQKAAAEAALAFLAEINNTTTDHGLDMEETIVEAIFTEENNDVFYMDEESMLEMPALLASMAEGMLLPPPSVHFGHNYDFDGDADVSLWSY

SEQ ID NO: 815 - protein, 214 aa, Brassica napus
  misc_feature: Public GI ID no.38426948
  misc_feature: Bit score of 417.4 for HMM based on sequences of FIGURE 8.
  misc_feature (48)..(99): Pfam Name: AP2 Pfam Description: AP2 domain
  misc_feature: Functional Homolog Of Ceres SEEDLINE ID no. ME15935 at SEQ ID NO. 644
MTSFSAFSEMLGSEYESPTLSGEYCPTLAASCPKKPAGRKKFRETRHPIYRGVRLRNSGKWVCEVREPNKKSRIWLGTFLTAEIAARAHDVAAIALRGKSACLNFADSAWRLRIPETTCPKDIQKAAAEAAVAFQAEINDTTKDHGLDVEETIVEAIFTEENSDGFYMDEEESMFGMPTLLASMAEGMLLPPPSVQFEYNYDFDGDTDVSLWSY

SEQ ID NO: 816 - protein, 215 aa, Brassica napus
  misc_feature: Public GI ID no.38146944
  misc_feature: Bit score of 411.6 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MTSFSAFSELLGSEHESPVTLGEEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKDIQKAAAEAAVAFQAEINDTTTDHGLDVEETIVEAIFTEENNDGFYMDEEESMFGMPSLVASMAEGMLLPPPSVRFEHNYDFDGDADVSLWSY

SEQ ID NO: 817 - protein, 214 aa, Brassica napus
  misc_feature: Public GI ID no.38426952
  misc_feature: Bit score of 412.9 for HMM based on sequences of FIGURE 8.
  misc_feature (48)..(99): Pfam Name: AP2 Pfam Description: AP2 domain
  misc_feature: Functional Homolog Of Ceres SEEDLINE ID no. ME15935 at SEQ ID NO. 644
MTSFSAFSEMMGSENESPALSGEYCPTLAASCPKKPAGRKKFRETRHPIYRGVRQRHSGKWVCEVREPNKKSRIWLGTFLTAEIAARAHDVAAIALRGKSACLNFADSAWRLRIPETTCPKDIQKAAAEAAVAFQAEINDTTADHGIDVEETIVEAIFTEENNDGFYMDEEESMFGMPALLASMAEGMLLPPPSVQFGHTYDFDGDADVSLWSY

SEQ ID NO: 818 - protein, 214 aa, Brassica napus
  misc_feature: Public GI ID no.20303011
  misc_feature: Bit score of 412.8 for HMM based on sequences of FIGURE 8.
  misc_feature (48)..(99): Pfam Name: AP2 Pfam Description: AP2 domain
  misc_feature: Functional Homolog Of Ceres SEEDLINE ID no. ME15935 at SEQ ID NO. 644
  misc_feature (200)..(200): Xaa is any aa, unknown, or other
  misc_feature (208)..(208): Xaa is any aa, unknown, or other
MTSFSAFSEMMGSENESPALSGEYCPTLAASCPKKPAGRKKFRETRHPIYRGVRQRHSGKWVCEVREPNKKSRIWLGTFLTAEIAARAHDVAAIALRGKSACLNFADSAWRLRIPETTCPKDIQKAAAEAAVAFQAEINDTTTDHGLDVEETIVEAIFTEENNDGFYMDEEESMFGMPSLLASMAEGMLLPPPSVRFEHXYDFDGDAXVSLWSY

SEQ ID NO: 819 - protein, 214 aa, Brassica rapa subsp. pekinensis
  misc_feature: Public GI ID no.66269982
  misc_feature: Bit score of 413.7 for HMM based on sequences of FIGURE 8.
  misc_feature (48)..(99): Pfam Name: AP2 Pfam Description: AP2 domain
  misc_feature: Functional Homolog Of Ceres SEEDLINE ID no. ME15935 at SEQ ID NO. 644
MTSVSAFSETLGSEYESPTLSGEYCPTLAASCPKKPAGRKKFRETRHPIYRGVRLRNSGKWVCEVREPNKKSRIWLGTFLTAEIAARAHDVAAIALRGKSACLNFADSAWRLRIPETTCPKDIQKAAAEAAVAFQAEINDTTKDHGLDVEETIVEAIFTEEDSDGFYMDEEESMFGMPTLLASMAEGMLLPPPSVQFEYNYDFDGDTDISLWSY

SEQ ID NO: 820 - protein, 216 aa, Brassica rapa subsp. chinensis
  misc_feature: Public GI ID no.89212816
  misc_feature: Bit score of 408.6 for HMM based on sequences of FIGURE 8.
  misc_feature (51)..(102): Pfam Name: AP2 Pfam Description: AP2 domain
  misc_feature: Functional Homolog Of Ceres SEEDLINE ID no. ME15935 at SEQ ID NO. 644
MNTFPASTEMVGSENESPVTTVAGGDYYPMLAASCPKKPAGRKKFQETRHPIYRGVRLRKSGKWVCEVREPNKKSRIWLGTFKTAEMAARAHDVAALALRGRGACLNYADSAWRLRIPETTCHKDIQKAAAEAALAFEAEKSDVTMQNGQNMEETIVEAIFTEENNDVFYMDEESMLEMPALLASMAEGMLLPPPSVHFGHNYDFDGDADVSLWSY

SEQ ID NO: 821 - protein, 215 aa, Brassica napus
  misc_feature: Public GI ID no.20303015
  misc_feature: Bit score of 401.8 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
  misc_feature (185)..(185): Xaa is any aa, unknown, or other
MTSFSTFSELLGSEHESPVTLGEEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKEIQKAAAEAAVAFKAEINNTTADHGIDVEETIVEAIFTEENNDGFYMDEEESMFGMPALLASXAEGMLLPPPSVQFGHTYDFDGDADVSLWSY

SEQ ID NO: 822 - protein, 215 aa, Brassica napus
  misc_feature: Public GI ID no.38426950
  misc_feature: Bit score of 398.1 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MTSFSTFSELLGSGHESPVTLGEEYCPKLAASCPKKPAGRKKFRETRHPVYRGVRLRNSGKWVCEVREPNKKSRIWLGTLLTAEIAARAHDVAAIALRGKTACLNFADSAWRLRIPETTCPKEIQKAAAEAAVAFKAEINNTTADHGIDVEETIVEAIFTEENNDGFYMDEEESMFGMPALLASMAEGMLLPPPSVQFGHTYDFDGDADVSLWSY

SEQ ID NO: 823 - protein, 224 aa, Arabidopsis thaliana
  misc_feature: Public GI ID no.15242244
  misc_feature: Bit score of 387.6 for HMM based on sequences of FIGURE 8.
  misc_feature (52)..(103): Pfam Name: AP2 Pfam Description: AP2 domain
  misc_feature: Functional Homolog Of Ceres SEEDLINE ID no. ME15935 at SEQ ID NO. 644
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGVREGERRAEEQNGGVFYMDDEALLGMPNFFENMAEGMLLPPPEVGWNHNDFDGVGDVSLWSFDE

SEQ ID NO: 824 - protein, 225 aa, Arabidopsis thaliana
  misc_feature: Public GI ID no.116831599
  misc_feature: Bit score of 387.6 for HMM based on sequences of FIGURE 8.
  misc_feature (52)..(103): Pfam Name: AP2 Pfam Description: AP2 domain
  misc_feature: Functional Homolog Of Ceres SEEDLINE ID no. ME15935 at SEQ ID NO. 644
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGVREGERRAEEQNGGVFYMDDEALLGMPNFFENMAEGMLLPPPEVGWNHNDFDGVGDVSLWSFDEG

SEQ ID NO: 825 - DNA, 905 bp, Triticum aestivum
  misc_feature: Ceres CLONE ID no.1052602
  misc_feature: Encodes the peptide sequence at SEQ ID NO. 826
aacaaaaaacactttaaaatccaaaaagaaagaaagagaaattaaacatcttatccaaaatcaagactctgttttcgtttcattcgatggatccattttacacttctttttcagattccttcctctcgatccccgaccacaggtctcctgtttctgacagtagtgagtgttctccaaagctagcttcgagctgtccgaagaaactagcagggagaaagaagtttcgtgagacacgtcatccgatttacagaggagttcgtcagagaaactcagggaaatgggtttgtgaagttagggagcctaataagaagtcgaggatttggttagggacttttccgacagtcgaaatggccgctcgtgctcacgacgtcgccgctttagcccttcgtggccgctccgcttgtcttaatttcgccgactcggcttggcgtctacggattcctgagtctacttgtcctaaagaaattcagagagctgcggctgaagctgcaatggcgtttcagaacaagacggctacgactgagacgactatggttgaggcagtgaaaccggcagaggagacggttgggcaaacgggtggggagaccatggaagagaacggtgtgttttatatggccgaagaagcggttttggggatgccaaggtttcttgagaatatgggggaggagatgctcttgccgccgccggaacttggatggaatcataacgacttggccggagatgctgacgtgtcactctggagtttttagaatttgaatcttctcttattattcagattttgtaagattttttgaatttctaggattggtcaaaagttcaactacctactttttattggtagactggtagtacgatacggaaagagaatggagatatacaaatctaataaattctatattactatt

SEQ ID NO: 826 - protein, 220 aa, Triticum aestivum
  misc_feature: Ceres CLONE ID no.1052602
  misc_feature: Bit score of 388.3 for HMM based on sequences of FIGURE 8.
  misc_feature (52)..(103): Pfam Name: AP2 Pfam Description: AP2 domain
  misc_feature: Functional Homolog Of Ceres SEEDLINE ID no. ME15935 at SEQ ID NO. 644
MDPFYTSFSDSFLSIPDHRSPVSDSSECSPKLASSCPKKLAGRKKFRETRHPIYRGVRQRNSGKWVCEVREPNKKSRIWLGTFPTVEMAARAHDVAALALRGRSACLNFADSAWRLRIPESTCPKEIQRAAAEAAMAFQNKTATTETTMVEAVKPAEETVGQTGGETMEENGVFYMAEEAVLGMPRFLENMGEEMLLPPPELGWNHNDLAGDADVSLWSF

SEQ ID NO: 827 - protein, 231 aa, Hevea brasiliensis
  misc_feature: Public GI ID no.66269671
  misc_feature: Bit score of 381.3 for HMM based on sequences of FIGURE 8.
  misc_feature (66)..(117): Pfam Name: AP2 Pfam Description: AP2 domain
  misc_feature: Functional Homolog Of Ceres SEEDLINE ID no. ME15935 at SEQ ID NO. 644
MDVFPQYSDSLPFATHSCSLHYPESSTLSDTCSALRANLSDEEVLLASSYPKKRAGRKKFRETRHPIYRGVRRRNSGKWVCEIREPNKKSRIWLGTFPTEEMAARAHDVAALALRGRSACLNFADSSWRLPVPASREAKDIRKAAAEAAMAFQPEGTEGFSGELKQENKWTTESAPEDVFYMDEEAVFAMPGLLASMAEGMLLPPPQCVAGSGGEDGEMDAADVSLWSFSI

SEQ ID NO: 828 - DNA, 768 bp, Populus balsamifera subsp. trichocarpa
  misc_feature: Ceres ANNOT ID no.1468919
  misc_feature: Encodes the peptide sequence at SEQ ID NO. 829
atggatcttttcagtcattattctgatccaagcccatttggggcaacagatttctggtcagtttttaatgagaataatggtattaatcaagaacagtgttcttattctcctgttctttcagatagtagtattagtagtaatgttactacaagagttcagccagctccaaatttttctgatgaggaagtaatgctagcttcgaggaatccgaagaagagggcagggagaaagaaattcagggaaacaaggcatccggtgtatagaggggtgaggaggaggaattcaggtaagtgggtttgtgaagttagagagcccaataagaaatcaagaatttggttagggactttccctactgctgaaatggctgctagggcacatgatgttgctgctttggcattgaggggtaggtctgcttgcttgaattttgcggattctgcttggaggttgccggttccggcttctagtgaagctaaggacattcaaaaggctgcagctgaggcagctgggggttttcggccggaggggtgtgtgggaggtgagttgatgaggacgggagatgagggggagaaggcggcggagactactgcagaggcgggggaggaggtgttttatatggatgatgaggctgtttttggaatgccagggttgttggctaatatggctgaagggatgttattgccaccacctcattgtggtggtggaggggatggttgggataacatggaaaatattgacgctgatatgccattatggagtttttctatatag

SEQ ID NO: 829 - protein, 255 aa, Populus balsamifera subsp. trichocarpa
  misc_feature: Ceres ANNOT ID no.1468919
  misc_feature: Bit score of 396.3 for HMM based on sequences of FIGURE 8.
  misc_feature (85)..(136): Pfam Name: AP2 Pfam Description: AP2 domain
  misc_feature: Functional Homolog Of Ceres SEEDLINE ID no. ME15935 at SEQ ID NO. 644
MDLFSHYSDPSPFGATDFWSVFNENNGINQEQCSYSPVLSDSSISSNVTTRVQPAPNFSDEEVMLASRNPKKRAGRKKFRETRHPVYRGVRRRNSGKWVCEVREPNKKSRIWLGTFPTAEMAARAHDVAALALRGRSACLNFADSAWRLPVPASSEAKDIQKAAAEAAGGFRPEGCVGGELMRTGDEGEKAAETTAEAGEEVFYMDDEAVFGMPGLLANMAEGMLLPPPHCGGGGDGWDNMENIDADMPLWSFSI

SEQ ID NO: 830 - protein, 222 aa, Lycopersicon hirsutum
  misc_feature: Public GI ID no.72068957
  misc_feature: Bit score of 407.3 for HMM based on sequences of FIGURE 8.
  misc_feature (56)..(107): Pfam Name: AP2 Pfam Description: AP2 domain
  misc_feature: Functional Homolog Of Ceres SEEDLINE ID no. ME15935 at SEQ ID NO. 644
MNIFETYNSDSLISTESSSSSSSSSSSLFSEEEIILASNNPKRPAGRKKFRETRHPIYRGIRKRNSGKWVCEVREPNKKTRIWLGTFPTAEMAARAHDVAALALRGRSACLNFSDSAWRLPIPASSNSKDIQKAAAEAAEIFRPLKESEEVSGESDNSTSPETSENVQESSDFVDEEAIFFMPGLLANMAEGLMLPPPQCAEMGDHYVETDAYMITLWNYSI

SEQ ID NO: 831 - protein, 219 aa, Festuca arundinacea
  misc_feature: Public GI ID no.71534113
  misc_feature: Bit score of 417.2 for HMM based on sequences of FIGURE 8.
  misc_feature (58)..(109): Pfam Name: AP2 Pfam Description: AP2 domain
  misc_feature: Functional Homolog Of Ceres SEEDLINE ID no. ME15935 at SEQ ID NO. 644
MDIFRSYYSDPLAECSSISDSSSSSCNRANLSDEEVILASNNPKKRAGRKKFRETRHPVYRGVRKRNSDKWVCEVREPNKKSRIWLGTFPSAEMAARAHDVAAIALKGRSACLNFADSAWKLPIPASTDAKDIQKAAAEAAEAFRSSEAENMPEYSGEDTKEVNSTPENMFYMDEEALFCMPGLLANMAEGLMLPPPQCSQIGDHMEDDFDMPLWSYSI

SEQ ID NO: 832 - protein, 215 aa, Capsicum annuum
  misc_feature: Public GI ID no.37147896
  misc_feature: Bit score of 405.8 for HMM based on sequences of FIGURE 8.
  misc_feature (59)..(110): Pfam Name: AP2 Pfam Description: AP2 domain
  misc_feature: Functional Homolog Of Ceres SEEDLINE ID no. ME15935 at SEQ ID NO. 644
MNIFRSYYSDPLTESSSSFSDSSIYSPNRAIFSDEEVILASNNPKKPAGRKKFRETRHPVYRGVRKRNSGKWVCEVREPNKKSRIWLGTFPTAEMAARAHDVAAIALRGRSACLNFADSAWRLPVPASSDTKDIQKAAAEAAEAFRPLKLEGISKESSSSTPESMFFMDEEALFCMPGLLTNMAEGLMLPPPQCAEIGDHVETADADTPLWSYSI

SEQ ID NO: 833 - protein, 218 aa, Vitis riparia
  misc_feature: Public GI ID no.57903606
  misc_feature: Bit score of 391.0 for HMM based on sequences of FIGURE 8.
  misc_feature (55)..(106): Pfam Name: AP2 Pfam Description: AP2 domain
  misc_feature: Functional Homolog Of Ceres SEEDLINE ID no. ME15935 at SEQ ID NO. 644
MNTTSPPYSDPHPLVCNWDSLNLPDSDGGSEELMLASTHPKKRAGRKKFRETRHPVYRGVRRRNSGKWVCEVREPNKTSRIWLGTFPTAEMAARAHDVAALALRGRGACLNFADSAWRLHVPSSRDAKDIQKAAAEAAEAFRPMENDGVMQDERREESEVRTPENVFVMDEEDVFGMPGLLVNMAEGLLMPPPHSVADGYGGDDMAADADMSLWSYSI

SEQ ID NO: 834 - protein, 218 aa, Vitis vinifera
  misc_feature: Public GI ID no.92918850
  misc_feature: Bit score of 390.3 for HMM based on sequences of FIGURE 8.
  misc_feature (55)..(106): Pfam Name: AP2 Pfam Description: AP2 domain
  misc_feature: Functional Homolog Of Ceres SEEDLINE ID no. ME15935 at SEQ ID NO. 644
MNTTSPPYSDPHPLVCNWDSLNLPDSDGGSEELMLASTHPKKRAGRKKFRETRHPVYRGVRRRNSGKWVCEVREPNKTSRIWLGTFPTAEMAARAHDVAALALRGRGACLNFADSAWRLHVPSSRDAKDIQKAAAEAAEAFRPMENDGVMQDERREESEVRTPDNVFVMDEEDVFGMPGLLVNMAEGLLMPPPHSVADGYGGDDMAADADMSLWSYSI

SEQ ID NO: 835 - protein, 215 aa, Capsicum annuum
  misc_feature: Public GI ID no.40647095
  misc_feature: Bit score of 402.7 for HMM based on sequences of FIGURE 8.
  misc_feature (59)..(110): Pfam Name: AP2 Pfam Description: AP2 domain
  misc_feature: Functional Homolog Of Ceres SEEDLINE ID no. ME15935 at SEQ ID NO. 644
MNIFRSYYSDPLTESSSSFSDSSIYSPNRAIFSDEEVILASNNPKKPAGRKKFRETRHPVYRGVRKRNSGKWVCEVREPNKKSRIWLGTFPTAEMAARAHDVAAIALRGRSACLNFADSAWRLPVPASSDTKDIQKAAAEAAEALRPLKLEGISKESSSSTPESMFFMDEEALFCMPGLLTNMAEGLMLPPPQCAEIGDHVETADADTPLWSYSI

SEQ ID NO: 836 - DNA, 747 bp, Populus balsamifera subsp. trichocarpa
  misc_feature: Ceres ANNOT ID no.1527711
  misc_feature: Encodes the peptide sequence at SEQ ID NO. 837
atggatgttttctgtagttattctgatcagaacccaattgggtcaatgagtttgttgtcagttcttgacgagcaagaatgttcttattcttctgttctttcagatagtagcatcactagtagtgttactaaaggagttcaaccaggtgcaattttttctgatgaggaagtaatattagcttccaggaatccgaagaagagggcaggaagaaagaagtttagggaaacaaggcatcctgtgtatagaggggtgaggaggaggaattcgggtaagtgggtttgtgaagttagagagcctaataagaaatcaaggatttggttagggacttttcctacggctgatatggctgctagggcacatgatgttgctgctttggcgttgagggggaggtctgcttgcttgaattttgctgattctgcctggaggttgcctactccggcttccagcgatgctaaggatattcagaaggctgcagcggaggcagcagaggctttccggccggaggggagtctgggagttgagttaacgaggacgggagatgaggttgagaaggttgcagggacggcggcgggggatgtgttttatatggatgatgatgcagattttggaatgccaggtttgttggctaatattgcagaagggatgttattgccgccacctaattgttgtggttattccggtggggatagtttggataacatggaaaataatgacaccgacatgtcattatggagtttttctgtttaa

SEQ ID NO: 837 - protein, 233 aa, Populus balsamifera subsp. trichocarpa
  misc_feature: Ceres ANNOT ID no.1527711
  misc_feature: Bit score of 396.1 for HMM based on sequences of FIGURE 8.
  misc_feature (64)..(115): Pfam Name: AP2 Pfam Description: AP2 domain
  misc_feature: Functional Homolog Of Ceres SEEDLINE ID no. ME15935 at SEQ ID NO. 644
MSLLSVLDEQECSYSSVLSDSSITSSVTKGVQPGAIFSDEEVILASRNPKKRAGRKKFRETRHPVYRGVRRRNSGKWVCEVREPNKKSRIWLGTFPTADMAARAHDVAALALRGRSACLNFADSAWRLPTPASSDAKDIQKAAAEAAEAFRPEGSLGVELTRTGDEVEKVAGTAAGDVFYMDDDADFGMPGLLANIAEGMLLPPPNCCGYSGGDSLDNMENNDTDMSLWSFSV

SEQ ID NO: 838 - protein, 219 aa, Malus x domestica
  misc_feature: Public GI ID no.71041116
  misc_feature: Bit score of 403.8 for HMM based on sequences of FIGURE 8.
  misc_feature (56)..(107): Pfam Name: AP2 Pfam Description: AP2 domain
  misc_feature: Functional Homolog Of Ceres SEEDLINE ID no. ME15935 at SEQ ID NO. 644
MDGCSNYYVDPPGESSSASDTSRPMFLTLSDKEVLLASTCPKKRAGRKKFRETRHPVFRGVRRRNSGKWVCEVREPNKKTRIWLGTFPTAEMAARAHDVAAIALRGRSACLNFADSARRLPVPASSNAKDIQTAATEAAEAFRPTEESDEVCGSPVAAPSESTSASEQQQVFYMDEEAVFGMPGLLADMAEGMLLPPPHYSDDDDVDVCADVPLWSFSI

SEQ ID NO: 839 - protein, 219 aa, Nicotiana tabacum
  misc_feature: Public GI ID no.12003384
  misc_feature: Bit score of 418.3 for HMM based on sequences of FIGURE 8.
  misc_feature (58)..(109): Pfam Name: AP2 Pfam Description: AP2 domain
  misc_feature: Functional Homolog Of Ceres SEEDLINE ID no. ME15935 at SEQ ID NO. 644
MDIFRSYYSDPLAEYSSISDSSSSSCNRANHSDEEVMLASNNPKKRAGRKKFRETRHPVYRGVRKRNSDKWVCELREPNKKSRIWLGTFPSAEMAARAHDVAAIALRGRSACLNFADSAWKLPIPASTDAKDIQKAAAEAAEAFRSSEAENMPEYSGEDTKEVNSTPENMFYMDEEALFFMPGLLVNMAEGLMLPPPQCSQIGDHMEADVDMPLWSYSI

SEQ ID NO: 840 - protein, 210 aa, Solanum lycopersicum
  misc_feature: Public GI ID no.18535580
  misc_feature: Bit score of 393.4 for HMM based on sequences of FIGURE 8.
  misc_feature (53)..(104): Pfam Name: AP2 Pfam Description: AP2 domain
  misc_feature: Functional Homolog Of Ceres SEEDLINE ID no. ME15935 at SEQ ID NO. 644
MNIFETYYSDSLILTESSSSSSSSSFSEEEVILASNNPKKPAGRKKFRETRHPIYRGIRKRNSGKWVCEVREPNKKTRIWLGTFPTAEMAARAHDVAALALRGRSACLNFSDSAWRLPIPASSNSKDIQKAAAQAVEIFRSEEVSGESPETSENVQESSDFVDEEAIFFMPGLLANMAEGLMLPPPQCAEMGDHCVETDAYMITLWNYSI

SEQ ID NO: 841 - protein, 205 aa, Solanum lycopersicum
  misc_feature: Public GI ID no.45826358
  misc_feature: Bit score of 386.2 for HMM based on sequences of FIGURE 8.
  misc_feature (49)..(100): Pfam Name: AP2 Pfam Description: AP2 domain
  misc_feature: Functional Homolog Of Ceres SEEDLINE ID no. ME15935 at SEQ ID NO. 644
MFYSDPRIESCSSFSDSIRANHSDEEVILASNNPKKPAGRKKFRETRHPVYRGVRKRNSGKWVCEVREPNKKTRIWLGTFPTAEMAARAHDVAAIALRGRSACLNFADSAWRLPTPDSSDTKDIQKAAAQAAEIFRPLKSEEEESVVKDQSTTPDDMFFMDEEALFCMPGLLTNMAEGLMVPPPQCTEMGDHVEADDMPLWSYSI

SEQ ID NO: 842 - DNA, 753 bp, Sorghum bicolor
  misc_feature: Ceres ANNOT ID no.6085912
  misc_feature: Encodes the peptide sequence at SEQ ID NO. 843
atgctccgacacacgttcctcctcccccccgctcgccacggccaccaccacacccgcccttcacccatggacgccgcatccttcagcgactactcctctggaacgccgtcccctgtcggtggcgtcagcggcggcgtggacggcgacgacggcggctcctcctcgtcgtacatgacggtgtcgtcggcgccgccgaagcggcgagccgggcggaccaagttcaaggagacgcggcaccccgtgtacaagggcgtgcggcggaggaaccccgggaggtgggtctgcgaggtgcgggagccgcacggcaagcagcggatatggctcgggaccttcgagaccgccgagatggcggcgcgcgcgcacgacgtcgccgcgctcgcgctgcgggggcgcgccgcctgcctcaacttcgcagactcgccgcggctcctcagggtgccgcccatgggctccggccatgacgagatacgccgggcggccgccgtcgcggcggaccagttccggccggcgcctgatcgtcagggcaatgtggccaccgccgaggaggcggcggatactacgccgctggatgcgacgacgcagagcgtagtcgatgacccgtactgcattatcgacgacaggctcgacttcgggatgcaggggtacctcgacatggcgcaagggatgctcattgatccaccacccatggctggttcgtccaccagtggcggtgacgacgatgacgacggtgaggtcaagctctggagctactga

SEQ ID NO: 843 - protein, 250 aa, Sorghum bicolor
  misc_feature: Ceres ANNOT ID no.6085912
  misc_feature: Bit score of 248.3 for HMM based on sequences of FIGURE 8.
  misc_feature (80)..(131): Pfam Name: AP2 Pfam Description: AP2 domain
  misc_feature: Functional Homolog Of Ceres SEEDLINE ID no. ME15935 at SEQ ID NO. 644
MLRHTFLLPPARHGHHHTRPSPMDAASFSDYSSGTPSPVGGVSGGVDGDDGGSSSSYMTVSSAPPKRRAGRTKFKETRHPVYKGVRRRNPGRWVCEVREPHGKQRIWLGTFETAEMAARAHDVAALALRGRAACLNFADSPRLLRVPPMGSGHDEIRRAAAVAADQFRPAPDRQGNVATAEEAADTTPLDATTQSVVDDPYCIIDDRLDFGMQGYLDMAQGMLIDPPPMAGSSTSGGDDDDDGEVKLWSY

SEQ ID NO: 844 - DNA, 750 bp, Sorghum bicolor
  misc_feature: Ceres ANNOT ID no.6026171
  misc_feature: Encodes the peptide sequence at SEQ ID NO. 845
atggagtacggcgtcgccgacgactacgggtacgggtacggcgggtacgacgaccagcaggatctgccgtcgtcgtcgtccgtggacggtgacgagtacgcgacggtgctgtcggcgccgccgaagcgccccgcgggtcggaccaagttccgggagacgcgtcacccggtgtaccgcggcgtgcggcggcgcgggcccgcggggcggtgggtgtgcgaggtccgggagcccaacaagaagtcccgcatctggctcggcaccttcgccaccgccgaggccgccgcgcgcgcgcacgacgtcgccgcgctcgcgctccgcggccgagccgcctgcctcaacttcgccgactccgcgcgcctgctccgcgtcgaccccgccacgctcgccacccccgacgacatccgacgcgccgccatccagctcgccgaggactcctcttcctccacgccggacgcctccgccgccgccgctgccgtggccgtggcgtcatctgcctccgtcggccaggccacgccctcgtcgtccgcgtaccaggccggggacgacgccacgggggctgcaatgtatggcgccgagtacgcggcggcggcaatgtatggcgctggcatggacttcgaccactcgtattactacgacgggatggtgggcgggaacgagtggcagagcgccggcagcagcgggtggcatagcaacgtggacgccggcgacgacgaaggcgccggcgacatgtcgctctggagctattactga

SEQ ID NO: 845 - protein, 249 aa, Sorghum bicolor
  misc_feature: Ceres ANNOT ID no.6026171
  misc_feature: Bit score of 198.0 for HMM based on sequences of FIGURE 8.
  misc_feature (56)..(108): Pfam Name: AP2 Pfam Description: AP2 domain
  misc_feature: Functional Homolog Of Ceres SEEDLINE ID no. ME15935 at SEQ ID NO. 644
MEYGVADDYGYGYGGYDDQQDLPSSSSVDGDEYATVLSAPPKRPAGRTKFRETRHPVYRGVRRRGPAGRWVCEVREPNKKSRIWLGTFATAEAAARAHDVAALALRGRAACLNFADSARLLRVDPATLATPDDIRRAAIQLAEDSSSSTPDASAAAAAVAVASSASVGQATPSSSAYQAGDDATGAAMYGAEYAAAAMYGAGMDFDHSYYYDGMVGGNEWQSAGSSGWHSNVDAGDDEGAGDMSLWSYY

SEQ ID NO: 846 - DNA, 723 bp, Sorghum bicolor
  misc_feature: Ceres ANNOT ID no.6031706
  misc_feature: Encodes the peptide sequence at SEQ ID NO. 847
atgtgtccgccgatcaagaaggagatgagcgccgagtcgtcggcctcagcctcggcctcgccctcggcctcgtcggagcaccagaccgtgtggacgtcgccgccgaagcggccggcggggcggaccaagttccgcgagacgcggcaccccgtgttccgcggcgtccggcgccggggcaacgccgggcggtgggtgtgcgaggtgcgcgtgccggggaggcgcggctgcaggctctggctcggcacattcgacaccgccgaggccgcggcgcgcgcgcacgacgccgccatgctcgccatcgccggcgcgggcgcgtgcctcaacttcgccgattcggcttggctcctcgcggtcccggcctcgtacgccagcctcgccgaggtccgccacgcggttgccgaggccgtagaggatttccagcgccgcgagggcgagggcgaggcggccgccggggaggacgacgcgcgctcggccacctcgtcgtcagtgccgtccacctcatcgggcaatgaggacgacgccgctgccactgacggcgaggagtcttcgccggccacggaggactcgtcgccgttcgagatggacgtgttcaatgacatgagctgggatctgtactacgcgagcatggcgcaggggatgctcatggagctgccgtccgcagttccggcgttcggggacgacggctacgccaatgtcgccgatgtgccactgtggagctactag

SEQ ID NO: 847 - protein, 240 aa, Sorghum bicolor
  misc_feature: Ceres ANNOT ID no.6031706
  misc_feature: Bit score of 203.9 for HMM based on sequences of FIGURE 8.
  misc_feature (50)..(103): Pfam Name: AP2 Pfam Description: AP2 domain
  misc_feature: Functional Homolog Of Ceres SEEDLINE ID no. ME15935 at SEQ ID NO. 644
MCPPIKKEMSAESSASASASPSASSEHQTVWTSPPKRPAGRTKFRETRHPVFRGVRRRGNAGRWVCEVRVPGRRGCRLWLGTFDTAEAAARAHDAAMLAIAGAGACLNFADSAWLLAVPASYASLAEVRHAVAEAVEDFQRREGEGEAAAGEDDARSATSSSVPSTSSGNEDDAAATDGEESSPATEDSSPFEMDVFNDMSWDLYYASMAQGMLMELPSAVPAFGDDGYANVADVPLWSY

SEQ ID NO: 848 - DNA, 615 bp, Arabidopsis thaliana
  misc_feature: Ceres SEEDLINE ID no.ME16594
  misc_feature: Genomic Sequence
  misc_feature: Expected Sequence
  misc_feature: Encodes the peptide sequence at SEQ ID NO. 850
atggagaaatcaccaagatacagagataaagcaaagaacttgcttccttcaccaagcagctgcaccactacaccgaccagatacgttaaagacgacatgtatgaaaccactttcatccgaaccgatccttcttccttcaagcaagtcgtccaactgctcaccggaatccccaagaacccgacccaccaacccgacccgagatttcctccttttcactcaatccctccgatcaaagccgtgaccaacaagaaacaatcttcgtccttccgactctccgaacgtcgcaactcgatgaagcattatctcaacatcaacccgacccattccgggccacccgagattctcactcccaccatcttgaattttccggctctcgatctcagccctgacactcctctcatgtctgatccgttttatcgaccggggtcttttagtcagagccctagtgattcgaaaccgagcttcgatgatgaccaagaaagatcgatcaaggagaaagggttttatttgcgcccgtcaccgtcgacaactccgagggatacggagcctcgacttctctctctctttccgatgactccgattcactcgccggcgccttcacctcatgatcattga

SEQ ID NO: 849 - DNA, 615 bp, Arabidopsis thaliana; identical to SEQ ID NO: 848
  misc_feature: Ceres SEEDLINE ID no.ME16594
  misc_feature: Inplanta Sequence
  misc_feature: Encodes the peptide sequence at SEQ ID NO. 850

SEQ ID NO: 850 - protein, 204 aa, Arabidopsis thaliana
  misc_feature: Ceres SEEDLINE ID no.ME16594
  misc_feature: Bit score of 379.9 for HMM based on sequences of FIGURE 9.
  misc_feature (32)..(62): Pfam Name: VQ Pfam Description: VQ motif
MEKSPRYRDKAKNLLPSPSSCTTTPTRYVKDDMYETTFIRTDPSSFKQVVQLLTGIPKNPTHQPDPRFPPFHSIPPIKAVTNKKQSSSFRLSERRNSMKHYLNINPTHSGPPEILTPTILNFPALDLSPDTPLMSDPFYRPGSFSQSPSDSKPSFDDDQERSIKEKGFYLRPSPSTTPRDTEPRLLSLFPMTPIHSPAPSPHDH

SEQ ID NO: 851 - protein, 240 aa, Gossypium hirsutum
  misc_feature: Ceres CLONE ID no.100040598
  misc_feature: Bit score of 499.9 for HMM based on sequences of FIGURE 9.
  misc_feature (57)..(87): Pfam Name: VQ Pfam Description: VQ motif
  misc_feature: Functional Homolog Of Ceres SEEDLINE ID no. ME16594 at SEQ ID NO. 850
METSPRHTTNPNILASPKSLSPNSSTSSTSSGSNTNPPPPTPPPQQPKPITRSESASPYPTTFVQADTSSFKQVVQMLTGSSETAKLASSTKPTPSPLSDSNPKTHIPPIKSIPKNKQNSGFRLYERRSSLKNLKINPLNPAFGSNNSGFSPRKPEILSPSILDFPSLALSPVTPLIPDPFDRSGSSNYTNCINNNANLDKEAEEKAIKEKGFYLHPSPASTPRDSEPRLLPLFPVTSPR

SEQ ID NO: 852 - DNA, 1027 bp, Gossypium hirsutum
  misc_feature: Ceres CLONE ID no.1833093
  misc_feature: Encodes the peptide sequence at SEQ ID NO. 853
ctcccttccttttcttcttcttcttcttctggtcctaaaattcaaacgcccccaaaaaatcaaaatggaaacctcgccgaggcaaaccacgaatcccaatttccttgcatctccgaaaagtctcagtcccaatagcagcaccagcagcacaagcagcggcagcaacacgaacccgccaccgccaactccaccgcctcaacagcccaaaccaatcaccagatctgaatccgccaacccctacccgactaccttcgtccaagccgacacttcttctttcaagcaagtcgtccagatgctcaccggatcctccgagaccgccaagcttgcttcttccaccaaacccactccctcccctctctccgactcaaacctcaaaacccatatccctccgatcaaatccatccccaaaaacaagcagaattctggatttaggctttacgagcgaaggagctccctcaagaatctcaaaatcaaccccttgaacccggcttttggctccaacaattccgggttttcgcctcgtaaacccgaaatactctcccctagcattctcgatttcccttctctggctcttagcccggtcactcctttgatacccgacccctttgaccgttctggatccggaaattatacgaattgtataaataataatgtgaatctagacaaggaagctgaagagaaggcaattaaagagaagggtttttatttgcatccatcaccggcatctacgccgcgagattcggagcctaggcttctccctctttttccagttacttcaccccgagtttcaggttcttctacttcttgaaccaaaaataaaatgactttctttttagttttcgcttcttcttttttctgacgcttgttattgtaagatttttacatattattgttgggcctatggggattgggaatgggacaaagaaggggtggaaacgagacacgatttgtaatgttggttgtttcatatttcaagaggaatgaagataaaaacaaatctttgcttcaaaaaaaaaaaaaaaaaaaa

SEQ ID NO: 853 - protein, 247 aa, Gossypium hirsutum
  misc_feature: Ceres CLONE ID no.1833093
  misc_feature: Bit score of 534.4 for HMM based on sequences of FIGURE 9.
  misc_feature (57)..(87): Pfam Name: VQ Pfam Description: VQ motif
  misc_feature: Functional Homolog Of Ceres SEEDLINE ID no. ME16594 at SEQ ID NO. 850
METSPRQTTNPNFLASPKSLSPNSSTSSTSSGSNTNPPPPTPPPQQPKPITRSESANPYPTTFVQADTSSFKQVVQMLTGSSETAKLASSTKPTPSPLSDSNLKTHIPPIKSIPKNKQNSGFRLYERRSSLKNLKINPLNPAFGSNNSGFSPRKPEILSPSILDFPSLALSPVTPLIPDPFDRSGSGNYTNCINNNVNLDKEAEEKAIKEKGFYLHPSPASTPRDSEPRLLPLFPVTSPRVSGSSTS

SEQ ID NO: 854 - DNA, 1035 bp, Gossypium hirsutum
  misc_feature: Ceres CLONE ID no.1847967
  misc_feature: Encodes the peptide sequence at SEQ ID NO. 855
aacagcaatcaatccttgtttttcacttctctttttctgttcttctccaaccaaacaaatttttttttctcttacagggtaaagggggggggtgttagagatcaccaatcaccacacccatcaatggagaattcatcaaggttagtacaagacaacaagaacttgaacttcccatcatcctcatcttcatcatctcctttaaactccccacatagcaatggaaccaaccacaacaacagcaatgggggtgtccaaattcccaccccacctttaactccaatccccatctccagatctgagaccaacccttacccaacaacctttgtccaagctgacacaactacttttaaacaggttgtccaaatgctcactggttcatccgaaactgctaaacaagcctcctctaagcctccaacacaacatcatcatcatcatcatcatcaacaagatccagcactcccatcaaaatcatcttttcctatacctcccatgaaaaccaactcccccaagaagcaaaatttcaagctttatgagagaagaaacagtaacctgaagaacaacctcatgatcaacactttccttccttctaacaacggtggaggtggtggtgctttttattcgccgaggaatgcagagatcttgtctccaagcttgcttgacttcccaaagctagcacttagcccggttacaccattaaatgaagaccctttcaacaagtcttcaccttctttagggaattcatctgaggaagagaaagctatagctgagaaaggcttttacttgcatccatcacctatgtcaacacctagagatactgagcctcagcttttaccactttttcctgttacttcaccaagagtttcaggctcttcttaaacatatgttagtttgagagtgatttgtcaagtgggttttggctgaaatttgagtgataaaaaaaaaaaggaagttaagaagatctttcttcaattgtatgatttggtctccctttgtatggtaaagctcttctttttagaaaaaaaaaaaaaaaaaaaa

SEQ ID NO: 855 - protein, 250 aa, Gossypium hirsutum
  misc_feature: Ceres CLONE ID no.1847967
  misc_feature: Bit score of 297.9 for HMM based on sequences of FIGURE 9.
  misc_feature (61)..(91): Pfam Name: VQ Pfam Description: VQ motif
  misc_feature: Functional Homolog Of Ceres SEEDLINE ID no. ME16594 at SEQ ID NO. 850
MENSSRLVQDNKNLNFPSSSSSSSPLNSPHSNGTNHNNSNGGVQIPTPPLTPIPISRSETNPYPTTFVQADTTTFKQVVQMLTGSSETAKQASSKPPTQHHHHHHHQQDPALPSKSSFPIPPMKTNSPKKQNFKLYERRNSNLKNNLMINTFLPSNNGGGGGAFYSPRNAEILSPSLLDFPKLALSPVTPLNEDPFNKSSPSLGNSSEEEKAIAEKGFYLHPSPMSTPRDTEPQLLPLFPVTSPRVSGSS

SEQ ID NO: 856 - DNA, 765 bp, Populus balsamifera subsp. trichocarpa
  misc_feature: Ceres ANNOT ID no.1502190
  misc_feature: Encodes the peptide sequence at SEQ ID NO. 857
atggaaacctcaccaagacatcgagataatcaaaacccacagtctctgtttccttcaccaactagctacagcagcagcagcaacagcaacagcaacagcagctccaccaccgccaccacaaataatgttgcactcaacaacaatattaaccaccctccaccacttccatcacccaaacccatttccagatccgaatccactaacccatacccgacaacttttgtccaagctgacagttcttccttcaaacaagtagtccagatgttgactggatcacccaaacccaaacctacatgcaccaccaccaccaccaccaccaccacgacccccaacacctcacaagtcgacccattacctaaaacccacaacatccctccaattaaatccatgcccaaaaagaaccagtcttccgggttcaagctttatgaacgtagaaactcactcaagaacctcaagatcaaccctttaaatccaatttttgcccaacccagttcaggtttttcttcaaggaaaccagagatcctctccccaagcattctcgatttcccagctcttgttttaagcccggttactcctttaatacccgacccgtttgaccgatccggatcggcaaagtatactaataaggagaaagcaattaaagagaaaggattttacttgcacccgtcacccggatcctcaccaagagaaacggagccccgattgctgcctctatttcctattacctcaccaagaatttcaggttctgttaatccttcatcctaa

SEQ ID NO: 857 - protein, 254 aa, Populus balsamifera subsp. trichocarpa
  misc_feature: Ceres ANNOT ID no.1502190
  misc_feature: Bit score of 517.0 for HMM based on sequences of FIGURE 9.
  misc_feature (68)..(98): Pfam Name: VQ Pfam Description: VQ motif
  misc_feature: Functional Homolog Of Ceres SEEDLINE ID no. ME16594 at SEQ ID NO. 850
METSPRHRDNQNPQSLFPSPTSYSSSSNSNSNSSSTTATTNNVALNNNINHPPPLPSPKPISRSESTNPYPTTFVQADSSSFKQVVQMLTGSPKPKPTCTTTTTTTTTTPNTSQVDPLPKTHNIPPIKSMPKKNQSSGFKLYERRNSLKNLKINPLNPIFAQPSSGFSSRKPEILSPSILDFPALVLSPVTPLIPDPFDRSGSAKYTNKEKAIKEKGFYLHPSPGSSPRETEPRLLPLFPITSPRISGSVNPSS

SEQ ID NO: 858 - DNA, 840 bp, Populus balsamifera subsp. trichocarpa
  misc_feature: Ceres ANNOT ID no.1449186
  misc_feature: Encodes the peptide sequence at SEQ ID NO. 859
atggaaacctcaccaagacatcgagataatcaaaacccacagtctctgtttccttcaccaactagctacagcagcagcagcaacagcaacagcaacagcagctccaccaccgccaccacaaataatgttgcactcaacaacaatattaaccaccctccaccacttccatcacccaaacccatttccagatccgaatccactaacccatacccgacaacttttgtccaagctgacagttcttccttcaaacaagtagtccagatgttgactggatcacccaaacccaaacctacatgcaccaccaccaccaccaccaccaccacgacccccaacacctcacaagtcgacccattacctaaaacccacaacatccctccaattaaatccatgcccaaaaagaaccagtcttccgggttcaagctttatgaacgtagaaactcactcaagaacctcaagatcaaccctttaaatccaatttttgcccaacccagttcaggtttttcttcaaggaaaccagagatcctctccccaagcattctcgatttcccagctcttgttttaagcccggttactcctttaatacccgacccgtttgaccgatccggatcggcaaagtatactaatagttttagtcccattaacacctccaccaccaacaacaataacgttgttaatgctgaggcaatggatactgatgcagaggagaaagcaattaaagagaaaggattttacttgcacccgtcacccggatcctcaccaagagaaacggagccccgattgctgcctctatttcctattacctcaccaagaatttcaggttctgttaatccttcatcctaa

SEQ ID NO: 859 - protein, 279 aa, Populus balsamifera subsp. trichocarpa
  misc_feature: Ceres ANNOT ID no.1449186
  misc_feature: Bit score of 513.2 for HMM based on sequences of FIGURE 9.
  misc_feature (68)..(98): Pfam Name: VQ Pfam Description: VQ motif
  misc_feature: Functional Homolog Of Ceres SEEDLINE ID no. ME16594 at SEQ ID NO. 850
METSPRHRDNQNPQSLFPSPTSYSSSSNSNSNSSSTTATTNNVALNNNINHPPPLPSPKPISRSESTNPYPTTFVQADSSSFKQVVQMLTGSPKPKPTCTTTTTTTTTTPNTSQVDPLPKTHNIPPIKSMPKKNQSSGFKLYERRNSLKNLKINPLNPIFAQPSSGFSSRKPEILSPSILDFPALVLSPVTPLIPDPFDRSGSAKYTNSFSPINTSTTNNNNVVNAEAMDTDAEEKAIKEKGFYLHPSPGSSPRETEPRLLPLFPITSPRISGSVNPSS

SEQ ID NO: 860 - DNA, 711 bp, Populus balsamifera subsp. trichocarpa
  misc_feature: Ceres ANNOT ID no.1466723
  misc_feature: Encodes the peptide sequence at SEQ ID NO. 861
atggaaacctcagcaagatttcaagaaaccagaaacccatctccaataaactcgcctcatggcaatggaagcaacaatggggtccaagttcacacctcaacagtcactccaatacccatctccagatctgacactaacccttacccaacaacctttgtccaagcagacacttctactttcaaacaagttgtccagatgctcactggctcaacagagacagcaaaacaggcttcctcgaagacaacccaagatccaccaacaacaccgactcaaacttcaagaaactacgccatccctcctatcaagaacatgccggccaagagacaacaaaacagcttcaaactttatgaaagaagaaacaacagcttcaaaaacagtctcatgatcaacactctattgcctagttttgcaaacagtagtaacgcttccccagttaccgggttttcgccaagaaacaaaccagagatcttgtctccaagcttgcttgacttccctaaacttacacttagccctgtaaccccattaaatgaagatccttttaacaagtgctcaccttctttagggaattcatcatcagaagaggagagagcaatagcagagaaaggtttttatttgcatccgtcgcctatctctacccctagagattcagagccccagttgctgtcgctttttcctgtaacctcaccgaaagtctcaggctcttcttcatga

SEQ ID NO: 861 - protein, 236 aa, Populus balsamifera subsp. trichocarpa
  misc_feature: Ceres ANNOT ID no.1466723
  misc_feature: Bit score of 301.2 for HMM based on sequences of FIGURE 9.
  misc_feature (46)..(76): Pfam Name: VQ Pfam Description: VQ motif
  misc_feature: Functional Homolog Of Ceres SEEDLINE ID no. ME16594 at SEQ ID NO. 850
METSARFQETRNPSPINSPHGNGSNNGVQVHTSTVTPIPISRSDTNPYPTTFVQADTSTFKQVVQMLTGSTETAKQASSKTTQDPPTTPTQTSRNYAIPPIKNMPAKRQQNSFKLYERRNNSFKNSLMINTLLPSFANSSNASPVTGFSPRNKPEILSPSLLDFPKLTLSPVTPLNEDPFNKCSPSLGNSSSEEERAIAEKGFYLHPSPISTPRDSEPQLLSLFPVTSPKVSGSSS

SEQ ID NO: 862 - protein, 204 aa, Arabidopsis thaliana
  misc_feature: Public GI ID no.21805688
  misc_feature: Bit score of 371.8 for HMM based on sequences of FIGURE 9.
  misc_feature (32)..(62): Pfam Name: VQ Pfam Description: VQ motif
  misc_feature: Functional Homolog Of Ceres SEEDLINE ID no. ME16594 at SEQ ID NO. 850
  misc_feature (140)..(140): Xaa is any aa, unknown, or other
  misc_feature (150)..(150): Xaa is any aa, unknown, or other
MEKSPRYRDKAKNLLPSPSSCTTTPTRYVKDDMYETTFIRTDPSSFKQVVQLLTGIPKNPTHQPDPRFPPFHSIPPIKAVTNKKQSSSFRLSERRNSMKHYLNINPTHSGPPEILTPTILNFPALDLSPDTPLMSDPFYXPGSFSQSPSXSKPSFDDDQERSIKEKGFYLRPSPSTTPRDTEPRLLSLFPMTPIHSPAPSPHDH

SEQ ID NO: 863 - protein, 247 aa, Arabidopsis thaliana
  misc_feature: Public GI ID no.9795609
  misc_feature: Bit score of 391.2 for HMM based on sequences of FIGURE 9.
  misc_feature (53)..(83): Pfam Name: VQ Pfam Description: VQ motif
  misc_feature: Functional Homolog Of Ceres SEEDLINE ID no. ME16594 at SEQ ID NO. 850
MENSPRYREATNLIPSPRCHNSNNSCGMSSSSESNKPPTTPTRHVTTRSESGNPYPTTFVQADTSSFKQVVQMLTGSAERPKHGSSLKPNPTHHQPDPRSTPSSFSIPPIKAVPNKKQSSSSASGFRLYERRNSMKNLKINPLNPVFNPVNSAFSPRKPEILSPSILDFPSLVLSPVTPLIPDPFDRSGSSNQSPNELAAEEKAMKERGFYLHPSPATTPMDPEPRLLPLFPVTSPRVSGSSSASTS

SEQ ID NO: 864 - protein, 247 aa, Arabidopsis thaliana
  misc_feature: Public GI ID no.13877535
  misc_feature: Bit score of 382.6 for HMM based on sequences of FIGURE 9.
  misc_feature (53)..(83): Pfam Name: VQ Pfam Description: VQ motif
  misc_feature: Functional Homolog Of Ceres SEEDLINE ID no. ME16594 at SEQ ID NO. 850
MENSPRYREATNLIPSPRCHNSNNSCGMSSSRESNNPPSTPTRHVTTRSESGNPYPTTFDQADTSSFKQVVQMLTGSGERPKHGSSIKPNPTHHQPDPRSTPSSFSIPPIKAVPNKKQSSSSASGFRLYERRNSMKNLKINPLNPVFNPVNSAFSPRKPEILSPSILDFPSLVLSPVTPLIPDPFDRSGSSNQSPNELAAEEKAMKERGFYLHPSPATTPMDPEPRLLPLFPVTSPRVSGSSSASTS

SEQ ID NO: 865 - protein, 219 aa, Arabidopsis thaliana
  misc_feature: Public GI ID no.15232547
  misc_feature: Bit score of 199.8 for HMM based on sequences of FIGURE 9.
  misc_feature (33)..(63): Pfam Name: VQ Pfam Description: VQ motif
  misc_feature: Functional Homolog Of Ceres SEEDLINE ID no. ME16594 at SEQ ID NO. 850
MEISTNPPSSSSSSVSSSIINGSLHHHIITRSDHYPTTFVQADSSSFKQVVQMLTGSSSPRSPDSPRPPTTPSGKGNFVIPPIKTAQPKKHSGNKLYERRSHGGFNNNLKNSLMINTLMIGGGGAGSPRFSPRNQEILSPSCLDFPKLALNSPVTPLKQGTNGNEGDPFDKMSPLSEEERGIADKGYYLHRSPISTPRDSEPQLLPLFPVTSPRLSPEM

SEQ ID NO: 866 - protein, 243 aa, Arabidopsis thaliana
  misc_feature: Public GI ID no.15238851
  misc_feature: Bit score of 179.8 for HMM based on sequences of FIGURE 9.
  misc_feature (45)..(75): Pfam Name: VQ Pfam Description: VQ motif
  misc_feature: Functional Homolog Of Ceres SEEDLINE ID no. ME16594 at SEQ ID NO. 850
MEVSTSSMSSKPEQMQNPPPMISSPRFQPQIISPHHHDQHQHLSNPYPTTFVQADTSTFKQVVQMLTGSSTDTTTGKHHEAPSPVNNNNKGSSFSIPPIKKTNSFKLYERRQNNNNMFAKNDLMINTLRLQNSQRLMFTGGNSSHHQSPRFSPRNSSSSENILLSPSMLDFPKLGLNSPVTPLRSNDDPFNKSSPLSLGNSSEEDKAIADKGFYLHPSPVSTPRDSQPLLLPLFPVASPARNS

SEQ ID NO: 867 - DNA, 907 bp, Arabidopsis thaliana
  misc_feature: Ceres CLONE ID no.123863
  misc_feature: Encodes the peptide sequence at SEQ ID NO. 868
attaatggaagtttcaacatcatccatgtcttcaaaaccagaacaaatgcaaaacccacctcctatgatctcatctcctaggtttcagcctcagataatatctcctcatcatcatgaccagcatcaacatctctcaaatccttatccaacaacatttgttcaagcagacacttctactttcaaacaagtcgttcagatgcttaccggctcatccaccgataccaccaccggaaaacaccacgaagctccttatccggtgaacaacaacaacaagggatcaagtttctcgattccacccatcaagaaaaccaacagcttcaagctttacgagagaagacaaaacaacaacaacatgttcgctaagaatgacctaatgatcaatacgttaaggcttcaaaactctcagagattgatgttcacaggaggaaacagcagtcatcatcaaagcccgagattctctccaagaaacagttcatcatcagaaaatattcttctgtctccaagcatgctggattttccgaagctagggctaaacagtcccgtgacgccactgagaagcaacgatgaccccttcaacaagtcatcacctttgtcattagggaactcatcggaagaagacaaagccattgctgataagggcttttatcttcatccatctccagtctcaactcctagagactctcagccactgcttcttcctctttttccggttgcttctccggcgaggaactcttaatcccgacgatatccatgagtgattttatacatgatattaaattatatctatctccggattttgtttagctataactaagatatctataagtttgatcatagttatggagtgactgtaaattttgtgcggtttttttcactttcaatctcaaaaattaattgcaatatatgt

SEQ ID NO: 868 - protein, 243 aa, Arabidopsis thaliana
  misc_feature: Ceres CLONE ID no.123863
  misc_feature: Bit score of 179.3 for HMM based on sequences of FIGURE 9.
  misc_feature (45)..(75): Pfam Name: VQ Pfam Description: VQ motif
  misc_feature: Functional Homolog Of Ceres SEEDLINE ID no. ME16594 at SEQ ID NO. 850
MEVSTSSMSSKPEQMQNPPPMISSPRFQPQIISPHHHDQHQHLSNPYPTTFVQADTSTFKQVVQMLTGSSTDTTTGKHHEAPYPVNNNNKGSSFSIPPIKKTNSFKLYERRQNNNNMFAKNDLMINTLRLQNSQRLMFTGGNSSHHQSPRFSPRNSSSSENILLSPSMLDFPKLGLNSPVTPLRSNDDPFNKSSPLSLGNSSEEDKAIADKGFYLHPSPVSTPRDSQPLLLPLFPVASPARNS

SEQ ID NO: 869 - DNA, 1191 bp, Glycine max
  misc_feature: Ceres CLONE ID no.652496
  misc_feature: Encodes the peptide sequence at SEQ ID NO. 870
  misc_feature (368)..(368): n is a, c, t, g, unknown, or other
acaagctcaataagcaaaaacaaccctctttccttttttttatttttcttcctcaagccttgttttttcactcttctatatttcttctccaatccccacccaaatcacccctaaccctttgaaagattttaatttgtttgttttggtgcaaggagagagagaggagagtgagagatggaaatcagctcaaggcttcaagaaagagagaaccacaaccacatccataaccataaccacccttgctcctatgaactctccaacagrgcaatgtgagcaactgcatgagcagcagcaacagcaatggcatccaaatcccaacaccaccactcactcccaaaaccattcccagatctgattccaacccttancctaccacttttgtccaagctgacacctccactttcaagcaagtagtccaaatgctaactggctcatcagacaccacaaaacaagcatcacaagatccacaaccaccacaaccaccatcatcatcatcatccagaaacttcaacataccccccatcaaggccccaccaaagaagcaacaaggaggcttcaagctctatgagaggaggaacagcctcaagaacagcctcatgctcaacaccttgatgcccaattttgcttataatcacaacaacaattctccaagcttctcaccaagaaacaacatgcctgagatcctctccccaagccttcttgacttcccttcccttgctctaagccctgttacaccattgaatgatgacccttttgacaagtcctccccttcattggggaactcgtcagaggaggataaagccatagctgaaaagggcttctacttgcatccctctcccatgaccactccaagagactcagaaccacagctcttgcctttgttcccagttacctcacctagagtctcatcacaatcaccttcttgatcttgatgagatgaaaagagattgtgttcctgtgctgtggatgattggttaattacatcatgggttttttattttgatttgaatatggtttatggtttcctctatcaacaaggtacaaaagcttttgtctaattgtaaaagtggctttcttaccatgaaatggcaactcttttctttattctcctgctttgttttcccacctcaaaatattggtatcttttcttgttttccctttccataaatgaaaaaaaaagtttctttgtac

SEQ ID NO: 870 - protein, 214 aa, Glycine max
  misc_feature: Ceres CLONE ID no.652496
  misc_feature: Bit score of 272.7 for HMM based on sequences of FIGURE 9.
  misc_feature (27)..(57): Pfam Name: VQ Pfam Description: VQ motif
  misc_feature: Functional Homolog Of Ceres SEEDLINE ID no. ME16594 at SEQ ID NO. 850
  misc_feature (29)..(29): Xaa is any aa, unknown, or other
MSSSNSNGIQIPTPPLTPKTIPRSDSNPXPTTFVQADTSTFKQVVQMLTGSSDTTKQASQDPQPPQPPSSSSSRNFNIPPIKAPPKKQQGGFKLYERRNSLKNSLMLNTLMPNFAYNHNNNSPSFSPRNNMPEILSPSLLDFPSLALSPVTPLNDDPFDKSSPSLGNSSEEDKAIAEKGFYLHPSPMTTPRDSEPQLLPLFPVTSPRVSSQSPS

SEQ ID NO: 871 - DNA, 1638 bp, Glycine max
  misc_feature: Ceres CLONE ID no.1656707
  misc_feature: Encodes the peptide sequence at SEQ ID NO. 872
aaagcaaagcaagcctctatactctctttcttcctttcttcaaagccttatttttcactcttccatacatctatccatctatcttctccaattttcatccaaaccaaaccctttcttctctcttccttagtttcggtacaaggcacaaacaaagcacccttcatcaatcaatggaaatcagcttaaggctccaagacacagaaaccccaccttccatgaacaactccccaagaagcaatctgagcaacaactgctgcaccaattataataatagcattggcatccaaatccccaccacaccaaaaaccatcctcagatctgactccacgaatccttaccccaccacctttgtccaagctgacacttccactttcaaacaggttgttcaaatgctcactggctcatcagaaaccacaaagccacaactacaacaacaacaacaacaacaacaacaagatctagttcaaccacaatcatcatcatcgaagaacttcaacattcctccaatgaaagcaacaccaaagaagcagcaagggttcaagctctatgagaggaggaacaacaacaacaaccaccacctcaagaacaccctcatgatcaacaccttggtccccaattttgcacacagctcaggattctcctcatcacaccacaacaagccagagatcctctccccaagcttgcttgacttcccttccctcactctcagcagccctgtcactcctttgaatgatgacccttttgataagtcctcctcaccttcattgggaagcacttcctcagaggaggagagagccatagctgaaaaagggttctacttgcatccctctcccatgtcaactccaagagactctgagcctcagctcttgcctttgttccctgtgacttcacctagagtttctgagtcaccttcttgaagaaaaccgaattgaaccgaaccgaactggaaaacagattgttgtgtttcatcatcatcatcaagctatgatatagagaatgattatcatttgattttcaattgaaaggtacatagcttgctcaaattgtaaacttgtttccttccacgaaatgaagatgatgccctctttctcctcttaattagatgagtttttctttcttttatcttttttttaaaattttgatttgcctcttcatgttccaatttctgttactaaaccacgcatccaaaagggaataatcataagccagagagggtgtagcaatttatgatcatgtgtgtatcaattcaatttcacaccaaccactaaagagaagttatgaagagactcagaaggcaaagggagggctaggaaatgaggattattgcttgggacacatttttactgcacaacagtgtacgcactaaggacttgactgtatcctatgtctctcatcaaagatagctgtacccaaaaggaagtgagtgggtcaactcaatgaaggttcaagggggtccctcttcttggtatttatgtaaaatgtagtcttaattatttttctaagcaattaaaacccacataaaaatggtgatgtgttttgggttttggtttttggtttttggttttcccttgtctgacttctattggatgaaaattgaaattggaaaattattagttctaaaaaaaaaaaaaaaaaaaa

SEQ ID NO: 872 - protein, 248 aa, Glycine max
  misc_feature: Ceres CLONE ID no.1656707
  misc_feature: Bit score of 296.6 for HMM based on sequences of FIGURE 9.
  misc_feature (54)..(84): Pfam Name: VQ Pfam Description: VQ motif
  misc_feature: Functional Homolog Of Ceres SEEDLINE ID no. ME16594 at SEQ ID NO. 850
MEISLRLQDTETPPSMNNSPRSNLSNNCCTNYNNSIGIQIPTTPKTILRSDSTNPYPTTFVQADTSTFKQVVQMLTGSSETTKPQLQQQQQQQQQDLVQPQSSSSKNFNIPPMKATPKKQQGFKLYERRNNNNNHHLKNTLMINTLVPNFAHSSGFSSSHHNKPEILSPSLLDFPSLTLSSPVTPLNDDPFDKSSSPSLGSTSSEEERAIAEKGFYLHPSPMSTPRDSEPQLLPLFPVTSPRVSESPS

SEQ ID NO: 873 - DNA, 682 bp, Glycine max
  misc_feature: Ceres CLONE ID no.1660346
  misc_feature: Encodes the peptide sequence at SEQ ID NO. 874
acacactcatcttcttcttcttctttttggttttctctctcacagtgagtcagcagcaatggactccatttccccaagagctcaagagaataataacactacggcgaaggccatgatgacgagatccgaaccagcgaacccatacccgacaacgttcgtccaagctgacacatcctccttcaagcaagtagtccaaatgctaaccggctcctcggagacagcgaaacaagcagccgccggcggctcctcgaaaccttcgaactcgatcccacccatgaaatccatacccaacaaaaagcatttttctaagctctacgagcgcagagcaaactccctgaacctcaagaacatcaaccccctcacctcgtttttctcgaaccacaacactaattccccccgaaaacccgacatcctctcccccagcatcctcgacttccccgcactcgttctcagccccgtcacgcctctcattcccgaccctttcgaccgatccaacgccgccatcgattccgaagctgaagacaaagccatcaaagagaaaggtttcttctttcacccttctcccagagacaaatctcaaccccgcttgctccctctcttcccacaacttctcccagagcctcctccaatgctccttcttccgctcctccttcttaattttgtgtaagattcttaatttatg

SEQ ID NO: 874 - protein, 202 aa, Glycine max
  misc_feature: Ceres CLONE ID no.1660346
  misc_feature: Bit score of 314.3 for HMM based on sequences of FIGURE 9.
  misc_feature (27)..(57): Pfam Name: VQ Pfam Description: VQ motif
  misc_feature: Functional Homolog Of Ceres SEEDLINE ID no. ME16594 at SEQ ID NO. 850
MDSISPRAQENNNTTAKAMMTRSEPANPYPTTFVQADTSSFKQVVQMLTGSSETAKQAAAGGSSKPSNSIPPMKSIPNKKHFSKLYERRANSLNLKNINPLTSFFSNHNTNSPRKPDILSPSILDFPALVLSPVTPLIPDPFDRSNAAIDSEAEDKAIKEKGFFFHPSPRDKSQPRLLPLFPQLLPEPPPMLLLPLLLLNFV

SEQ ID NO: 875 - DNA, 858 bp, Glycine max
  misc_feature: Ceres CLONE ID no.565641
  misc_feature: Encodes the peptide sequence at SEQ ID NO. 876
ctctctcagactctcatcaaagtcattaccaatggactccatttccccaaaacctcaagagaataataataataataataataatattccgaagcccatgacgagatcagaacccgcgaactcgtacccaacaacgttcgtccaagcggacacaacctcgttcaagcaagtagtccaaatgctaaccggttcctcggagacagcaaagcaagccgccgccgccgccgccgccgcctcctcctcctcctcctcctcgaaacctgcgaacccgatcccacccatgaaatccatacccaacaagaagcagcagccgcatttttctaagctctacgagcgcagaacaaactccctcaacctcaggaacagtctccacatcaaccccctcacctcgtttttctcgaaccacactaattccccgcgaaaagccgacatcctctcccccagcatccttgacttccccgcactcgtcctcagccccgtcacgcctctcatacccgaccctttcgaccgatccaacgctgccattgattccgaagctgaagtcaaagccatcaaagagaaaggtttcttcttgcatccttctcccagagacaaagctcaacccctcttgctccctctcttccccacaacttctcccagagcctcctcaggtccttcttcttccgctcctccttcttagaattgttttttttaattattatttgctttcccattttgtgtaagattcttaattcatatatatataatttatgttttaattaattactgccattcatgccgattagaggggtgaggagtttcagaaaatttgtaatggttggttaattatcaagagaatggaataatcttaattgcttc

SEQ ID NO: 876 - protein, 215 aa, Glycine max
  misc_feature: Ceres CLONE ID no.565641
  misc_feature: Bit score of 419.5 for HMM based on sequences of FIGURE 9.
  misc_feature (30)..(60): Pfam Name: VQ Pfam Description: VQ motif
  misc_feature: Functional Homolog Of Ceres SEEDLINE ID no. ME16594 at SEQ ID NO. 850
MDSISPKPQENNNNNNNNIPKPMTRSEPANSYPTTFVQADTTSFKQVVQMLTGSSETAKQAAAAAAAASSSSSSSKPANPIPPMKSIPNKKQQPHFSKLYERRTNSLNLRNSLHINPLTSFFSNHTNSPRKADILSPSILDFPALVLSPVTPLIPDPFDRSNAAIDSEAEVKAIKEKGFFLHPSPRDKAQPLLLPLFPTTSPRASSGPSSSAPPS

SEQ ID NO: 877 - protein, 264 aa, Medicago truncatula
  misc_feature: Public GI ID no.87240507
  misc_feature: Bit score of 511.6 for HMM based on sequences of FIGURE 9.
  misc_feature (79)..(109): Pfam Name: VQ Pfam Description: VQ motif
  misc_feature: Functional Homolog Of Ceres SEEDLINE ID no. ME16594 at SEQ ID NO. 850
MDSTSSMRYQEEQKSSLTSLPSPKTQSNGHNHSHNQIPSPRPISLPSPKTQTQSNGHNHNHNHNQIPSPRPITRSEPGNPYPTTFVQADTTSFKQVVQMLTGSSETAKQASTSTKANHNHNIPPKKQQGFKLYERRNSFHKNLNINPLLPPIFSNSTFSPRNKQEILSPSILDFPSLVLSPVTPLIPDPFNRSGSSSSSSAARNGSSLDSLAEDKAIREKGFFLHPSPRAASTSRDSEPRLLPLFPTSSPRASGPSSSSKYSAS

SEQ ID NO: 878 - DNA, 988 bp, Triticum aestivum
  misc_feature: Ceres CLONE ID no.678878
  misc_feature: Encodes the peptide sequence at SEQ ID NO. 879
ccatccccttccccccctctcttcttctccatcaatccccgacgaaaccaaccaaccaacaatggaagttgctgcgcccaagcaactcctccccatggcgccgcgggaccccaactccccgtcctcctccacctcctcctcctcgccgtcttccgccgcgtcgccctccagccaccggcccagcccgctgccgccgtccccgaggcccgtgccccgcaccatcgacaccacccccttccccaccaccttcgtccaggccgacaccgcctccttcaagcaggtcgtccagatgctcaccggcgccgacatgcctccgccgtcctcgcagccgcaggcccagagccagaggccccccgcggccgccaacagcaaggccggcgcgccgtgccggcccaagaagccggcgttcaagctctacgagcgccggagcagcatgaagaacctcaagatgatcgcgccgctcgccatggcggccgccgcgggggcgtcgccgaggaaggcgctgccggagctgctgtcgcccagcgtgctcgacttcccgtcgctggcgctcagccccgtcacgccgctggtgtccgaccccttcaaccggtccgcgtccgcgtccccggcggagcaggaggcggccgcggagcgcgcggccatcgcgcgcaagggcttcttcctgcacccgtcgccgcggggcggcgccggcgagcccccgccgcgcctgctgccgctgttccccgtcacctccccccggatggcctccgccaccgcgccgtcgtcggagtgaagcgatccagcccgcgcgtggagcgcgcatggcatattactgaattgtccggagtagctcgtcctcggtgctagtatgttgtaatttttgctcgcttgcttgagcgacggctcgcgaaggaacggaaaaggatcacactctttgagctcctcccctcccctgtcctgttcttggtggatcggtgctaattgtgcctaatttactctcagaatt

SEQ ID NO: 879 - protein, 237 aa, Triticum aestivum
  misc_feature: Ceres CLONE ID no.678878
  misc_feature: Bit score of 416.3 for HMM based on sequences of FIGURE 9.
  misc_feature (57)..(87): Pfam Name: VQ Pfam Description: VQ motif
  misc_feature: Functional Homolog Of Ceres SEEDLINE ID no. ME16594 at SEQ ID NO. 850
MEVAAPKQLLPMAPRDPNSPSSSTSSSSPSSAASPSSHRPSPLPPSPRPVPRTIDTTPFPTTFVQADTASFKQVVQMLTGADMPPPSSQPQAQSQRPPAAANSKAGAPCRPKKPAFKLYERRSSMKNLKMIAPLAMAAAAGASPRKALPELLSPSVLDFPSLALSPVTPLVSDPFNRSASASPAEQEAAAERAAIARKGFFLHPSPRGGAGEPPPRLLPLFPVTSPRMASATAPSSE

SEQ ID NO: 880 - DNA, 1091 bp, Triticum aestivum
  misc_feature: Ceres CLONE ID no.1325382
  misc_feature: Encodes the peptide sequence at SEQ ID NO. 881
aaatcctcttctcccccttcccttcccttcctcctcgcccccgagaagctcacgcatcccaactctaaccatacgcagacgcaaggcttcaatggagccgtgcaccaagcagttcctccccatgcctccgcaggaccccaactccccgtcgtcctccacctcctcttcctcctcctcctccacctcgccgtcccacccctaccaccgcgcgcagccgccgcacccacacaacctcccgccctcgcccaggcccgtcccccgcaccatcgagaccaccccgttccccaccaccttcgtccaggccgacaccacctccttcaagcagatcgtccagatgctcaccggctccgagcagtcctccaagagcgccgccgcggcgacgaccaacggcagcgccgggaaccaggcggcgagcgggagcgggccgtgccgcccgaagaagccgtccttcaagctgtacgagcggcggagcagcctcaagaacctcaagatgatcgcgccgctggccatgggcgcgccgccgtcgccgaggaacgcctccgccgcgccggagatcctgtcgccgagcgtcctggacttcccgtccctgaagctcagcagcccggtgacgccgctcaccggcgaccccttcttcccctcgccggcgtcgtcctcgggggacgccgcggagcgcgcggccatcgccgacaagggcttcttcttccacccttcgccgcggggcgccgagccgccgcggctcctcccgctgttccccgtcagctcgcccaggatggccgccgcgtccgcgacggcggcgccggccgagtgagtggcccaaagcctccgcctttgcgcgcgcatcctgctcagccagccatgaagtactctacgacttctactatcgtcgctgtatcatcgccgtcctttgttcgcagttctagttccatagtagtaagtaaggtgtttgctgtgtcgttcttcgccggcgccggcgccgccgctgttgtaatttttgctcccttcttgaaaggaagaggggagttggttctcttttggggctgcgactcgattaatcgattaattacagcttcatttcaaaaaaaaaaaaaaaa

SEQ ID NO: 881 - protein, 238 aa, Triticum aestivum
  misc_feature: Ceres CLONE ID no.1325382
  misc_feature: Bit score of 503.0 for HMM based on sequences of FIGURE 9.
  misc_feature (62)..(92): Pfam Name: VQ Pfam Description: VQ motif
  misc_feature: Functional Homolog Of Ceres SEEDLINE ID no. ME16594 at SEQ ID NO. 850
MEPCTKQFLPMPPQDPNSPSSSTSSSSSSSTSPSHPYHRAQPPHPHNLPPSPRPVPRTIETTPFPTTFVQADTTSFKQIVQMLTGSEQSSKSAAAATTNGSAGNQAASGSGPCRPKKPSFKLYERRSSLKNLKMIAPLAMGAPPSPRNASAAPEILSPSVLDFPSLKLSSPVTPLTGDPFFPSPASSSGDAAERAAIADKGFFFHPSPRGAEPPRLLPLFPVSSPRMAAASATAAPAE

SEQ ID NO: 882 - DNA, 874 bp, Zea mays subsp. mays
  misc_feature: Ceres CLONE ID no.340102
  misc_feature: Encodes the peptide sequence at SEQ ID NO. 883
ccgtgaaaccaacgcccctctctccccgcgcacgagacccatcgcgaatggaagttgctcctgcggtgaagcaactcctccccatggcgcagggccccaactccccgtcctcctccaccacctcctcctcgccctcgccctcggccgccgcgccgtccccgccgccgcgccagcagcagtcgcagtcgcaggcgcccgtgccgcgcatcatcgacaccacgcccttccccaccaccttcgtgcaggccgacacggccagcttcaaggaggtcgtccagaggctcaccggctccgacacgccgccgcctgcccagaagcccgccaagacccacggccaccaccaccaccaccacggcggcggcggcgtcgggcccaagaagccggccttcaagctctacgagcgccggatcggcaagaacaacctcaagatgatcgcgccgctggcggggccgtcgccgcggaaggcggcgccggaggtgctgtcgcccagcgtgctcgacttcccttccctggcgctcggtagccccgtcacgccgctgctggccgaccccttcaaccggtcggcgtcggcgtccccgggcgagcaggacgaggccgcggcggccatcgcgcagaggggcttcttcctgcacccctcgccgaggggcgtcgagccgccgcggctgctgccgctgttccccgtcacgtcccccaagatggcgccgtggccgtcgcagcagtgatcgggggcgggcccccgctgccggagaattcctagtactgccgcttcagatactacttgtttaattaactccttggtgcgtcatgtatttttgctcatggtattcaactcttgagcgatcgcgaaggaacggaaagaaagatcacactcttg

SEQ ID NO: 883 - protein, 224 aa, Zea mays subsp. mays
  misc_feature: Ceres CLONE ID no.340102
  misc_feature: Bit score of 431.7 for HMM based on sequences of FIGURE 9.
  misc_feature (58)..(88): Pfam Name: VQ Pfam Description: VQ motif
  misc_feature: Functional Homolog Of Ceres SEEDLINE ID no. ME16594 at SEQ ID NO. 850
MEVAPAVKQLLPMAQGPNSPSSSTTSSSPSPSAAAPSPPPRQQQSQSQAPVPRIIDTTPFPTTFVQADTASFKEVVQRLTGSDTPPPAQKPAKTHGHHHHHHGGGGVGPKKPAFKLYERRIGKNNLKMIAPLAGPSPRKAAPEVLSPSVLDFPSLALGSPVTPLLADPFNRSASASPGEQDEAAAAIAQRGFFLHPSPRGVEPPRLLPLFPVTSPKMAPWPSQQ

SEQ ID NO: 884 - DNA, 921 bp, Zea mays
  misc_feature: Ceres CLONE ID no.1558265
  misc_feature: Encodes the peptide sequence at SEQ ID NO. 885
agtctgccccctccgtgaaaccaacgcccctccctccccgcgcgaatggaagttgctcctgcggtgaagcaactcctccccatggcgcggggccccaactccccgtcctcctccaccacctcctcctcgccctcgccctcggccgccgcgccgtccccgccgccgcgccagcagcagtcgcaggcgcccgtgccgcgcatcatcgacaccacgcccttccccaccaccttcgtgcaggccgacacggccagcttcaagcaggtcgtccagaggctcaccggctccgacacgccgccgcctgcccagaagcccgcgaagacccacggccaccaccaccaccacggcggcggcgtcgggcccaagaagccggccttcaagctctacgagcgccggatcggcaagaacaacctcaagatgatcgcgccgctggcggggccgtcgccgtcgccgcggaaggcggcgccggaggtgttgtcgcccagcgtgctcgacttcccttccctggcgctcggtagccccgtcacgccgctgctggccgaccccttcaaccggtcggcgtcggcgtccccgggcgagcaggacgaggccgaggccgcggccatcgcgcagaggggcttcttcctgcacccctcgccgaggggcgccgtcgagccgccgcggctgctgccgctgttccccgtcacgtcccccaagatggcgcagtgatcggggcgggaccccgctgccggagaattcctagtactgccgcttgagatactacttgttcaattaactacttggtgcgtcatgtatttttttttgtttttttttgctcatggtattcaactcttgagcgatcgcgaaggaacggaaagaaagatcacactcttgagcttaaaaaaaaaaaaaaaaaaaaaaaaaaaaagaaaaaaaaaaaaaaaa

SEQ ID NO: 885 - protein, 219 aa, Zea mays
  misc_feature: Ceres CLONE ID no.1558265
  misc_feature: Bit score of 454.8 for HMM based on sequences of FIGURE 9.
  misc_feature (56)..(86): Pfam Name: VQ Pfam Description: VQ motif
  misc_feature: Functional Homolog Of Ceres SEEDLINE ID no. ME16594 at SEQ ID NO. 850
MEVAPAVKQLLPMARGPNSPSSSTTSSSPSPSAAAPSPPPRQQQSQAPVPRIIDTTPFPTTFVQADTASFKQVVQRLTGSDTPPPAQKPAKTHGHHHHHGGGVGPKKPAFKLYERRIGKNNLKMIAPLAGPSPSPRKAAPEVLSPSVLDFPSLALGSPVTPLLADPFNRSASASPGEQDEAEAAAIAQRGFFLHPSPRGAVEPPRLLPLFPVTSPKMAQ

SEQ ID NO: 886 - DNA, 1171 bp, Zea mays subsp. mays
  misc_feature: Ceres CLONE ID no.330491
  misc_feature: Encodes the peptide sequence at SEQ ID NO. 887
accaacgccaccaaaaccaacactccgatggatgttttcaccaagcaactcctccccatgcctcaccagcgggaccccaactacccttcctcttccacctcttcctcctcgtcgtcgtcctcctccacgcccccatctcgccctcaccaccgtgcgcaaccccagccccacaacctcccccagtcccccagacccgtcccgcgcaccatcgacaccaccccgttccccaccaccttcgtccaggccgacaccacctcgttcaagcaggtcgtccagatgctcaccggcgccgagcagccggccaacaacgacgcgacgacggcgggcgcagccgctgccgctgccgccaacggcggtggcgccggcgcccaggcggccagcggtggaccgtgctgccggcccaagaagccgtcgttcaagctgtacgagcggcggagcagcctgaagaacctgaagatgatcgcgccgctggcgatgggctcgccgccgtcgccgtcgccgcggagggcggcgccggagatcctgtcgccgagcgtgctggacttcccgtccctcacgctcagcccggtgacgccgctcgccggcgacccctttaaccgctcgccggcgtcggcgtcgtcctccgaggaggccgagcgcgcggccatcgccgagaggggcttcttcctccacccgtccccgaggggcgccgagcccccgcgcctgctcccgctcttccccgtcgtctcgccccggatggccggcgccgcggcggcgccgtcgtccgagtgaagatcccccgacgcgggcgcgcgcctgctctaccgtagccgccgccgccgccaccaccaccaccatcagtactactactactacaacaaccgtcgccgtcgccgtaccgtccgtccttgtttcgtgaggtgcttgctttgctgttcttcttgatcgacgccgctgtaatttttgcccccttcttgcttttcttggaacgggcgaggaagggagttctctctctctctctctttttttttgcttcgtttcggagcggcgacacgcgagcgatcagcgatctgacgatccaggctcgctcggttcctgatcgctcgcgtcgcgggagcctccggccgggatgaaatgatgggatggatgaattagacagttaataattaatgaagcctaatctgaagatttg

SEQ ID NO: 887 - protein, 247 aa, Zea mays subsp. mays
  misc_feature: Ceres CLONE ID no.330491
  misc_feature: Bit score of 467.1 for HMM based on sequences of FIGURE 9.
  misc_feature (64)..(94): Pfam Name: VQ Pfam Description: VQ motif
  misc_feature: Functional Homolog Of Ceres SEEDLINE ID no. ME16594 at SEQ ID NO. 850
MDVFTKQLLPMPHQRDPNYPSSSTSSSSSSSSSTPPSRPHHRAQPQPHNLPQSPRPVPRTIDTTPFPTTFVQADTTSFKQVVQMLTGAEQPANNDATTAGAAAAAAANGGGAGAQAASGGPCCRPKKPSFKLYERRSSLKNLKMIAPLAMGSPPSPSPRRAAPEILSPSVLDFPSLTLSPVTPLAGDPFNRSPASASSSEEAERAAIAERGFFLHPSPRGAEPPRLLPLFPVVSPRMAGAAAAPSSE

SEQ ID NO: 888 - DNA, 746 bp, Zea mays
  misc_feature: Ceres CLONE ID no.992304
  misc_feature: Encodes the peptide sequence at SEQ ID NO. 889
atcatcttcctcctcttctctcctctcctcttactcttccccaccaacactccgatggatgttttcaccaagcaactcctccccatgcctcaccagcgggaccccaactacccttcctcttccacctcttcctcctcgtcgtcgtcctcctccacgcccccatctcgccctcaccaccgtgcgcaaccccaaccccaaccccacaacctcccccagtcccccagacccgtcccgcgcaccatcgacaccaccccgttccccaccaccttcgtccaggccgacaccacctcgttcaaacaggtcgtccagatgctcaccggcgccgagcagccggccaacaacgacgcgacgacggcgggcgcagccgctgccgctgccgccaacggcggcggcgccggggcccaggcgggcagcggcggaccgtgctgccggcccaagaagccgtcgttcaagctgtacgagcggcggagcagcctgaagaacctgaagatgatcgcgccgctggcgatgggctcgccgccgtcgccgtcgccgtcgccgcggagggcggcgccggagatcctgtcgccgagcgtgctggacttcccgtccctcacgctcagcccggtgacgccgctcgccggcgaccccttcaaccgctcgccggcgtcggcgtcgtcctccgaggaggccgagcgcgccgccatcgccgagaggggcttcttcctccacccgtccccgaggggcgccgagcccccgcgcctgct

SEQ ID NO: 889 - protein, 230 aa, Zea mays
  misc_feature: Ceres CLONE ID no.992304
  misc_feature: Bit score of 394.0 for HMM based on sequences of FIGURE 9.
  misc_feature (66)..(96): Pfam Name: VQ Pfam Description: VQ motif
  misc_feature: Functional Homolog Of Ceres SEEDLINE ID no. ME16594 at SEQ ID NO. 850
MDVFTKQLLPMPHQRDPNYPSSSTSSSSSSSSSTPPSRPHHRAQPQPQPHNLPQSPRPVPRTIDTTPFPTTFVQADTTSFKQVVQMLTGAEQPANNDATTAGAAAAAAANGGGAGAQAGSGGPCCRPKKPSFKLYERRSSLKNLKMIAPLAMGSPPSPSPSPRRAAPEILSPSVLDFPSLTLSPVTPLAGDPFNRSPASASSSEEAERAAIAERGFFLHPSPRGAEPPRL

SEQ ID NO: 890 - DNA, 1082 bp, Zea mays
  misc_feature: Ceres CLONE ID no.1509925
  misc_feature: Encodes the peptide sequence at SEQ ID NO. 891
ctgccttgctgcgccggactccctcacagtcacggaggcgaaggcgacgtttttcttcttccctttttaccatggaggcaaccacccaggagcgccccgcgccgccgccgccgtcgccgtcgtcggtgcagatgcagctgccgcacgcggccgccgacccgtccaaccctttcccgaccaccttcgtgcaggccgacaccacctccttcaagcaggtcgtgcagatcctcaccggcaccccggagaccgcggccgcggcggcggcggggggcgcggcgggcgcgccggcagctaagccggcccccacgccgaccgggcccaagaagccggccttcaagctctacgagcggcgcggcagcatgaagagcctgaagatgctctgcccgctcctccccgccgccttcgccgccggcggctccggtggctgcagcgggttctccccgcgggggttctcgccgcgcgggctggaggtgctgtcgcccagcatgctggacttcccgtcgctggcgctggggagccccgtgacgccgctcccgccgctgccggggtcgcgggaggcagccgcggccgaggaccgcgccatcgtcgagaaggggttctacctccacccctcgccgcgcggcaatgccagcggccgcggcgacctgacgccgccgcccaggctgctcccgctcttccccttgcagtcgcccacccggcagtgagcctcgcccgctccttgctggtatgctctgctctgctctgctcacccggtcgctgctaaaatgctaggctcccggagcgcgaggtcgattcgatctgtggattatttgctcctcttctctccccgggaggatccgtgtatgcccctgtgttgtaatcttagtgtctgtaacagcgatttggctcataagagggattaattgatcactccaccggcccgagtgttctttgtctctttaccattggctattagtagtttcatactggcagcagtagtagtagatttagcttggcattttcctcttctcgcttcgtgaacttgtcttgtcatattactagtttggtgttgcaaatcttgtacatcaaaaaaaaaaaaaaaa

SEQ ID NO: 891 - protein, 210 aa, Zea mays
  misc_feature: Ceres CLONE ID no.1509925
  misc_feature: Bit score of 191.8 for HMM based on sequences of FIGURE 9.
  misc_feature (32)..(62): Pfam Name: VQ Pfam Description: VQ motif
  misc_feature: Functional Homolog Of Ceres SEEDLINE ID no. ME16594 at SEQ ID NO. 850
MEATTQERPAPPPPSPSSVQMQLPHAAADPSNPFPTTFVQADTTSFKQVVQILTGTPETAAAAAAGGAAGAPAAKPAPTPTGPKKPAFKLYERRGSMKSLKMLCPLLPAAFAAGGSGGCSGFSPRGFSPRGLEVLSPSMLDFPSLALGSPVTPLPPLPGSREAAAAEDRAIVEKGFYLHPSPRGNASGRGDLTPPPRLLPLFPLQSPTRQ

SEQ ID NO: 892 - DNA, 1194 bp, Zea mays
  misc_feature: Ceres CLONE ID no.1543852
  misc_feature: Encodes the peptide sequence at SEQ ID NO. 893
aagatctgagccagtggccacaccacacatgaagcagaatagtattccagttccaggtccaggcatgctcaagctgaaacaaagcaagccaagcactcatctcatcccctccaagcaattgattccagatcccaaagctccaaaaattccactcccgaaaagcccataaaaccccatgactctctctctctctctctcaccctgtcttcctcactcccaagagaagccagccaagccaaacctgccaaaggcgacatttttctcatggactccggcgcagccaccgccacccgagagcgccacccgccgccctcgccggtgctgatgcagatgtcgatgccccaggcatcggcagacccgtctaacccattcccgacaacgttcgtccaggccgacaccaactccttcaagcaggtggtccagatcctcaccggcacgccggagaccgcggaggccgcggcgtcgagcggggcgcaggcgccgcctccagcccagcagaagccagcgctcacgcccccggggcccaagaagccggctttcaagctctacgagcggcggagcagcatgaggagcctcaagatgctctgccccctgctcccggccttcgccgccggcgattccgtggaaggcttctccccgcgcgggttctcgcctcgcgggatcgagctgctgtcgcccagcatgctggacttcccgtcgctggcactcgggagccccgtcacgccgctgccaccgctgccgggctcccaggaggccgcggccgccgaggaccgcgccatcgccgagaaggggttctacctccacccgtccccgcgtggcaatgccggcgccggcagcgacctgcagccgcctcccagactgctcccgctcttccccgtgcagtcgccgaccgcccggccgtgacccgcttcttgttcttggcttcccactctcttcctctagggtctaggccggctcgctcttgctctgtatgctctgctactcgctgctgatcacggcactcctcaaggttgaggacgaccacctgatctatggatatttgctcccctcgcctcccccctgtcatgacctttgggatgatgattcctatatgtccagtccccatgttgtaattttggtgtttgtaacagtaattcggcgcataagagggattaattgatcacctacttcgagttccaaaaaaaaaaaaaaaaa

SEQ ID NO: 893 - protein, 212 aa, Zea mays
  misc_feature: Ceres CLONE ID no.1543852
  misc_feature: Bit score of 187.1 for HMM based on sequences of FIGURE 9.
  misc_feature (34)..(64): Pfam Name: VQ Pfam Description: VQ motif
  misc_feature: Functional Homolog Of Ceres SEEDLINE ID no. ME16594 at SEQ ID NO. 850
MDSGAATATRERHPPPSPVLMQMSMPQASADPSNPFPTTFVQADTNSFKQVVQILTGTPETAEAAASSGAQAPPPAQQKPALTPPGPKKPAFKLYERRSSMRSLKMLCPLLPAFAAGDSVEGFSPRGFSPRGIELLSPSMLDFPSLALGSPVTPLPPLPGSQEAAAAEDRAIAEKGFYLHPSPRGNAGAGSDLQPPPRLLPLFPVQSPTARP

SEQ ID NO: 894 - DNA, 1242 bp, Panicum virgatum
  misc_feature: Ceres CLONE ID no.1823669
  misc_feature: Encodes the peptide sequence at SEQ ID NO. 895
aaatcctcctcctcctcctccgcccctccactcccctcgtcgcctcctccccggccatcttcttcttcttctcctcttccccaccaacgccaaaacccagcaaacccacactcactcaatggaggtctccaccaagcagctcctccccatgcctcatcagcaggaccccaactccccttcctcttccacctcctcgtcgtcctcctcctccacctcaccgtctcacccccaccaccgtgcgcagccccacaacctcccaccgtcgccccggcccatcccgcgcaccatcgacaccaccccgttccccaccaccttcgtccaggctgacaccacgtcctttaagcaggtcgtccagatgctcaccggcgccgagcagcccaccaagaacgacgcgacgacggcggcggcggcgccagcgggcaacggcggcggtggccaggcggctggcgggccgtgccggcccaagaagccgtctttcaagctgtacgagcggcggagcagcatgaagaacctcaagatgatcgcgccgctggcgatgggcccgccgccgtcgccgcggagggcggcgccggagatcctctcgccgagcgtgctggacttcccgtccctgaggctcagcagcccggtgacgccgctgaccggggaccccttcaaccgctcgccggcgtcgacgtcgtcctccgaggaggccgagcgcgcggccatcgccgagagggggttcttcctccacccgtccccgaggggcgccgagccgccgcgcctgctcccgctcttccccgtcacctcgccccggatggccgcccccgccgcggcgccgtccgagtgatccggcccgagatcgatcccgcctccgctccgatcgccggcgcccgcctctaccatagctactacccctgtactactacaaccatcgccgtatcctcccttcacctctggtcttgtaaggtgcttgctttgctctgctcttgttcttgatcgacgctgctgcgcgtctgctgctgccgtagtttttgctcccttcttgaaaggaagaggggagtttgttctttttcttcctttcggagcggcgactggcgagcagacgagcagtgatcgtacgaaccgagcctggagacgcacgcgccaggctcgattactcgatcgctcgtcgcctccgaaatgaagagatgggtggatgaattagtaaattaattatcaattaatgaaaattaatctcgagcttaaaaaaaaaaaaaaaaaaaa

SEQ ID NO: 895 - protein, 235 aa, Panicum virgatum
  misc_feature: Ceres CLONE ID no.1823669
  misc_feature: Bit score of 505.1 for HMM based on sequences of FIGURE 9.
  misc_feature (60)..(90): Pfam Name: VQ Pfam Description: VQ motif
  misc_feature: Functional Homolog Of Ceres SEEDLINE ID no. ME16594 at SEQ ID NO. 850
MEVSTKQLLPMPHQQDPNSPSSSTSSSSSSSTSPSHPHHRAQPHNLPPSPRPIPRTIDTTPFPTTFVQADTTSFKQVVQMLTGAEQPTKNDATTAAAAPAGNGGGGQAAGGPCRPKKPSFKLYERRSSMKNLKMIAPLAMGPPPSPRRAAPEILSPSVLDFPSLRLSSPVTPLTGDPFNRSPASTSSSEEAERAAIAERGFFLHPSPRGAEPPRLLPLFPVTSPRMAAPAAAPSE

SEQ ID NO: 896 - DNA, 978 bp, Panicum virgatum
  misc_feature: Ceres CLONE ID no.1785736
  misc_feature: Encodes the peptide sequence at SEQ ID NO. 897
attcccactccctctcgcctccgcacagacccgtcagacaccccgtccctccctcctcgccgtggaaccaacgcccagcacgcgcgcgcgcgagcacgagaacccccaccgcgtatggaagttgctgcggcgaagcaactcctccccatggcgcggggccccaactccccgtcctcgtccacctcctcctcctccccgtcctccgccgcctccccgtcgccgcgccagccgcagtcccagcccgtcccgccgtcgcccaagcccgtgccgcgcatcatcgacaccacgcccttcccgaccaccttcgtgcaggccgacaccaccaacttcaagcaggtcgtgcagaggctcaccggctccgacacgccgccgtcggcccagaacaagcccgccaagacccaccaccaccaccaccacggcgccagcggcctcgccggcgggcccaagaagccggccttcaagctctacgagcgccggatcggcaagaacaacctcaagatgatcgcgccgctggcgatggccgcggccgcggccgcgggggcgtcgccgcggaagccgggccccgaggtgctgtcgcccagcgtgctcaacttcccgtccctggcgctcgggagccccgtcacgccgctggtgtcggaccccttcaaccggtcgccggcgtccgcgtcgccgggcgaggaggaggaggccgccgagcgcgcggccatcgcgcgcaagagcttcttcctgcacccgtccccgagggccgccgagccgccgcggctgctgccgctgttccccgtcacgtcccccaggatggcgccctccgccgccgccgccgcggcgccgtcgtcgcagtgaccgggcaccgcgctgccggagaattcctagtatttgcgtgagaaacttgctgtttaactactccttgcgtgatgtaatttttgctcatactagtcctgaaccgatcgccaagaaacggaaaaaaaaaaaaaaaaaaaa

SEQ ID NO: 897 - protein, 241 aa, Panicum virgatum
  misc_feature: Ceres CLONE ID no.1785736
  misc_feature: Bit score of 403.7 for HMM based on sequences of FIGURE 9.
  misc_feature (58)..(88): Pfam Name: VQ Pfam Description: VQ motif
  misc_feature: Functional Homolog Of Ceres SEEDLINE ID no. ME16594 at SEQ ID NO. 850
MEVAAAKQLLPMARGPNSPSSSTSSSSPSSAASPSPRQPQSQPVPPSPKPVPRIIDTTPFPTTFVQADTTNFKQVVQRLTGSDTPPSAQNKPAKTHHHHHHGASGLAGGPKKPAFKLYERRIGKNNLKMIAPLAMAAAAAAGASPRKPGPEVLSPSVLNFPSLALGSPVTPLVSDPFNRSPASASPGEEEEAAERAAIARKSFFLHPSPRAAEPPRLLPLFPVTSPRMAPSAAAAAAPSSQ

SEQ ID NO: 898 - protein, 255 aa, Oryza sativa subsp. japonica
  misc_feature: Public GI ID no.115464921
  misc_feature: Bit score of 463.2 for HMM based on sequences of FIGURE 9.
  misc_feature (61)..(91): Pfam Name: VQ Pfam Description: VQ motif
  misc_feature: Functional Homolog Of Ceres SEEDLINE ID no. ME16594 at SEQ ID NO. 850
MAHDPNSPSSSTSSSSPSSAAAAASSSPSSHRPPPPPPSSSSQPALPPSPRTVVPRTIDTTPFPTTFVQADTASFKQVVQMLTGSDTTPPSQRPPAKSNHHQHHHSGAPCRPKKQAFKLYERRSGVHKNFKMIAPLAMAAAAAAGASSSPRKAAQHQQQEALSPSVLDFPSLALSPVTPLVADPFNRSPASASSSASPEEEAAAIAQKGFFLHPSPRSAEPPRLLPLFPVTSPRVASSSSSSAAAAVAVASPSFE

SEQ ID NO: 899 - DNA, 714 bp, Sorghum bicolor
  misc_feature: Ceres ANNOT ID no.6079909
  misc_feature: Encodes the peptide sequence at SEQ ID NO. 900
atggaggtttccaccaagcaactcctccccatgcctcatcagcgggaccccaactccccttcctcttccacctcgtcgtcgtcgtcgtcctccacctccccatctcacccgcaccaccaccgtgcgcagcagccccacaaactcccgcagtccccgaggcccatcccgcgcaccatcgacaccaccccgttccccaccaccttcgtccaggccgacaccacctcgttcaagcaggtcgtccagatgctcaccggcgccgagcagccggccaagaacgacgcgacgacgacagcaggggcagcagcagccaacggcggcggccaggcggcgagcggggcggcctgccggccgaagaagccgtctttcaagctgtacgagcggcggagcagcctgaagaacctcaagatgatcgcgccgctggcgatgggcccgccgccgtcgccgcggacgagggccacggcgccggagatcctgtccccgagcgtcctggacttcccgtccctcaggctcagcagcccggtgacgccgctcaccggcgaccccttcaaccgctcgccggcgtccacgtcgtcgtcctccgaggaggccgagcgcgccgccatcgccgagaggggcttcttcctccacccgtccccgaggggcggcgccgagcccccgcgcctgctcccgctcttccccgtcacctcgccccggatggcggcgccgtccgagtga

SEQ ID NO: 900 - protein, 237 aa, Sorghum bicolor
  misc_feature: Ceres ANNOT ID no.6079909
  misc_feature: Bit score of 471.7 for HMM based on sequences of FIGURE 9.
  misc_feature (62)..(92): Pfam Name: VQ Pfam Description: VQ motif
  misc_feature: Functional Homolog Of Ceres SEEDLINE ID no. ME16594 at SEQ ID NO. 850
MEVSTKQLLPMPHQRDPNSPSSSTSSSSSSSTSPSHPHHHRAQQPHKLPQSPRPIPRTIDTTPFPTTFVQADTTSFKQVVQMLTGAEQPAKNDATTTAGAAAANGGGQAASGAACRPKKPSFKLYERRSSLKNLKMIAPLAMGPPPSPRTRATAPEILSPSVLDFPSLRLSSPVTPLTGDPFNRSPASTSSSSEEAERAAIAERGFFLHPSPRGGAEPPRLLPLFPVTSPRMAAPSE

SEQ ID NO: 901 - DNA, 762 bp, Sorghum bicolor
  misc_feature: Ceres ANNOT ID no.6040353
  misc_feature: Encodes the peptide sequence at SEQ ID NO. 902
atggaagttgctgcggcgaagcaactcctccccatggcgcggggggtccccaactccccgtcctcctccacctcctcctcctcgccctcgtccgccgcctgcgcctccccgtcgccgcgccagcagtcccaggcgcccgtgccgccgtcgcccaagcccgtgccgcgcatcatcgacaccacgccgttccccaccaccttcgtgcaggccgacaccgccaacttcaagcaagtcgtccagaggctcaccggctccgacacgccgccgacgccggcggcggcccagcagaagcccgccaagagcagccacggccatcaccaccaccaccaccaccaccaccacggcggtggcagcggcctcgctagcggtcccaagaagccggccttcaagctctacgagcgccggatcggcaagaacaacctcaagatgatcgcgccgctggcgatggcagcggccgcggccgcgggcgcgtcgccgaggaaggcggcgccggaggtgctgtcgcccagcgtgctcgacttcccgtccctggcgctagggagccccgtcacgccgctgctgtccgaccccttcaaccggtcgccgccgtcggcgggcgaggaggacgaggccgccgagcgcgccgccatcgcgcggaagggcttcttcctgcacccatcgccgagggccgccgccgagccgccgcggctactgccgctgttccccgtcacgtcccccagggtggcgccctcacccgccgccgcgccgtcgccgttgcagtga

SEQ ID NO: 902 - protein, 253 aa, Sorghum bicolor
  misc_feature: Ceres ANNOT ID no.6040353
  misc_feature: Bit score of 412.9 for HMM based on sequences of FIGURE 9.
  misc_feature (61)..(91): Pfam Name: VQ Pfam Description: VQ motif
  misc_feature: Functional Homolog Of Ceres SEEDLINE ID no. ME16594 at SEQ ID NO. 850
MEVAAAKQLLPMARGVPNSPSSSTSSSSPSSAACASPSPRQQSQAPVPPSPKPVPRIIDTTPFPTTFVQADTANFKQVVQRLTGSDTPPTPAAAQQKPAKSSHGHHHHHHHHHHGGGSGLASGPKKPAFKLYERRIGKNNLKMIAPLAMAAAAAAGASPRKAAPEVLSPSVLDFPSLALGSPVTPLLSDPFNRSPPSAGEEDEAAERAAIARKGFFLHPSPRAAAEPPRLLPLFPVTSPRVAPSPAAAPSPLQ

SEQ ID NO: 903 - DNA, 660 bp, Sorghum bicolor
  misc_feature: Ceres ANNOT ID no.6100173
  misc_feature: Encodes the peptide sequence at SEQ ID NO. 904
atggacgccggcgccgccaccaccgcccgggagcgccccgtgccgccctcgccggtgccgatggcgattccgctgccggtgccgctgccgcaggcgtcggcggacccgtccaaccccttccccaccacgttcgtccaggccgacaccacctccttcaagcaggtggtccagatcctcaccggcacgccggagaccgcggcggccgcggcgtcaggtggggcgcaggcgtcgccgccggccccgcagaagccggcgcccgcgcccccggggcccaagaagccggctttcaagctctacgagcggcggagcagcatgaagagcctcaagatgctctgccccctgctcccggccgccgccgccttcgccgccggcggctccgccggaggcttctccccgcgcgggttctcgccgcgcgggctcgaggtgctgtcgcccagcatgctggacttcccgtcgctggcgctcgggagccccgtcacgccgctgccgccgctgcctgggtccgaggaggccgccgccgccgaggaccgcgccatcgccgagaaggggttctacctccacccgtcccctcgcggcaatgccggcgccggcggcgacctgcagccgcctcccaggctgctcccgctcttccccgtgcagtcgccgacgggccggccgtga

SEQ ID NO: 904 - protein, 219 aa, Sorghum bicolor
  misc_feature: Ceres ANNOT ID no.6100173
  misc_feature: Bit score of 186.8 for HMM based on sequences of FIGURE 9.
  misc_feature (38)..(68): Pfam Name: VQ Pfam Description: VQ motif
  misc_feature: Functional Homolog Of Ceres SEEDLINE ID no. ME16594 at SEQ ID NO. 850
MDAGAATTARERPVPPSPVPMAIPLPVPLPQASADPSNPFPTTFVQADTTSFKQVVQILTGTPETAAAAASGGAQASPPAPQKPAPAPPGPKKPAFKLYERRSSMKSLKMLCPLLPAAAAFAAGGSAGGFSPRGFSPRGLEVLSPSMLDFPSLALGSPVTPLPPLPGSEEAAAAEDRAIAEKGFYLHPSPRGNAGAGGDLQPPPRLLPLFPVQSPTGRP

SEQ ID NO: 905 - DNA, 615 bp, Arabidopsis thaliana
  misc_feature: Ceres SEEDLINE ID no.ME16597
  misc_feature: Genomic Sequence
  misc_feature: Expected Sequence
  misc_feature: Encodes the peptide sequence at SEQ ID NO. 907
atgaacggtggtgcatggatgtggaaccctaacaaaattgaagaattggaggatgatgatgaatcttgggaagtcaaagcctttgagcaagacactaaaggcaacatctctggtaccacttggcctccaagatcttacacttgcaatttctgccgccgtgagttccgttctgctcaagccttaggcggtcacatgaatgtccaccgccgtgaccgcgcctcatctagggctcatcaaggttccaccgttgcggctgcggctagaagcggccacggggggatgttactcaattcttgtgctccgccgttgcctacaacgacacttataatacaatccacggcgagtaacattgaaggtttgtcccatttctaccaactgcaaaaccctagtggcatttttggtaattctggtgacatggtgaatctttatggtacgacttcgtttcctccgagcaaccttccgttttcaatgttgaattctccagtagaagttcctcctcggcttattgaatattcgacaggagatgatgagagcattggctcgatgaaagaagcgacaggaacatcagtggatgagcttgatcttgaacttcggctagggcaccatccaccgtga

SEQ ID NO: 906 - DNA, 615 bp, Arabidopsis thaliana; identical to SEQ ID NO: 905
  misc_feature: Ceres SEEDLINE ID no.ME16597
  misc_feature: Predicted Sequence
  misc_feature: Encodes the peptide sequence at SEQ ID NO. 907

SEQ ID NO: 907 - protein, 204 aa, Arabidopsis thaliana
  misc_feature: Ceres SEEDLINE ID no.ME16597
  misc_feature: Bit score of 389.0 for HMM based on sequences of FIGURE 10.
  misc_feature (46)..(68): Pfam Name: zf-C2H2 Pfam Description: Zinc finger, C2H2 type
MNGGAWMWNPNKIEELEDDDESWEVKAFEQDTKGNISGTTWPPRSYTCNFCRREFRSAQALGGHMNVHRRDRASSRAHQGSTVAAAARSGHGGMLLNSCAPPLPTTTLIIQSTASNIEGLSHFYQLQNPSGIFGNSGDMVNLYGTTSFPPSNLPFSMLNSPVEVPPRLIEYSTGDDESIGSMKEATGTSVDELDLELRLGHHPP

SEQ ID NO: 908 - DNA, 1038 bp, Gossypium hirsutum
  misc_feature: Ceres CLONE ID no.1940797
  misc_feature: Encodes the peptide sequence at SEQ ID NO. 909
aaaagctgatctgcctgcaaatgtctataagacttttgtctctcccaacatttcttcacacaactcatgtcccttgtctgactttttctcctcatgtacttccttccaattataatgataaacccttaatctccaagaagtgataaatttcctggtgagaatttgagtcttagttaagaatttccatggaagccaaccatcttgaagattcaaagagctcgagtgaagagactgataaatcagagcaaagcatcgatgatatgcgcaccggtcgtcggtcctacgagtgtgtgttttgcaagagagggttttccacagcacaagccttaggtgggcatatgaacatccacaggaaagatagagtcaagagcaggcctagctcggttcctatagtttcactttcaggcaacaaagctgatgataagaattacccaagttttagaccttattcctatccgccaatccatagctatcagccgcattactccattgctcctgaggtacatgtaagttatcaagcttttcttccagtttcaggttggggttttaggctacccccgcacacggctcaactgtttgtagacaattcaaagcatcggaatccgtttggcgaagatgatcatgaaaacaagaaggctgatggatataatgataaagaagatgaattagacttggagcttcgattaggtcatgatccctagtatatatatcactatatattctatattaaatacttataataaagaagtttctcaatgtacagcagttgtggatatattctttagaaagcacacgaaataagaagaatcattacttacataaagaagaaggaaaagggggttatttttatgcctaatatatacttcaaagttcaaagatggaaggcccgcaagatggattctgtaagatgttctttcttatgtgatcttttgcacagtcgtcatgtttaagtgaagtttcaaacttgaaatattttcatgtgaaattaattattagtagaaatggagcttgcttatcgaaaaaaaaaaaaaaaaaaaa

SEQ ID NO: 909 - protein, 171 aa, Gossypium hirsutum
  misc_feature: Ceres CLONE ID no.1940797
  misc_feature: Bit score of 263.8 for HMM based on sequences of FIGURE 10.
  misc_feature (33)..(55): Pfam Name: zf-C2H2 Pfam Description: Zinc finger, C2H2 type
  misc_feature: Functional Homolog Of Ceres SEEDLINE ID no. ME16597 at SEQ ID NO. 907
MEANHLEDSKSSSEETDKSEQSIDDMRTGRRSYECVFCKRGFSTAQALGGHMNIHRKDRVKSRPSSVPIVSLSGNKADDKNYPSFRPYSYPPIHSYQPHYSIAPEVHVSYQAFLPVSGWGFRLPPHTAQLFVDNSKHRNPFGEDDHENKKADGYNDKEDELDLELRLGHDP

SEQ ID NO: 910 - DNA, 624 bp, Populus balsamifera subsp. trichocarpa
  misc_feature: Ceres ANNOT ID no.1538900
  misc_feature: Encodes the peptide sequence at SEQ ID NO. 911
atgtggaaccctaagcaaactcaagaagaggatgattcatgggaggttagagccttcgcagaggataccggcaacatcaacggcaccacttggccaccgaggtcttatacttgcaccttttgtagaagggaattccgctcagctcaagccctagggggtcacatgaatgttcaccgccgtgaccgtgctaggcttcaccaaacacagcctggttcaatcaaccccaactcatcaacttccagttcttcctcgtctacttttataatcccaactcaagaatttcccccaaatgctgggttatgcttactttaccaactaccaaaccctaatggagtcttcactcccgcaactatgaatgcatgtgctactgattcaccttctactcttctctctatcacaccatatccccataacaacttgatagagaaatctcttaattttctagtagctccacctgagataaatacttctcattgttactcaatcaaagccgagccctcggcatccattgataatagcaataatatcaacagcgacaacaactttaaggagttggcacacgaagaacttgatctagagctccggctagggcacagatcgacaacaccaccaccatcatcataa

SEQ ID NO: 911 - protein, 207 aa, Populus balsamifera subsp. trichocarpa
  misc_feature: Ceres ANNOT ID no.1538900
  misc_feature: Bit score of 329.2 for HMM based on sequences of FIGURE 10.
  misc_feature (36)..(58): Pfam Name: zf-C2H2 Pfam Description: Zinc finger, C2H2 type
  misc_feature: Functional Homolog Of Ceres SEEDLINE ID no. ME16597 at SEQ ID NO. 907
MWNPKQTQEEDDSWEVRAFAEDTGNINGTTWPPRSYTCTFCRREFRSAQALGGHMNVHRRDRARLHQTQPGSINPNSSTSSSSSSTFIIPTQEFPPNAGLCLLYQLPNPNGVFTPATMNACATDSPSTLLSITPYPHNNLIEKSLNFLVAPPEINTSHCYSIKAEPSASIDNSNNINSDNNFKELAHEELDLELRLGHRSTTPPPSS

SEQ ID NO: 912 - DNA, 903 bp, Populus balsamifera subsp. trichocarpa
  misc_feature: Ceres ANNOT ID no.1529131
  misc_feature: Encodes the peptide sequence at SEQ ID NO. 913
atggagcaagctcgttattggatgttgactaaacggaagcatagtttggattctcattttcaggcttcaaccaatccttcgttggatgattcttgggaagaacaagctttcgctgaagatgcagctggtcctctcggaggatgtatatggcctccaagatcttattcttgtagcttttgtagaagagaatttaggtctgctcaagctctaggaggtcatatgaatgtccacaggagggatagagctagactcaagcaatctccaagtcctcacaatgaaattcttcatcatgagcatcaaaaacctctcaatcaccttcaaaatccctatacatctttcggttttcaatacccatctcagctttgtaccttggattattgccctaaccctaattctaatcctggttttattccatcccgaacttcatcttctagggtttcaattacatctactcaagagaatttctgtgataaaaccatttcccctcctttcacttcttttattgttgaagaacaacaaaagagatcccataaatcttcccccccgccacagactaagttaactaaagaaagatgtcatatatcttctctaagcactgaaggagagcagaattcaaggaaaatagaatcaggatgtagagccaaagtagattatgtccaaacagatttgtctgtcagcttgaatttagtcgttcgacgaactcgcccgagcatatcagactgtggggaggagcctatgagctgcaagaaacggaggattgataaatcatcattacctttctttctaaagtgtaattcagttgataaacatcatgtccagtctgaggtgtttgaaattagcccttgcactgtagatgaattggatcttgagctcaggcttggtgaccggcctaaggtaaagtag

SEQ ID NO: 913 - protein, 300 aa, Populus balsamifera subsp. trichocarpa
  misc_feature: Ceres ANNOT ID no.1529131
  misc_feature: Bit score of 100.8 for HMM based on sequences of FIGURE 10.
  misc_feature (55)..(77): Pfam Name: zf-C2H2 Pfam Description: Zinc finger, C2H2 type
  misc_feature: Functional Homolog Of Ceres SEEDLINE ID no. ME16597 at SEQ ID NO. 907
MEQARYWMLTKRKHSLDSHFQASTNPSLDDSWEEQAFAEDAAGPLGGCIWPPRSYSCSFCRREFRSAQALGGHMNVHRRDRARLKQSPSPHNEILHHEHQKPLNHLQNPYTSFGFQYPSQLCTLDYCPNPNSNPGFIPSRTSSSRVSITSTQENFCDKTISPPFTSFIVEEQQKRSHKSSPPPQTKLTKERCHISSLSTEGEQNSRKIESGCRAKVDYVQTDLSVSLNLVVRRTRPSISDCGEEPMSCKKRRIDKSSLPFFLKCNSVDKHHVQSEVFEISPCTVDELDLELRLGDRPKVK

SEQ ID NO: 914 - DNA, 906 bp, Populus balsamifera subsp. trichocarpa
  misc_feature: Ceres ANNOT ID no.1454060
  misc_feature: Encodes the peptide sequence at SEQ ID NO. 915
atggagcaagctcggtattggatgttgactaagcaaaagcatagtttgaattctcatttccaggcttcaactaatccttcatttgatgattcttgggaagaacaagctttcgccgaagatgcagctgggcctcttggagggtgtatatggcctccaagatcttattcttgtagcttttgtagaagagaatttaggtctgctcaagctctaggaggtcatatgaatgtccacaggagggatagagctagactaaagcaacctccaagtcctcacaatgaaatccttcaacaggagcatcaaagtcctcacagtcaccttcaaaatccctataaatctttcggttttcaatacccatctcagctttgtaatctggtttatagccctaaccctaattctgatcctggtcctattgcatccccaccttcttcttctagggtttcaacgacacctactcaagagaattgccgaataaagggttttttccctcctttttcttcttttattgttgaagaacaacaaaagagatcccctagatcttctcctccaccacggactaagttagctacagaaagatgttatcatatctctgatctgagcactgaaggagagcagaattcaaggaaagtggaatcaggatgtacaggaaaagtaaaccgtgtcaaaacagatttgtctgtcagcttgaatttggtagttcgacgtactcgcccaagcataacggacagtgaggaggatccttcgagctgcaagaagcggaggatcgataaatcatcattacctttctctctaaagtctaattcagtcgacaagtctgaggtgcttgaaattagcccttgcactgtagaagaattggatcttgaactcaggcttggtgaccggcctaagtcttattgtcacatttactaa

SEQ ID NO: 915 - protein, 294 aa, Populus balsamifera subsp. trichocarpa
  misc_feature: Ceres ANNOT ID no.1454060
  misc_feature: Bit score of 96.6 for HMM based on sequences of FIGURE 10.
  misc_feature (55)..(77): Pfam Name: zf-C2H2 Pfam Description: Zinc finger, C2H2 type
  misc_feature: Functional Homolog Of Ceres SEEDLINE ID no. ME16597 at SEQ ID NO. 907
MLTKQKHSLNSHFQASTNPSFDDSWEEQAFAEDAAGPLGGCIWPPRSYSCSFCRREFRSAQALGGHMNVHRRDRARLKQPPSPHNEILQQEHQSPHSHLQNPYKSFGFQYPSQLCNLVYSPNPNSDPGPIASPPSSSRVSTTPTQENCRIKGFFPPFSSFIVEEQQKRSPRSSPPPRTKLATERCYHISDLSTEGEQNSRKVESGCTGKVNRVKTDLSVSLNLVVRRTRPSITDSEEDPSSCKKRRIDKSSLPFSLKSNSVDKSEVLEISPCTVEELDLELRLGDRPKSYCHIY

SEQ ID NO: 916 - DNA, 555 bp, Populus balsamifera subsp. trichocarpa
  misc_feature: Ceres ANNOT ID no.1442787
  misc_feature: Encodes the peptide sequence at SEQ ID NO. 917
atggaatcaaaccaacatgatgaagactcgaagagctcaagtgacgaagaggaaattaccgaccgatccgatcaagatacgggtaccggccggtcctatgagtgtgttttttgcaagagaggattcactacagcacaggctttgggaggacatatgaatattcataggaaagatagggccaagtcaaggcctagctcagttccttcactttcaagcaaagttgatgaggattatgcaagttttcaaggctatcctccaattcaaagctacccacctcactaccctacgcctcatgaggtacatataaattaccaaacgttttttccggcatcgacaacatggggtataggatccccatatgcacagcaacacaatggtgatttctatgtgcaaagtccacatcatttgtatccattcggagacgattggagaaggagtctaagcctgcaaaccggtccatcccatgtggatgataataccaaagaaaaaatagaagacggcattggagcagatgatgaattggatttggagcttagacttggtcacgatccataa

SEQ ID NO: 917 - protein, 184 aa, Populus balsamifera subsp. trichocarpa
  misc_feature: Ceres ANNOT ID no.1442787
  misc_feature: Bit score of 127.1 for HMM based on sequences of FIGURE 10.
  misc_feature (33)..(55): Pfam Name: zf-C2H2 Pfam Description: Zinc finger, C2H2 type
  misc_feature: Functional Homolog Of Ceres SEEDLINE ID no. ME16597 at SEQ ID NO. 907
MESNQHDEDSKSSSDEEEITDRSDQDTGTGRSYECVFCKRGFTTAQALGGHMNIHRKDRAKSRPSSVPSLSSKVDEDYASFQGYPPIQSYPPHYPTPHEVHINYQTFFPASTTWGIGSPYAQQHNGDFYVQSPHHLYPFGDDWRRSLSLQTGPSHVDDNTKEKIEDGIGADDELDLELRLGHDP

SEQ ID NO: 918 - DNA, 558 bp, Populus balsamifera subsp. trichocarpa
  misc_feature: Ceres ANNOT ID no.1452648
  misc_feature: Encodes the peptide sequence at SEQ ID NO. 919
atggaatcatcaaaccaacatgatgaagactcgaagagctcaagcgacgaagaaattaccgatcgatcctatcaagatacaggcaccggccggtcctatgagtgtgttttttgcaagagaggctttactactgctcaggctttgggaggacatatgaatattcataggaaagatagagccaagtcaaggcctagctcagttccttccttttcaagcaaagttgatgaggattttcccagttttcgaggctaccctccccttcaaagttacccagctcactatcctacacctcacgaggtacatacgaattaccaaacattttttccgttatcctcgacatggggtataggatccccatatgcacaacaacacaatggtgatttctatgcacaaactccacagcatttgtatccattcggagaagatatttgtagagggagtctaagccagcaaatcgatccatcccatgtagatgataataccaaagaaaaaatagaagaaggcagtgaagcagatgatgatttggatttggagcttagacttggtcatgatccataa

SEQ ID NO: 919 - protein, 185 aa, Populus balsamifera subsp. trichocarpa
  misc_feature: Ceres ANNOT ID no.1452648
  misc_feature: Bit score of 110.8 for HMM based on sequences of FIGURE 10.
  misc_feature (33)..(55): Pfam Name: zf-C2H2 Pfam Description: Zinc finger, C2H2 type
  misc_feature: Functional Homolog Of Ceres SEEDLINE ID no. ME16597 at SEQ ID NO. 907
MESSNQHDEDSKSSSDEEITDRSYQDTGTGRSYECVFCKRGFTTAQALGGHMNIHRKDRAKSRPSSVPSFSSKVDEDFPSFRGYPPLQSYPAHYPTPHEVHTNYQTFFPLSSTWGIGSPYAQQHNGDFYAQTPQHLYPFGEDICRGSLSQQIDPSHVDDNTKEKIEEGSEADDDLDLELRLGHDP

SEQ ID NO: 920 - protein, 180 aa, Arabidopsis thaliana
  misc_feature: Public GI ID no.2245140
  misc_feature: Bit score of 335.2 for HMM based on sequences of FIGURE 10.
  misc_feature (40)..(62): Pfam Name: zf-C2H2 Pfam Description: Zinc finger, C2H2 type
  misc_feature: Functional Homolog Of Ceres SEEDLINE ID no. ME16597 at SEQ ID NO. 907
MWNPNKIEELEDDDESWEVKAFEQDTKGNISGTTWPPRSYTCNFCRREFRSAQALGGHMNVHRRDRASSRAHQGSTVAAAARSGHGGMLLNSCAPPLPTTTLIIQSTASNIEGLSHFYQLQNPSGIFGNSGDMVNLYVEVPPRLIEYSTGDDESIGSMKEATGTSVDELDLELRLGHHPP

SEQ ID NO: 921 - DNA, 862 bp, Brassica napus
  misc_feature: Ceres CLONE ID no.1126868
  misc_feature: Encodes the peptide sequence at SEQ ID NO. 922
acatcattatctatcaaccccatcttctcttcttattctccatcttctctactgagatttttctttaacaaaaaaaaactcatccttgaatgcacggtggtgcatggatgtggaatcatagcaaaaacgaagaactggaggatgatgatgaatcttgggaagtcaaagctttcgagcaagacactaaaggcaacatctatggtaccacttggcctccaagatcttacacttgcaatttctgccgccgtgagttccgttctgctcaagccttaggcggtcacatgaatgtccaccgccgtgaccgtgcctctaaggctcatcaaggtccagcggttagaagcggtggcggcagcggaggcggtaggacaacgtttctcagttcttgtgttccaccgtcgacaacgcttataatccaatccacggcgagtaacagtgaaggcttctcccacttcaaccaattgcaaaaccctaatggcatgtttggtaattccagtgatatggtgaatttttatggtactacgccgtttccttcgagcaaccttgagttttcgttgttgaactcgtcggtagaggttcctcctaggcttatacaatatccgacaggagatgatgagaaagctggctcgatgaaagagacgacgagaacatcagtgaatgagcctgatcttgaacttcgactagggcacaagccaccgtgacatttcacattcgtgacacacttgaggcctttcatatccatatccattcatacagaggttgtttacatcctaaattgcatttgtgttaaattctgaacttcaatttgttttagttgtctatcacaattaaatccattatatttcatgcaaaaaaaaaaaaaaaa

SEQ ID NO: 922 - protein, 196 aa, Brassica napus
  misc_feature: Ceres CLONE ID no.1126868
  misc_feature: Bit score of 386.6 for HMM based on sequences of FIGURE 10.
  misc_feature (40)..(62): Pfam Name: zf-C2H2 Pfam Description: Zinc finger, C2H2 type
  misc_feature: Functional Homolog Of Ceres SEEDLINE ID no. ME16597 at SEQ ID NO. 907
MWNHSKNEELEDDDESWEVKAFEQDTKGNIYGTTWPPRSYTCNFCRREFRSAQALGGHMNVHRRDRASKAHQGPAVRSGGGSGGGRTTFLSSCVPPSTTLIIQSTASNSEGFSHFNQLQNPNGMFGNSSDMVNFYGTTPFPSSNLEFSLLNSSVEVPPRLIQYPTGDDEKAGSMKETTRTSVNEPDLELRLGHKPP

SEQ ID NO: 923 - protein, 200 aa, Brassica oleracea
  misc_feature: Public GI ID no.89257684
  misc_feature: Bit score of 396.7 for HMM based on sequences of FIGURE 10.
  misc_feature (40)..(62): Pfam Name: zf-C2H2 Pfam Description: Zinc finger, C2H2 type
  misc_feature: Functional Homolog Of Ceres SEEDLINE ID no. ME16597 at SEQ ID NO. 907
MWNPSKVERLEDDDESWEVKAFEQDTKGNISGTTWPPRSYACNFCRREFRSAQALGGHMNVHRRDRASKAHQGPAAAVAARSGGRSRGGKKTFLNSCVLPTATLIIQSTASNNEGLSHFYQLQNPNSMFGHSSDTVNFYGSSSFPSSNLDFSVLNSPVEVPPRFIEYSTGDDESIGSMKETKRTSVGEPDLELRLGHNPP

SEQ ID NO: 924 - protein, 196 aa, Brassica oleracea
  misc_feature: Public GI ID no.89274212
  misc_feature: Bit score of 375.2 for HMM based on sequences of FIGURE 10.
  misc_feature (40)..(62): Pfam Name: zf-C2H2 Pfam Description: Zinc finger, C2H2 type
  misc_feature: Functional Homolog Of Ceres SEEDLINE ID no. ME16597 at SEQ ID NO. 907
MWNHSKNGELEDDDESWEVKAFEQDTKGNIYGTTWPPRSYTCNFCRREFRSAQALGGHMNAHRRDRGSKAHQGPAVRSGGRSGGGRTTFLSSCVPPSTTLIIQSTASNSEGLSHFNQLQNPNGMFGNSSDMVNFYGTTPFPSGNLEFSLLNSSVEVPPRLIQYPTGDDEKAGSMKETTRTSVNEPDLELRLGHKPP

SEQ ID NO: 925 - DNA, 1075 bp, Glycine max
  misc_feature: Ceres CLONE ID no.1104523
  misc_feature: Encodes the peptide sequence at SEQ ID NO. 926
aactccacctctcatcttcctacaccctcatcatcaacaacctgttggatgtggaatccaagggaccatgaagatcaagatgagtcctgggaggtcagagccttcgcagaagacacaagtaacatgatgggcaccacctggcctcctagattctactactgcagcttctgtagaagggagttccgttcagcacaagcccttggcggccacatgaacgttcaccgccgcgaccgcgctcgcctccaccaagcttcagtagtaccccacaacaacaacaatagcaataatagcaacatcaaccccatctcctctttttctaacacaccctcttttctcaacatctctcatcatcatcaggacccttttgttgcaaatgggggcttgtgcctgttgtacccctttccaagccctaataacaacaacaatgatccattttcctctcttgcccacaacaataatgcatgcggtgacttaccttccactgttttttcagtttcttcttctcattcccaatattcatcccttcagtactctccaattagggtgcctagttgctcagctacttcctttgatttctcggtggctcaacctgctgctgcttcagggaggaataatgctttctcttcttcttattctgggaaagtggaacaagaacccataatctcctcttccacacatcatggcctccaccatgaggagcttgatctagagctccgcttgggaaataaatcaacatcaacctgatgtgaaaatatgatttgtttattgtttttgtgaaaaccaccatatatatgggttgcctgggaggaaagatcaaagtccaaactccaaagaaaagagaagaggactaatgtttcttttttattgtcaaatgttagttttttgttagaagaaaaatcaattcctttttttcttccttaactatttaagccaggttatatatatctccaacaagagagctacactgtttggtcttttcggcagtggagggagagaggtgacggctgtaatttattgatgtttgaaaacaccatgtataactctcatatattatagttgaaaaaaaaaaaaaaaa

SEQ ID NO: 926 - protein, 231 aa, Glycine max
  misc_feature: Ceres CLONE ID no.1104523
  misc_feature: Bit score of 150.1 for HMM based on sequences of FIGURE 10.
  misc_feature (36)..(48): Pfam Name: zf-C2H2 Pfam Description: Zinc finger, C2H2 type
  misc_feature: Functional Homolog Of Ceres SEEDLINE ID no. ME16597 at SEQ ID NO. 907
MWNPRDHEDQDESWEVRAFAEDTSNMMGTTWPPRFYYCSFCRREFRSAQALGGHMNVHRRDRARLHQASVVPHNNNNSNNSNINPISSFSNTPSFLNISHHHQDPFVANGGLCLLYPFPSPNNNNNDPFSSLAHNNNACGDLPSTVFSVSSSHSQYSSLQYSPIRVPSCSATSFDFSVAQPAAASGRNNAFSSSYSGKVEQEPIISSSTHHGLHHEELDLELRLGNKSTST

SEQ ID NO: 927 - DNA, 963 bp, Glycine max
  misc_feature: Ceres CLONE ID no.654265
  misc_feature: Encodes the peptide sequence at SEQ ID NO. 928
atcccaacaacaacaacaaaaaaccctaactccacacctcttctcctccctcaacttgttggatgtggaatcctagggaccaatatcatcatcaggaccaagatcaagatgagtcgtgggaagtcagagccttcgcagaagacaccagtaacatcatgggcaccacctggcctcctaggtcctactcctgcaccttctgtagaaaggagttccgttcagcacaagccctcggcggccacatgaacgttcaccgccgcgaccgcgcccgcctccaccaagcctcagtaccccacaacaacccctctttttctcccacaccctcttttcttaacatctctcatcaggagccttttgttgcaaatgggggtttgtgcctcttgtacccctttccaagccctaataacaatgctccattttcctctctaggccacaacaataatgcatgtggtgactcaccttccactgstttttcagtttcttcttctcattcccttcagtaccctccaatgagggtgcctagttgctcagcttctacttcctttgatttctytgtggctcagcctgctcctcctgctgtagggaggaataawaakggtttctcttcttcttattctgggaaagtggaacaagaaccacccacaaacgactyttcaacccatcatggtcatggccgccaccmccatgatgaggagcttgatytagagctccgcttgggaaataaatcaacatcaacgtgatgtgaaaatatgatttgtttatttgtttattgttttttgaaaacccccatatkaggtgtytgtgaggaaagatcaaagtccmaactccaaagaaaagagaagagaactactttgctgtactytcttatgatagagtactactgtaatttattgttgtttgaaaaggccttgtataactytcacatattatagctgaagaagctgatggaatttttttgtttttccc

SEQ ID NO: 928 - protein, 224 aa, Glycine max
  misc_feature: Ceres CLONE ID no.654265
  misc_feature: Bit score of 153.9 for HMM based on sequences of FIGURE 10.
  misc_feature (41)..(63): Pfam Name: zf-C2H2 Pfam Description: Zinc finger, C2H2 type
  misc_feature: Functional Homolog Of Ceres SEEDLINE ID no. ME16597 at SEQ ID NO. 907
  misc_feature (135)..(135): Xaa is any aa, unknown, or other
  misc_feature (163)..(163): Xaa is any aa, unknown, or other
  misc_feature (176)..(176): Xaa is any aa, unknown, or other
  misc_feature (177)..(177): Xaa is any aa, unknown, or other
  misc_feature (196)..(196): Xaa is any aa, unknown, or other
  misc_feature (206)..(206): Xaa is any aa, unknown, or other
  misc_feature (213)..(213): Xaa is any aa, unknown, or other
MWNPRDQYHHQDQDQDESWEVRAFAEDTSNIMGTTWPPRSYSCTFCRKEFRSAQALGGHMNVHRRDRARLHQASVPHNNPSFSPTPSFLNISHQEPFVANGGLCLLYPFPSPNNNAPFSSLGHNNNACGDSPSTXFSVSSSHSLQYPPMRVPSCSASTSFDFXVAQPAPPAVGRNXXGFSSSYSGKVEQEPPTNDXSTHHGHGRHXHDEELDXELRLGNKSTST

SEQ ID NO: 929 - protein, 156 aa, Medicago truncatula
  misc_feature: Public GI ID no.124360460
  misc_feature: Bit score of 206.4 for HMM based on sequences of FIGURE 10.
  misc_feature (35)..(57): Pfam Name: zf-C2H2 Pfam Description: Zinc finger, C2H2 type
  misc_feature: Functional Homolog Of Ceres SEEDLINE ID no. ME16597 at SEQ ID NO. 907
MHEMTDPALSIYNFLSREGAKRHYPPLPPPSTRTFQCHFCHRKFYSSQALGGHQNAHKLERAAARRSTKPLHNFHHHHHHNNNNGSFHPSSLIITDLRPKPKPQKESARFFHNYPLLEVEPFHQLHAGTSIISHEYDTPPPAEPSDHANLDLTLRL

SEQ ID NO: 930 - protein, 224 aa, Petunia x hybrida
  misc_feature: Public GI ID no.42627704
  misc_feature: Bit score of 84.5 for HMM based on sequences of FIGURE 10.
  misc_feature (56)..(78): Pfam Name: zf-C2H2 Pfam Description: Zinc finger, C2H2 type
  misc_feature: Functional Homolog Of Ceres SEEDLINE ID no. ME16597 at SEQ ID NO. 907
MEKNNNFTNKYFKHTSMKELNNNNNKVKDSWDNYGSSFEGVDGDLLGGFLWPPRSYTCSFCKREFRSAQALGGHMNVHRRDRARLRLQSPPRENGTHQYSLLNLNLEPNPNVDPNPNPSFISSSPSSPSRKFPPFLSRLPPLISHSFSSTASGSQISHVSHQPKTGDLTKFGSAKFEKIDTFMQGKECNEVLMKRSEFLRLELGIGMINESKEDLDLELRLGYT

SEQ ID NO: 931 - protein, 184 aa, Sorghum bicolor
  misc_feature: Public GI ID no.62865694
  misc_feature: Bit score of 270.0 for HMM based on sequences of FIGURE 10.
  misc_feature (51)..(73): Pfam Name: zf-C2H2 Pfam Description: Zinc finger, C2H2 type
  misc_feature: Functional Homolog Of Ceres SEEDLINE ID no. ME16597 at SEQ ID NO. 907
MDAAGQIKLQQQHQPPCSDNNFSLLAAAADSSSWPPPQVRSPPSSSSSSSYTCGYCKKEFRSAQGLGGHMNVHRLDRARLIHQQYMSSSSHRTAPPPSNPNPSCAVLDLGLSLSSLLARGGGDGGGLPVPLEKQLGDRFSSASSAAATNDYYSEVKNLELRMGACSHGGDGTEERLDLQLRLGY

SEQ ID NO: 932 - protein, 170 aa, Tripsacum dactyloides
  misc_feature: Public GI ID no.62865692
  misc_feature: Bit score of 269.3 for HMM based on sequences of FIGURE 10.
  misc_feature (42)..(64): Pfam Name: zf-C2H2 Pfam Description: Zinc finger, C2H2 type
  misc_feature: Functional Homolog Of Ceres SEEDLINE ID no. ME16597 at SEQ ID NO. 907
MEGEDDGQIKLQQQQSPCSDNFSLAAASSWLPPQVRSSSSSYTCGYCKKEFRSAQGLGGHMNIHRLDRARLIHQQCTSHRIAPHPNPNPSCTVLDLELSLSSLLAHGAASSDGGLPVPVAKLAGNRFSSASSSAATKDVEGKNLELRIGACSHGDGAEERLDLQLRLGYS

SEQ ID NO: 933 - DNA, 827 bp, Triticum aestivum
  misc_feature: Ceres CLONE ID no.887222
  misc_feature: Encodes the peptide sequence at SEQ ID NO. 934
attcacatcgattgatcatcgcagctagctaggttgcggcaacatggagagcggcagcacggcggcgtcgagcgacgaggccgtgagatcgcccggcgggacgacggcggtggcggccgcccggccgtactacgagtgcgtgttctgcaagcgcgggttcaccacggcgcaggcgctgggcgggcacatgaacatccaccgccgggaccgcgccaagcccgcccgcctcacgacgtcagcttcccggagcacagagtgcaacttggcgtaccccccagcgccgccggccacgtccctgatgagcagcggcgacttcgccatgttgtactacggccggcacaccggagccggagtggacgccgaggccgtgagccctggtagcccgatcccgagggagctgagcctgttcggcgcggacgacgacagtcacgacgaccgtgacgactgcttgcaactgggcctccggtgccatggaagcagcagcggcgacgggttcgagcggcggccggacggcgagctgccggagaggaagctggacttggagctcaggctcgggcccgggcctcgtccgaggcactgatcactcgcacggtaccctggtgcaactcagacacaggaacgcactcatctatatacatgcatgggcttcctagctagtattacttcagttcttttgttgcttgatatcattattgctattctcatcttctgctgcttgtttatatgactaaatatatttatatttcgccataacaacaagagcagatgctttgatgtattgaatgtacatggagagctatatatgcttggctcttgttttgattcgc

SEQ ID NO: 934 - protein, 178 aa, Triticum aestivum
  misc_feature: Ceres CLONE ID no.887222
  misc_feature: Bit score of 285.0 for HMM based on sequences of FIGURE 10.
  misc_feature (30)..(52): Pfam Name: zf-C2H2 Pfam Description: Zinc finger, C2H2 type
  misc_feature: Functional Homolog Of Ceres SEEDLINE ID no. ME16597 at SEQ ID NO. 907
MESGSTAASSDEAVRSPGGTTAVAAARPYYECVFCKRGFTTAQALGGHMNIHRRDRAKPARLTTSASRSTECNLAYPPAPPATSLMSSGDFAMLYYGRHTGAGVDAEAVSPGSPIPRELSLFGADDDSHDDRDDCLQLGLRCHGSSSGDGFERRPDGELPERKLDLELRLGPGPRPRH

SEQ ID NO: 935 - DNA, 922 bp, Zea mays subsp. mays
  misc_feature: Ceres CLONE ID no.260368
  misc_feature: Encodes the peptide sequence at SEQ ID NO. 936
atcctctagctctctctctctctcttctctcacacacacacacagtcacagacacccctatcacttagactgtgctagtaggtagcggccgcgtaatggagcaggagctcagccttgagctcaccctcctccacccctcggcctcgccgccggagccaccgggctacttcgtctgcatgtactgcgaccgcaagttcttcagctcgcaggctctcggtggccaccagaacgcgcacaagtacgagcgcagcctggccaagcgccgcagggagatagccgccgccctgcgcgcgcacggggcggccgccaccgccacgggcgccccggaggacgacgccgccgccgcgatgggctctcgcgatgtccccgccaggccacaaggcacgggtaccggagtcgtcgtcgttgaagatgagagtgcaaccaggatgatggacaagcagaaggctcctgctgctgatgacgacgctcccgcgaccgcgtcgtcgagcaacatgaagaggtcgtcggagtacggctacggcgtcgaggagctggatctctccctcaggctttgattggttcctcttcctcctccacctttaaatataattcgccccgtttgcttagataattcgatctttgtggtcagtgcaatcatctgtttcgcgtgcgtggtatctcagtgctggatccgtcactttcttcctcatgtagttgttgtgcagttatattcttccatccgatgatggaacctatcggcaagaactattgtcggcccatcctgctatccaaagggcgtggtatttggtgtgctcttttcggttttctgccttgagtcttctttgtgcgatctaaattcgcagcttgttttttccaaaacggcggaaacagttttgccgcaatttcgtttggacctttttcaagtgactctaaattgggc

SEQ ID NO: 936 - protein, 153 aa, Zea mays subsp. mays
  misc_feature: Ceres CLONE ID no.260368
  misc_feature: Bit score of 185.2 for HMM based on sequences of FIGURE 10.
  misc_feature (30)..(52): Pfam Name: zf-C2H2 Pfam Description: Zinc finger, C2H2 type
  misc_feature: Functional Homolog Of Ceres SEEDLINE ID no. ME16597 at SEQ ID NO. 907
MEQELSLELTLLHPSASPPEPPGYFVCMYCDRKFFSSQALGGHQNAHKYERSLAKRRREIAAALRAHGAAATATGAPEDDAAAAMGSRDVPARPQGTGTGVVVVEDESATRMMDKQKAPAADDDAPATASSSNMKRSSEYGYGVEELDLSLRL

SEQ ID NO: 937 - protein, 175 aa, Zea mays
  misc_feature: Public GI ID no.62865690
  misc_feature: Bit score of 232.3 for HMM based on sequences of FIGURE 10.
  misc_feature (46)..(68): Pfam Name: zf-C2H2 Pfam Description: Zinc finger, C2H2 type
  misc_feature: Functional Homolog Of Ceres SEEDLINE ID no. ME16597 at SEQ ID NO. 907
MEGEDDGAQMKLQQQQQSPCSDNLSLSAASSWLPPQVRSSSSSSSYTCGYCKKEFRSAQGLGGHMNIHRLDRARLIHQQYTSHRIAAPHPNPNPSCTSVLDLELSLSSLLAHGAASSDGGLSVPVAKLAGNRFSSASLPTTKDVEGKNLELRIGACSHGDGAEERLDLQLRLGYY

SEQ ID NO: 938 - protein, 176 aa, Zea mays
  misc_feature: Public GI ID no.64175600
  misc_feature: Bit score of 231.8 for HMM based on sequences of FIGURE 10.
  misc_feature (47)..(69): Pfam Name: zf-C2H2 Pfam Description: Zinc finger, C2H2 type
  misc_feature: Functional Homolog Of Ceres SEEDLINE ID no. ME16597 at SEQ ID NO. 907
MEGEDDGAQMKLQQQQQSPCSDNLSLSAASSWLPPQVRSSSSSSSSYTCGYCKKEFRSAQGLGGHMNIHRLDRARLIHQQYTSHRIAAPHPNPNPSCTSVLDLELSLSSLLAHGAASSDGGLSVPVAKLAGNRFSSASLPTTKDVEGKNLELRIGACSHGDGAEERLDLQLRLGYY

SEQ ID NO: 939 - protein, 175 aa, Zea mays
  misc_feature: Public GI ID no.64175634
  misc_feature: Bit score of 232.5 for HMM based on sequences of FIGURE 10.
  misc_feature (46)..(68): Pfam Name: zf-C2H2 Pfam Description: Zinc finger, C2H2 type
  misc_feature: Functional Homolog Of Ceres SEEDLINE ID no. ME16597 at SEQ ID NO. 907
MEGEDDGAQMKLQQQQQSPCSDNLSLSAASSWLPPQVRSSSSSSSYTCGYCKKEFRSAQGLGGHMNIHRLDRARLIHQQYTSHRIAAPHPNPNPSCTSVLDLELSLSSLLAHGAASSDGGLSVPVAKLAGNRFSSASPPTTKDVEGKNLELRIGACSHGDGAEERLDLQLRLGYY

SEQ ID NO: 940 - protein, 177 aa, Zea mays
  misc_feature: Public GI ID no.64175606
  misc_feature: Bit score of 231.3 for HMM based on sequences of FIGURE 10.
  misc_feature (48)..(70): Pfam Name: zf-C2H2 Pfam Description: Zinc finger, C2H2 type
  misc_feature: Functional Homolog Of Ceres SEEDLINE ID no. ME16597 at SEQ ID NO. 907
MEGEDDGAQMKLQQQQQSPCSDNLSLSAASSWLPPQVRSSSSSSSSSYTCGYCKKEFRSAQGLGGHMNIHRLDRARLIHQQYTSHRIAAPHPNPNPSCTSVLDLELSLSSLLAHGAASSDGGLSVPVAKLAGNRFSSASLPTTKDVEGKNLELRIGACSHGDGAEERLDLQLRLGYY

SEQ ID NO: 941 - protein, 174 aa, Zea mays
  misc_feature: Public GI ID no.64175648
  misc_feature: Bit score of 226.7 for HMM based on sequences of FIGURE 10.
  misc_feature (45)..(67): Pfam Name: zf-C2H2 Pfam Description: Zinc finger, C2H2 type
  misc_feature: Functional Homolog Of Ceres SEEDLINE ID no. ME16597 at SEQ ID NO. 907
MEGEDDGAQMKLQQQQQSPCSDNLSLSAASSWLPPQVRSSSSSSYTCGYCKKEFRSAQGLGGHMNIHRLDRARLIHQQYTSHRIATPHPNPNPSCTSVLDLELSLSSLLAHGAASSDGGLSVPVAKLAGNRFSSASPHTTKDVEGKNLELRIGACSHGDGAEERLDLQLRLGYY

SEQ ID NO: 942 - DNA, 911 bp, Zea mays subsp. mays
  misc_feature: Ceres CLONE ID no.312184
  misc_feature: Encodes the peptide sequence at SEQ ID NO. 943
gctgttgcaaattacgttccctctagtctctactctagccccctctctctctcacacacacacacacccctatcacttggactgtgctagtataggtagccgccgtgtaatggagcaggagctcagccttgagctcaccctcttccacccctcggtctcgccggaaccgccgggctatttcgtctgcacgtactgcgaccgcaagttcttcacctcgcaggctctcggtggccaccagaacgcgcacaagtacgagcgcagcctggccaagcgccggcgggagatcgccaccgccctgcgcgcgcacggggcggccgccaccgccacgggcgtccaggacgccgccgctatgggctctcgcgatgtccccgccaggccccaaggcacgggtagcggtgccgacaagagcgcaacaaggatggataagcacaaggcgcctgctgatgatgccgctcccgcgcctgccgcgtcgagcaacaggaagaggtcgtcggaggagctggacctctccctcaggctttgattggttcctcttcctcgtccacctttaattggcccatttgtttacataattcgatccgtataaatgagtgcaagcatctgtttcgagtgtgtgtggtatctctagatccatcacttcttcctcatgtagtacgttgtgcagttatgttcttccatatgatgatgccacttatcggcaagaactgttgtcgttccatgcatcctgctacccaaagggcgcgtgtggtatttggtattctattcggttgtgccttgagtcctctttgtacgtaattagtttttagcactcaattaaaataataatggaaagggcagcaagagttttgctgcaatgtttggggcttttcaagtgattctaaattgcacttacgccatgtcaaactttgtgc

SEQ ID NO: 943 - protein, 137 aa, Zea mays subsp. mays
  misc_feature: Ceres CLONE ID no.312184
  misc_feature: Bit score of 128.8 for HMM based on sequences of FIGURE 10.
  misc_feature (24)..(46): Pfam Name: zf-C2H2 Pfam Description: Zinc finger, C2H2 type
  misc_feature: Functional Homolog Of Ceres SEEDLINE ID no. ME16597 at SEQ ID NO. 907
MEQELSLELTLFHPSVSPEPPGYFVCTYCDRKFFTSQALGGHQNAHKYERSLAKRRREIATALRAHGAAATATGVQDAAAMGSRDVPARPQGTGSGADKSATRMDKHKAPADDAAPAPAASSNRKRSSEELDLSLRL

SEQ ID NO: 944 - DNA, 717 bp, Zea mays
  misc_feature: Ceres CLONE ID no.380740
  misc_feature: Encodes the peptide sequence at SEQ ID NO. 945
acacacacagtcacagacacccctatcacttagactgtgctagtaggtagcggccgcgtaatggagcaggagctcagccttgagctcaccctcctccacccctcggcctcgccgccggagccgccgggctacttcgtctgcatgtactgcgaccgcaagttcttcagctcgcaggctctcggtggccaccagaacgcgcacaagtacgagcgcagcctggccaagcgccgcagggagatagccgccgccctgcgcgcgcacggggcggccgccaccgccacgggcgccccggaggacgacgccgccgccgcgatgggctctcgcgatgtccccgccaggccacagggcacgggtaccggagtcgtcgtcgktgaagatgaagagtgcamccaggatgatggacaagcagaaggctcttgctgatgatgacgacgctcccgcgaccgcacattatctatggtcaactcctatgccttaataatacttttcagttgaaaaacagtttgtgtcgtagttgtaatgcttcaactcctatgcgagtctgattgatgtctctctttttgtgactgtggccacagtgcgctagaacagttatctatggtacaatatagtcagttcataataatacttttcaggatccctcattgaatatatataaaagttgtatctgataagaaccgaacttcctaggatcccaaaaaggttttttcttctcgc

SEQ ID NO: 945 - protein, 120 aa, Zea mays
  misc_feature: Ceres CLONE ID no.380740
  misc_feature: Bit score of 97.7 for HMM based on sequences of FIGURE 10.
  misc_feature (25)..(47): Pfam Name: zf-C2H2 Pfam Description: Zinc finger, C2H2 type
  misc_feature: Functional Homolog Of Ceres SEEDLINE ID no. ME16597 at SEQ ID NO. 907
  misc_feature (104)..(104): Xaa is any aa, unknown, or other
  misc_feature (110)..(110): Xaa is any aa, unknown, or other
MEQELSLELTLLHPSASPPEPPGYFVCMYCDRKFFSSQALGGHQNAHKYERSLAKRRREIAAALRAHGAAATATGAPEDDAAAAMGSRDVPARPQGTGTGVVVXEDEECXQDDGQAEGSC

SEQ ID NO: 946 - DNA, 693 bp, Panicum virgatum
  misc_feature: Ceres CLONE ID no.1873510
  misc_feature: Encodes the peptide sequence at SEQ ID NO. 947
gtcagttcatttctgctgcacaatcacagacacgcagtcgcgagctataagttttaatttgccaacatgaagagcagactgagcagtagactgccgtggcagcaagaggaggagctggacctcgagctcagcctcctccccggcgactcggacacggagccgcccggcttcttccgctgcacctactgcgaccgcaagttctacacctcgcaggcgctcggcggccaccagaacgcgcacaagtacgagcgcaccctcgccaagcgccgccgcgagatcgccgccgccttcaatgccggcggcgcggggcgcgccatcagcgtcgccgcgggagctgagaccgtcggagcgaggccgcggctggaagacgctctggcgccggagagatcgtctcgcctgctgctgcgggacaagaagggctcgtcggagcacggcggcgtcgagcgcgccgacgagctggacctgtccctcaggctatgatcgatggacctcgccctcggcgcctctcaagtttccgtaatcggtttgcctgctggttaatttttcctacctgtatgctttgcctcttagattattcaccgtcatcttgcacataaaagctgagtttctatccttggatacatatatgcttgcagatgagtttgtgtaataataggatttcttggcaacacgcgaagggcatataattcgtcc

SEQ ID NO: 947 - protein, 137 aa, Panicum virgatum
  misc_feature: Ceres CLONE ID no.1873510
  misc_feature: Bit score of 160.5 for HMM based on sequences of FIGURE 10.
  misc_feature (36)..(58): Pfam Name: zf-C2H2 Pfam Description: Zinc finger, C2H2 type
  misc_feature: Functional Homolog Of Ceres SEEDLINE ID no. ME16597 at SEQ ID NO. 907
MKSRLSSRLPWQQEEELDLELSLLPGDSDTEPPGFFRCTYCDRKFYTSQALGGHQNAHKYERTLAKRRREIAAAFNAGGAGRAISVAAGAETVGARPRLEDALAPERSSRLLLRDKKGSSEHGGVERADELDLSLRL

SEQ ID NO: 948 - protein, 195 aa, Oryza sativa subsp. indica
  misc_feature: Public GI ID no.125541662
  misc_feature: Bit score of 306.8 for HMM based on sequences of FIGURE 10.
  misc_feature (47)..(69): Pfam Name: zf-C2H2 Pfam Description: Zinc finger, C2H2 type
  misc_feature: Functional Homolog Of Ceres SEEDLINE ID no. ME16597 at SEQ ID NO. 907
MSQETSKDEVIGGRSPSGDGDKAEEELREARSGDDDDDDEAGTRQPYNCTFCRRGFPTAQALGGHMNVHRKDRVGRATPSSSSSTTAAAARRSVSYDTLVGLFLPPASGGSEDAAASTAAGGGGSLRSRTAEPAPQELRLFGRGAGRREEGGGRDRRDRYGCCSKDGDGNGGHDHGEEEELDLELRLGGSGSAGS

SEQ ID NO: 949 - protein, 210 aa, Oryza sativa subsp. indica
  misc_feature: Public GI ID no.125531536
  misc_feature: Bit score of 103.0 for HMM based on sequences of FIGURE 10.
  misc_feature (47)..(69): Pfam Name: zf-C2H2 Pfam Description: Zinc finger, C2H2 type
  misc_feature: Functional Homolog Of Ceres SEEDLINE ID no. ME16597 at SEQ ID NO. 907
MDMDDGSSKGSRADESVSSLGTDDHAAAAEPMSSSPPPATATARPYYECVFCKRGFTTAQALGGHMNIHRRDRAAKPAGPGAAAPPRDASTTAVSRSVDCYSQFRHLAAAYPVPAATSGAAGTAGSSSSFTMYYGGTGAGAEAAVVAGPRELSLFDAATDHGLHLGVGRRGGGGDGGESRTPEGSEQQVAGELPERELDLELRLGRHTKQ

SEQ ID NO: 950 - protein, 195 aa, Oryza sativa subsp. japonica
  misc_feature: Public GI ID no.48716268
  misc_feature: Bit score of 305.8 for HMM based on sequences of FIGURE 10.
  misc_feature (47)..(69): Pfam Name: zf-C2H2 Pfam Description: Zinc finger, C2H2 type
  misc_feature: Functional Homolog Of Ceres SEEDLINE ID no. ME16597 at SEQ ID NO. 907
MSQKTSKDEVIGGRSPSGDGDKAEEELREARSGDDDDDDEAGTRQPYNCTFCRRGFPTAQALGGHMNVHRKDRVGRATPSSSSSTTAAAARRSVSYDTLVRLFRPPASGGSEDAAASTAAGGGASLRSRTAEPAPQELRLFGRGAGRREEGGGRDRRDRYGCCSKDGDGNGGHDHGEEEELDLELRLGGSGSAGS

SEQ ID NO: 951 - DNA, 585 bp, Arabidopsis thaliana
  misc_feature: Ceres SEEDLINE ID no.ME16630
  misc_feature: Genomic Sequence
  misc_feature: Expected Sequence
  misc_feature: Encodes the peptide sequence at SEQ ID NO. 953
atggagaagaagttgttggatataactcggactgactcggctgagaaaaagcgagtcagagacgagtcattcgacgaagcggttcttgactcgccggaggtgaagaggttgagagatgatttattcgatgtcctggatgactcggatcctgaaccagtgagtcaagatctcgactcggttatgaaaagtttcgaagacgagttatcaacggtcaccaccacgacggcgcaaggttcctctaccgccggcgaaactcagcctgatctcggatatcttcttgaagcttccgatgatgagcttggtttaccaccacctccatcgatttctccggttcccgtcgcgaaggaggaggtaacgacggagacggtaacggatttggtacgagcgtcttctgattcgtcaggaatcgacgagatttggggatttgaagatcacgtgtcgaattacggtggtttagattttggttccggcgtcggagatggtggagattacgtggctgttgaggggttgtttgaattttccgacgattgttttgactccggcgatctgttttcgtggcggtcggagtcgttaccggcggaataa

SEQ ID NO: 952 - DNA, 585 bp, Arabidopsis thaliana; identical to SEQ ID NO: 951
  misc_feature: Ceres SEEDLINE ID no.ME16630
  misc_feature: Predicted Sequence
  misc_feature: Encodes the peptide sequence at SEQ ID NO. 953

SEQ ID NO: 953 - protein, 194 aa, Arabidopsis thaliana
  misc_feature: Ceres SEEDLINE ID no.ME16630
  misc_feature: Bit score of 403.4 for HMM based on sequences of FIGURE 11.
MEKKLLDITRTDSAEKKRVRDESFDEAVLDSPEVKRLRDDLFDVLDDSDPEPVSQDLDSVMKSFEDELSTVTTTTAQGSSTAGETQPDLGYLLEASDDELGLPPPPSISPVPVAKEEVTTETVTDLVRASSDSSGIDEIWGFEDHVSNYGGLDFGSGVGDGGDYVAVEGLFEFSDDCFDSGDLFSWRSESLPAE

SEQ ID NO: 954 - DNA, 679 bp, Gossypium hirsutum
  misc_feature: Ceres CLONE ID no.1798705
  misc_feature: Encodes the peptide sequence at SEQ ID NO. 955
acctcaatctccctccttcgcgtttctttattcctaactctctttaccacctaaacctccttccattcatttttacgttttaatggatgagttaaacagcaagaagcgggctagggacgactccaatgagtcgggtctggactcgcccgacgtgaagagactcagagatgatttatttcttgatgattcagattccttgcctcttaatcaagaccttgcatccgtaatgaagagttttgaagaggagatatcagccgtcccatcgacttcgacggaatctatgccggttgtggatctcacttcggattctggtgactcacaaccggatcttggttaccttctcgaggcttccgatgatgaacttggtctgcctccccctacggcttccacaactgatgctgagggaaggtccgaagcgactgatttggtgcgagctgactcaaactcctcgggaatccatgatttgtgggggttcgaggaacaaaaccccaactacgattctttcgagtttggattcgttgataatttcaatgatggcaccgttgcatatgatggactgttcgagtattccgatgtctattacgattcctccgatatttctggtcagctatggcggccggaaactttgtcggcgaagtaaaaatccaaacttaaaatccaaaaaaaaaaaaaaaaaaaa

SEQ ID NO: 955 - protein, 185 aa, Gossypium hirsutum
  misc_feature: Ceres CLONE ID no.1798705
  misc_feature: Bit score of 401.5 for HMM based on sequences of FIGURE 11.
  misc_feature: Functional Homolog Of Ceres SEEDLINE ID no. ME16630 at SEQ ID NO. 953
MDELNSKKRARDDSNESGLDSPDVKRLRDDLFLDDSDSLPLNQDLASVMKSFEEEISAVPSTSTESMPVVDLTSDSGDSQPDLGYLLEASDDELGLPPPTASTTDAEGRSEATDLVRADSNSSGIHDLWGFEEQNPNYDSFEFGFVDNFNDGTVAYDGLFEYSDVYYDSSDISGQLWRPETLSAK

SEQ ID NO: 956 - DNA, 1112 bp, Gossypium hirsutum
  misc_feature: Ceres CLONE ID no.1793754
  misc_feature: Encodes the peptide sequence at SEQ ID NO. 957
acccaataccccgtattttctctctctacactttcactttctctctctagaaaccctctcgttaaacagtttattataaaattttcaaatccttaataaaatcaccagcaactctctgatttgaaaactgagggttttctttttttctgcaatttttttggaactgaagatttactaatggttatgggggataacgaaggaaataaaaagagagcccgggaagagacagaggctaactcggtgcccaatacaaaactcgctcgagttgacttggacgataataagggtcccgactccgactctcccgaggctactcgtgtagaacctgatcctgatgatggagaagataatttgccggaaacaaggcgtataccggaggaattgctgaacatcctcgacgattcagatccggttagtggaccagatccggcgattcagggactcgattcggtcatcaggagtttcgaagaagagatcttatttccggaacaggtggctttaccggaaacgatattggattccggagagtcgaggccggagttagggtttctatttgaagcttcggatgatgaactgggtttgccaccgagtttaccgtcggttgaggtggagcagagatttgagaccgcctttgatgtggatgaaggtggagggtcaggcggcgttggatttggggaaatgatggggagtgagttcccgattccgatctacgaaccgtttgaattcggaatcggcgttgactcagataccaataacaatatccatagtaataataccggtgattttgtggcgttaggagggttgtttgaaccggcggctgatatttcggagctgacgtggcggcctgaatcactttccgccttgtagtaaaaattaaataaataaaaaacaaccgaaacggttcgttttggctccgtatacatcacgtggacatattcgtttttttttttgggggtaattacataaatatacatgtggtctagatttagttttaagcctgaaatataagttcttaatggtaataatacgacatttatttaaccatcttccgtctatttgtaatttaaacttaacactgttgattaaatttaaattttagtaatattttagtt

SEQ ID NO: 957 - protein, 229 aa, Gossypium hirsutum
  misc_feature: Ceres CLONE ID no.1793754
  misc_feature: Bit score of 99.5 for HMM based on sequences of FIGURE 11.
  misc_feature: Functional Homolog Of Ceres SEEDLINE ID no. ME16630 at SEQ ID NO. 953
MVMGDNEGNKKRAREETEANSVPNTKLARVDLDDNKGPDSDSPEATRVEPDPDDGEDNLPETRRIPEELLNILDDSDPVSGPDPAIQGLDSVIRSFEEEILFPEQVALPETILDSGESRPELGFLFEASDDELGLPPSLPSVEVEQRFETAFDVDEGGGSGGVGFGEMMGSEFPIPIYEPFEFGIGVDSDTNNNIHSNNTGDFVALGGLFEPAADISELTWRPESLSAL

SEQ ID NO: 958 - DNA, 1007 bp, Gossypium hirsutum
  misc_feature: Ceres CLONE ID no.1938045
  misc_feature: Encodes the peptide sequence at SEQ ID NO. 959
accctatattcctcattttctctctctacaaaatctctgctcccctctctttattttatttttctcgacatccaaacactctctccacacttaaaaattttgacactcttttgcagtctgctccttataaaatctccctatctttatatgtatccaatgacaagttactatattgaacactaagctttcttttccaatttcctgaaacattttccaatggaaaatgacgataacagaggcgacaagaagagtgcccgggaagagtttgagaattttgagtcagaggctaactcggttccctttttaaaactctctcgagtcgactcgtccgagttcactcgtgtggaatccgcccttgattacgtggacgttcagttgccggagtcaaagcatatccaggaggatttgctgaacttcctggacgattccgacccggtcattggacctggactggggattcagggacttgactcggttctcaaaagtttcgaagaagagatcgtagttccggctcaggcgacgctaacggtaacatcgttggaaacccgcaagtcgaagccggatctagggtttcttttaaaggcttcggatgatgaactgggtttgccaccgagtttttcgtctgttgagcagggcgttgatatagagggaagtgtagagttaggagccgatggaatagaggaaatgatgggatatgagttcccaattccgagttacggatcgtttgacttcggaatcggcggtgactcagatgccgacaacaaaaatcatagtaatagcggtgattttgtggcgttaggaggcttggtcgaacccattgtagaaatttcggagctaacctcgtgacctgaatcgctttacgcactacggtgccgtttgatctaaatcttttctttttttgaaaaaaaatagtggatatgtaggcctgtaaatcttgttaattactaaaatggtaaattaaaggaaaaaaaactgggttggaggtggaaaaaaaaaaaaaaaaaaaa

SEQ ID NO: 959 - protein, 209 aa, Gossypium hirsutum
  misc_feature: Ceres CLONE ID no.1938045
  misc_feature: Bit score of 63.2 for HMM based on sequences of FIGURE 11.
  misc_feature: Functional Homolog Of Ceres SEEDLINE ID no. ME16630 at SEQ ID NO. 953
MENDDNRGDKKSAREEFENFESEANSVPFLKLSRVDSSEFTRVESALDYVDVQLPESKHIQEDLLNFLDDSDPVIGPGLGIQGLDSVLKSFEEEIVVPAQATLTVTSLETRKSKPDLGFLLKASDDELGLPPSFSSVEQGVDIEGSVELGADGIEEMMGYEFPIPSYGSFDFGIGGDSDADNKNHSNSGDFVALGGLVEPIVEISELTS

SEQ ID NO: 960 - DNA, 967 bp, Gossypium hirsutum
  misc_feature: Ceres CLONE ID no.1850004
  misc_feature: Encodes the peptide sequence at SEQ ID NO. 961
actcaaataattttcccgcattttctttattgtttttcacactatccaaacaatatcttaaaatagtagattaaagtgtaaaagttcttcaatggcgatggaggataataaaggaaacaagagaactcgagtagagtttgaggattttgaaacggagggtaacttggagtcggtccataattcaaagctcgctcgagttgactcggagaattcgggctcgaactcttctgaggttacttacgtggaacctgatcctgacgatgagggaattcagtcgccggatgtgaagcgtatccaggaagatttgcttgatatcttggacgattcggatccggttattggacttgatccggagattcagggtctcgacttggttatcaaaagcttcgaagaagagatctcggtccccgctcaggatccggtacaggaattagattccggcgagtcccggctggagctagggtttggtttagaagcttctggatacgagttggatttaccgccggattttgaggagaaacttgcgacccttgatgtcgaggaaggtggagggacaggagcagttggattagcggatatgatggggtatgaatttccgattccgagttacgaatcgttcgagtttggagtcggcggtgactgggttatcaatagcgataataataatagccatagtaaaagcggtgattgtgtggcgtttggaggtttatttgatacatcggcggatatttcggagttgacgtggcgccctgaatcgctctctgctttatagataaagaaaaaaaacattcaagagataacggtgccgtttctttgtggtcgaatatgatatggacatttagggtcattttttgatgctagattaggttttttttttttagattttgggtatttattaaatgagaagaaaaaaaaataaaattatgtaataaagcttcgttctcgttaaaaaaaaaaaaaaaaaaaa

SEQ ID NO: 961 - protein, 226 aa, Gossypium hirsutum
  misc_feature: Ceres CLONE ID no.1850004
  misc_feature: Bit score of 66.4 for HMM based on sequences of FIGURE 11.
  misc_feature: Functional Homolog Of Ceres SEEDLINE ID no. ME16630 at SEQ ID NO. 953
MAMEDNKGNKRTRVEFEDFETEGNLESVHNSKLARVDSENSGSNSSEVTYVEPDPDDEGIQSPDVKRIQEDLLDILDDSDPVIGLDPEIQGLDLVIKSFEEEISVPAQDPVQELDSGESRLELGFGLEASGYELDLPPDFEEKLATLDVEEGGGTGAVGLADMMGYEFPIPSYESFEFGVGGDWVINSDNNNSHSKSGDCVAFGGLFDTSADISELTWRPESLSAL

SEQ ID NO: 962 - DNA, 573 bp, Populus balsamifera subsp. trichocarpa
  misc_feature: Ceres ANNOT ID no.1458907
  misc_feature: Encodes the peptide sequence at SEQ ID NO. 963
atggaagaactgctaaaccataaaaagcgagtaagggatggctcggacgagtcggatttggattttccggaggttaagaaaatcagggacgatctattcggtctcctcgatgactcggaccccgactcactgggtcaggatctagactcggtcatgaaaagttttgaacaagagatttccgcgtcttcctcatccccggtgcctgtcgtcgacctgacctctgaatcaggcgagtcccagccggatcttggctttcttctagaagcttctgatgatgaactcggcttgcctccttcgtcaatcaatttgtcgagtggggaagtcaagggtggggtagagactgagttggcccgagttgactctgcccagtcgtccggggtcggcggtgagttgtgggggtttgaggaccagatcccgacttatgactcgttcgggcttggagtaggagacagtaattatagcagtgattacgtggggttcgatgactcgttgttcgagtactctaatgtttgtttcgactcgtccgatttctcggatttgtcgtggcggttgggtggcatgccggccgagtaa

SEQ ID NO: 963 - protein, 190 aa, Populus balsamifera subsp. trichocarpa
  misc_feature: Ceres ANNOT ID no.1458907
  misc_feature: Bit score of 386.3 for HMM based on sequences of FIGURE 11.
  misc_feature: Functional Homolog Of Ceres SEEDLINE ID no. ME16630 at SEQ ID NO. 953
MEELLNHKKRVRDGSDESDLDFPEVKKIRDDLFGLLDDSDPDSLGQDLDSVMKSFEQEISASSSSPVPVVDLTSESGESQPDLGFLLEASDDELGLPPSSINLSSGEVKGGVETELARVDSAQSSGVGGELWGFEDQIPTYDSFGLGVGDSNYSSDYVGFDDSLFEYSNVCFDSSDFSDLSWRLGGMPAE

SEQ ID NO: 964 - DNA, 630 bp, Populus balsamifera subsp. trichocarpa
  misc_feature: Ceres ANNOT ID no.1489548
  misc_feature: Encodes the peptide sequence at SEQ ID NO. 965
atggatcaagaaaacagaaagaaacgaacccgggatgagttgggcgtctcgagttccgaatctcccgaggttaaactagctcgggttgactcggaggctaactcgccccttctggaacctgaccgagatgaactggttgaggtacgtgaagatttgctcagcatctttgatgattcggatgagccagtcgttcaggggctggaatcggttataaaaagttttgaagaggagattcacgtaggggttccggtgccggatatgtcgtcagattctggtggttcccaaacggaccttggttacctcctagaggcctcggatgacgagcttggcttgccgccgacgtttgctgttggcgaggagaaagacaccgccgctgtcgccgttttgccagcggaggaggagggacctggagctgttggttttgttgagatgctacggtttgaggatgagataccgagttatgactcatttgagtttgggctcgttggtaacacggaaggaaatcataattattgtgataataacggagattttgtggcgttaggtgggttgtttgattattcggacgagaactcggtaccggccgatatttcgggattgctgtggcagcccgagttatcggctttgtga

SEQ ID NO: 965 - protein, 209 aa, Populus balsamifera subsp. trichocarpa
  misc_feature: Ceres ANNOT ID no.1489548
  misc_feature: Bit score of 142.8 for HMM based on sequences of FIGURE 11.
  misc_feature: Functional Homolog Of Ceres SEEDLINE ID no. ME16630 at SEQ ID NO. 953
MDQENRKKRTRDELGVSSSESPEVKLARVDSEANSPLLEPDRDELVEVREDLLSIFDDSDEPVVQGLESVIKSFEEEIHVGVPVPDMSSDSGGSQTDLGYLLEASDDELGLPPTFAVGEEKDTAAVAVLPAEEEGPGAVGFVEMLRFEDEIPSYDSFEFGLVGNTEGNHNYCDNNGDFVALGGLFDYSDENSVPADISGLLWQPELSAL

SEQ ID NO: 966 - protein, 194 aa, Arabidopsis thaliana; identical to SEQ ID NO: 953
  misc_feature: Public GI ID no.22329538
  misc_feature: Bit score of 403.4 for HMM based on sequences of FIGURE 11.
  misc_feature: Functional Homolog Of Ceres SEEDLINE ID no. ME16630 at SEQ ID NO. 953

SEQ ID NO: 967 - protein, 170 aa, Arabidopsis thaliana
  misc_feature: Public GI ID no.18404714
  misc_feature: Bit score of 213.5 for HMM based on sequences of FIGURE 11.
  misc_feature: Functional Homolog Of Ceres SEEDLINE ID no. ME16630 at SEQ ID NO. 953
MEDLLEERLTRTDSVGNKRVRDGLDLDSPDVKRLRDDLFDDSGLDPVSQDLDSVMKSFENELSTTTAALSSGETQPDLGYLFEASDDELGLPPPLTPPQTLLPPSCEETVTELVRASSDSSEVGELCGFEDHVTEFGPCDLGDDGLFEYFDGCLDSGDLFSWRPEFLPAE

SEQ ID NO: 968 - DNA, 965 bp, Brassica napus
  misc_feature: Ceres CLONE ID no.1110032
  misc_feature: Encodes the peptide sequence at SEQ ID NO. 969
atccctcactaatttcaatactgccactgataaaataaaaaagtttcaccgaacaaaacaaagaaagaaccgaaagagtatggcggaggagttgttggctaacgaagagaggctaactcggactgactcagctgagaaaaagcgagtcagggacgagtctgacgacacggttattgactcccccgaggtgaagaggctcagagacgatttattcgatgttctcgatgactcggatcctgaaccggtgagtcaagatctcgactcggtcatgaagagtttcgaggacgagctatcttccacggttaccacggcgcaaggatccggcgaaacccagccggatctcggctaccttctcgaggcttccgatgacgagcttggtctgccgccggtttctccggttcccgtcgcgaaggaggtggaaacgacggagacgttaacggatctggtgcgagcgtcgtcggattcgtcaggagtcgacgagctatgggggttcgaggatcatttgtcgaattacggctcgttagatttcggttccggcgtcggagatggtggagattacctcgccgtagaggggctctttgaattttccgattatggtttcgatgccggcgagctattttcgtggcggtcggagtctttaccggcggaataaaaacttttcggagttttttatctgacgtgaaaaatgataaaacgatgccgttttgtaaagcgtgtggctgctatgtcgttttttttaccccctatcattttatggtagattgttaattttctattgattaattattaggattaggaaagtatgtttttttattaggaaagttaaatactttgttagtgggggtaattttctagattaatataatcgaattcgtttgtttgttcttcccagatctttaatagtttttgttgatgtggaaaattatattaatatgaaatacaccctgccaaaaaaaaaaaaaaaa

SEQ ID NO: 969 - protein, 190 aa, Brassica napus
  misc_feature: Ceres CLONE ID no.1110032
  misc_feature: Bit score of 326.5 for HMM based on sequences of FIGURE 11.
  misc_feature: Functional Homolog Of Ceres SEEDLINE ID no. ME16630 at SEQ ID NO. 953
MAEELLANEERLTRTDSAEKKRVRDESDDTVIDSPEVKRLRDDLFDVLDDSDPEPVSQDLDSVMKSFEDELSSTVTTAQGSGETQPDLGYLLEASDDELGLPPVSPVPVAKEVETTETLTDLVRASSDSSGVDELWGFEDHLSNYGSLDFGSGVGDGGDYLAVEGLFEFSDYGFDAGELFSWRSESLPAE

SEQ ID NO: 970 - DNA, 884 bp, Brassica napus
  misc_feature: Ceres CLONE ID no.1090409
  misc_feature: Encodes the peptide sequence at SEQ ID NO. 971
gcacctctatctcccactaatttcgatactgccactaagcaaaaaaaagtttcagcgaacaaaaaaaaaaacgtaactgatattctatggcggaggagacgctaactcggactgactcagctgagccaaccgataaaaagcgagtcagggacgagtctgacggcgcggttctcgactcaccggaggtcaagaggctgagagatgatttattcgacgttttcgatgactcggatcccgaaccggtgagtcaagatctcgactcggttatgaagagtttcgaggacgagttatcttcggcgcagccccgcggcgagactcagccggatctcggttaccttctagaggcttcggacgatgagctcgggctgccaccgccgcctccaccggtttccgtggtggaggaggtggagacgacggagacggtggcggatttggtacgagcgtcgtcggattcgtcgggaatcgacgagttatgggggttcgaggatcacgtgccggattacggctctttagatttcggttccggcgtcggagatggtggagattacgtcaccgttgaggggctgtttgatttttccggcgaatgttttgattccggcgatctattctcgtggcggccggagtctttaccggcggaataaaacgaacgtttttcttaggtaggaaattaaaaacgatgccgtttgtaaagcgtttggcttccctgccgttttttacccctaccctacggtagatggtggttaatttctatggattattaattatgaggattaggaaatttaaatattttgttattaggaaagttaaatattttgttagtgggtgtaactttctagattagtatgtgtgcgaattcgtttgttcctcccaaaaaaaaaaaaaaa

SEQ ID NO: 971 - protein, 184 aa, Brassica napus
  misc_feature: Ceres CLONE ID no.1090409
  misc_feature: Bit score of 377.2 for HMM based on sequences of FIGURE 11.
  misc_feature: Functional Homolog Of Ceres SEEDLINE ID no. ME16630 at SEQ ID NO. 953
MAEETLTRTDSAEPTDKKRVRDESDGAVLDSPEVKRLRDDLFDVFDDSDPEPVSQDLDSVMKSFEDELSSAQPRGETQPDLGYLLEASDDELGLPPPPPPVSVVEEVETTETVADLVRASSDSSGIDELWGFEDHVPDYGSLDFGSGVGDGGDYVTVEGLFDFSGECFDSGDLFSWRPESLPAE

SEQ ID NO: 972 - DNA, 921 bp, Brassica napus
  misc_feature: Ceres CLONE ID no.1095353
  misc_feature: Encodes the peptide sequence at SEQ ID NO. 973
acctctatctcccactaatttcgatattgccactgaagaaaaaaaaaaagttccacccaacaaaaaaacaaattgatattctatggcggaggagacgctaactcggacggactcagctgagccaaccgataaaaagcgagttagggacgagtctgacggcgcgattctcgactcgccggaggtgaagaggctgagagatgatttattcgacgttttcgatgactcagatcccgaaccggtgagtcaagatctcgactcggtcatgaagagtttcgaggacgagttatcttcggcgcagccccccggcgagactcagccggatctcggttaccttctagaggcttccgacgatgagctcggcttgccgccgccggtttccgtcgtgaaggaggtggagacgacggagacggtggcggatttgctacgagcgtcgtcggattcgtcgggaatcgacgagttatgggggttcgaggatcacgcgccggattacggctctttagatttcggttccggcgtcggagatggtggagattacgtcaccgttgaggggctatttgatttttccggcgaatgttttgattccggcgatctgttctcgtggcggtcggagtctttaccggcggaataaaacgatatttttttcttagataggaaattagaaaacggtgccgttttgtaaagcgtttgggcttccctgccgtttttttaccgctaccatgctatggtagatggtggttaaatggttaatttcctatgggttattgattatgaagattaggaaagttaaatattatgttagtgggtgtaattttgtagattagtatgtgcgaatttgtttgttcttctcagacctttaattatattctctctttgaatagtttttgttattgtgaaaatgttagtacaaaaaaaaaaaaaaaa

SEQ ID NO: 973 - protein, 181 aa, Brassica napus
  misc_feature: Ceres CLONE ID no.1095353
  misc_feature: Bit score of 362.7 for HMM based on sequences of FIGURE 11.
  misc_feature: Functional Homolog Of Ceres SEEDLINE ID no. ME16630 at SEQ ID NO. 953
MAEETLTRTDSAEPTDKKRVRDESDGAILDSPEVKRLRDDLFDVFDDSDPEPVSQDLDSVMKSFEDELSSAQPPGETQPDLGYLLEASDDELGLPPPVSVVKEVETTETVADLLRASSDSSGIDELWGFEDHAPDYGSLDFGSGVGDGGDYVTVEGLFDFSGECFDSGDLFSWRSESLPAE

SEQ ID NO: 974 - DNA, 854 bp, Brassica napus
  misc_feature: Ceres CLONE ID no.872121
  misc_feature: Encodes the peptide sequence at SEQ ID NO. 975
accgatactcccacgctaatttcgaaactgccactgattatttaatcaacgtaccatctaaaccgagtaattaaccataaccggttaagtaatggacggttttccaactgatgaggagaggctaactcggcgtgactcggttggtaagaagcgagtcagagacgagttggatgagttagttatcaactcgcccgacgtaaagcggctgagagacgatttgtttgatgactcgggtcatgacccagccactcaagatctcgactcgttgatgaagagcttcgaagacgagttgacgaacacgacggcgcaacaatccggcgagactcagccggatctcggatatcttttcgaagcttccgacgacgagctgggtttgcctccaccgcaaccgtcaacgcttcttcctccgtcgtctggggaaacaaaggagacggagttagtacgagcgtcgtcggattcatcaggagtcggcgagttacgtggaattgaggagcctgttacgggttttggatctttcgagctggatgatgggctgttcgaatattccgatgtttctttagattccggtgacctgttttcatggcggccggaaactctaccggcggagtaacaatgttccggagttttttttaaaagcgggagctgaaacggtggcgtttaaactcgcttagtgatataagatctctatattattgtaagattttaggattagagaaatcaaaggcttagtgtgggttaatgacttagactggtagttcatacccgtcctctttttccaggatctgttctgttgatcttgaatcatcttcatcctgtgtgttagcttttgttaatgttaaagctaaactattatc

SEQ ID NO: 975 - protein, 172 aa, Brassica napus
  misc_feature: Ceres CLONE ID no.872121
  misc_feature: Bit score of 228.0 for HMM based on sequences of FIGURE 11.
  misc_feature: Functional Homolog Of Ceres SEEDLINE ID no. ME16630 at SEQ ID NO. 953
MDGFPTDEERLTRRDSVGKKRVRDELDELVINSPDVKRLRDDLFDDSGHDPATQDLDSLMKSFEDELTNTTAQQSGETQPDLGYLFEASDDELGLPPPQPSTLLPPSSGETKETELVRASSDSSGVGELRGIEEPVTGFGSFELDDGLFEYSDVSLDSGDLFSWRPETLPAE

SEQ ID NO: 976 - DNA, 639 bp, Glycine max
  misc_feature: Ceres CLONE ID no.479817
  misc_feature: Encodes the peptide sequence at SEQ ID NO. 977
tacaacccaccgtgtcaactctcgttcaatcaccagcgattaagcgtgtctctcctaataccaaaacgctaccgttttgctcttttatttctctatggattgcaagaagcgagttcgggatgactcggacgagtcagttctggaatcgcccgaggcgaagcgactcagggacgatttactcgagttcttcgacgacgccgacgacgcaccttcctctcaggaccttgactccgtcatgaagagcctgcaggaggagatttccggcgtggcctcagattccggcgagtctcaggcgcagatcgggtaccttctggaggcctccgacgacgagctaggtcttccacccgccggaaactcgtcggcgccggaggagaagaacgtggagaccgagttggtccgagtcgcgtctgactcgtccggaatcggcgagttgtgggagtttgaggaacagattccgagatacgactcgtttgatttgggaatgggatttggctatgagtgtgatacgaccgaatacgctgcgtttggtggacttttcgatcattcggatttgtattatgactcgtggcggcacgagaccttgccaacacaatagaagatttaatgaaaacaaaaggaaaaaaagggttttagagatgc

SEQ ID NO: 977 - protein, 166 aa, Glycine max
  misc_feature: Ceres CLONE ID no.479817
  misc_feature: Bit score of 366.9 for HMM based on sequences of FIGURE 11.
  misc_feature: Functional Homolog Of Ceres SEEDLINE ID no. ME16630 at SEQ ID NO. 953
MDCKKRVRDDSDESVLESPEAKRLRDDLLEFFDDADDAPSSQDLDSVMKSLQEEISGVASDSGESQAQIGYLLEASDDELGLPPAGNSSAPEEKNVETELVRVASDSSGIGELWEFEEQIPRYDSFDLGMGFGYECDTTEYAAFGGLFDHSDLYYDSWRHETLPTQ

SEQ ID NO: 978 - DNA, 850 bp, Glycine max
  misc_feature: Ceres CLONE ID no.1041793
  misc_feature: Encodes the peptide sequence at SEQ ID NO. 979
aagaattgggtcccacgcgcctgcgacgtcagcatcattacaccgtactctctctctctctctccattgtccccctttatatataagcctcaccagatctcttcgccaccacaacccaccgtgtcaactctccttcaaacaccagcgattaaacttgtctctctttaatctcttaataccaaaacgctaccgttttgctcttttatttctctctctctctatggattgcaagaagcgagttcgggatgactcggacgaatcaattctggaatcgcccgaggcgaaacgactcagggacgatttactcgagttcttcgacgacgccgatgatgcagcttccactcaggaccttgactccgtcatgaagagcttgcaggaggagatttccggcgtgacgtcagattacggcgagtctcaggcgcagatcggatacctcctggaggcctccgacgacgatcttgggcttcctcccgccggaaactcgtcggcgccacaggagaagaacgtggaggccgagttggttcgagtcgcgtctgactcgtccggaatcggcgagttgtgggagtttgaggaccagattccgagatacgactcgttcgatttgggaatggggttcggttatgagtgcgatgctaccgaatacgctgcgtttggtgaacttttcgatcattctgatgtgtattatgactcgtggcggcaatagagatttaatgaaaactaaagggaaaaaagggttttagagatgtaaatgtttcttctcagcttttttattcttttagatgaagggaattacagaagaaagattataaagaaggacttgggataacaagatgcaaaaaaaaaaaaaaaa

SEQ ID NO: 979 - protein, 160 aa, Glycine max
  misc_feature: Ceres CLONE ID no.1041793
  misc_feature: Bit score of 333.2 for HMM based on sequences of FIGURE 11.
  misc_feature: Functional Homolog Of Ceres SEEDLINE ID no. ME16630 at SEQ ID NO. 953
MDCKKRVRDDSDESILESPEAKRLRDDLLEFFDDADDAASTQDLDSVMKSLQEEISGVTSDYGESQAQIGYLLEASDDDLGLPPAGNSSAPQEKNVEAELVRVASDSSGIGELWEFEDQIPRYDSFDLGMGFGYECDATEYAAFGELFDHSDVYYDSWRQ

SEQ ID NO: 980 - DNA, 910 bp, Glycine max
  misc_feature: Ceres CLONE ID no.562208
  misc_feature: Encodes the peptide sequence at SEQ ID NO. 981
acattttctctcttctttatcttaaattacttttccatggaggaaagcaagaaacgagtccgggacgagtccagctactcacccgagtcccaaactcagctggtcgactctcccgagtctgaaagtcagcgggtcgactcacctgagtctaagattcgtcgagttgactcgtccgagtctcaactcgactcggtccttgactcggaggtgcgtctacaagacgacatttttaacatacttgacgacgccgataatgtgcctgagcgtgactcggtgcagggtcttgactcagtgatcaaaagcttcgaagatgagataaacgctcctggttcggattctggttcgggtgacccgacccaggaaccagactctggggagctacaatctaacttggggtatcttctagaagcctctgacgacgaactggggttgccgccgacggttgttgacggtgaggaaacgggtcgggttggtccggaaatgacggagcttgccaggttaatgggttttgaagatgatatacccagttatgatgcattcgggtttgggtcagggtttgcggcggagagtgacggcggcgccggaggttttgtgacggtggatgggttgtttgactattcggacccggcggcggatgttttgtggcggtcggagtcattacaagctatgtaggtgaccgcggcgagattttgcgatggttttggcagaagggtgcgtaggggtggaaaatgtaaatctaggaaaatattggggttaaaataggaggaggaaaaaaaagggtagggtagcatagaaacgtggtaggtagatgtgaaaagttgtagggtttgttgttttggttttttcgttgaattcaattgaaacaaactggactacttgatgagccgtttcagttttgttttgttgcttc

SEQ ID NO: 981 - protein, 211 aa, Glycine max
  misc_feature: Ceres CLONE ID no.562208
  misc_feature: Bit score of 97.0 for HMM based on sequences of FIGURE 11.
  misc_feature: Functional Homolog Of Ceres SEEDLINE ID no. ME16630 at SEQ ID NO. 953
MEESKKRVRDESSYSPESQTQLVDSPESESQRVDSPESKIRRVDSSESQLDSVLDSEVRLQDDIFNILDDADNVPERDSVQGLDSVIKSFEDEINAPGSDSGSGDPTQEPDSGELQSNLGYLLEASDDELGLPPTVVDGEETGRVGPEMTELARLMGFEDDIPSYDAFGFGSGFAAESDGGAGGFVTVDGLFDYSDPAADVLWRSESLQAM

SEQ ID NO: 982 - DNA, 885 bp, Glycine max
  misc_feature: Ceres CLONE ID no.1042364
  misc_feature: Encodes the peptide sequence at SEQ ID NO. 983
atttctcgttttctctctctacactcctttcagcacagcacaacacaacacaaaaccctttcccaaaaaaataaaaaataaaaaatggaggaatccaaattcggccaaaccgataagcgaaagcgagttcgcgacgagtcggactcggccctcaactcgcccgactcgttaaagcatccccgagccgagtctaactcgttcgagtctctccgagttgactcggacgagtttgaactcgcccggctcgacccggttcttctcaacatgctgaatgacgcggagaatgtggcggagcgtgaacccaccgtgcttgactctgttattaagagtttcgaagaagaaatactttctccggttccgaacccgaacctagcatccgaggcagatgtgtttaagccgaacctagggtacttattggaagcatccgacgacgagctagggttgccgccgacggtggcgccaagcgaggatgtgttgaaacccgaaacagttgattcggatcgtgttggaccagaaggaatggatctgactgggtttttggggtttgaagatgatattcgtagctacgaaggttttgggtttgtggggtatgatgtgggagataacggtggtggttatgtgacgatagatgggttgtttgactatgcggaacccggtgccgatattttgtggcggtcggagtcgttgcaggctttgtagttggttgggaagattaattaattaattaattaattaacgttttggctaatgaaggtgtataaagagccacagataacgtaggtgggttagatgtgaagttattctaagattctgaaaatttgttgtttcggttggccttgactgaaaacatgttctttaacctctttagcaaaaaaaaaaaaaaaa

SEQ ID NO: 983 - protein, 204 aa, Glycine max
  misc_feature: Ceres CLONE ID no.1042364
  misc_feature: Bit score of 97.9 for HMM based on sequences of FIGURE 11.
  misc_feature: Functional Homolog Of Ceres SEEDLINE ID no. ME16630 at SEQ ID NO. 953
MEESKFGQTDKRKRVRDESDSALNSPDSLKHPRAESNSFESLRVDSDEFELARLDPVLLNMLNDAENVAEREPTVLDSVIKSFEEEILSPVPNPNLASEADVFKPNLGYLLEASDDELGLPPTVAPSEDVLKPETVDSDRVGPEGMDLTGFLGFEDDIRSYEGFGFVGYDVGDNGGGYVTIDGLFDYAEPGADILWRSESLQAL

SEQ ID NO: 984 - DNA, 731 bp, Triticum aestivum
  misc_feature: Ceres CLONE ID no.684633
  misc_feature: Encodes the peptide sequence at SEQ ID NO. 985
gaagcaaagaagcgaagggaaagagaaggaagaatagtctgtgcatcggccatggagagctcctcctcgtctctcttgctgagttcgtatgccggcaacaacaagagggccagggatgccgacctcgaagtgggctcgtccgcggaggcggaggccgccaagaggatgcgaccggaggacctgctggacctgctcgccgacgacaccgacgccgcggcggccggcgacctggcctccgtcatgcggagccttgaggaggagatatgcgccgacgagctgatgccgccgcagccggagctggggttcctgctcgaggcctccgacgacgagctcggcctgccgccggccgccggggcgtcctcctcgtcggacgacgccgggggctgggagccggaggaggccgcaggcctgttcggggagcagatatggggcttcgaggacgagattgacggcgcatacgccttcggcggcgtcgcctactcgccggaggccgccgtggcggctgctgcggccgcggccgagtggggcgacgacggctttgacgccggcctgttcggcttcggcgacgagtcattcgggccgtccgatctcgacgtgcttcgccaggagaccatgcccgccgtttgatcagtcgtcagtggatggatggattagccttttcttttttacctttggctgactttagctttaccctttttttaagagaaatgtcaaaaataaaccttaacttc

SEQ ID NO: 985 - protein, 191 aa, Triticum aestivum
  misc_feature: Ceres CLONE ID no.684633
  misc_feature: Bit score of 359.8 for HMM based on sequences of FIGURE 11.
  misc_feature: Functional Homolog Of Ceres SEEDLINE ID no. ME16630 at SEQ ID NO. 953
MESSSSSLLLSSYAGNNKRARDADLEVGSSAEAEAAKRMRPEDLLDLLADDTDAAAAGDLASVMRSLEEEICADELMPPQPELGFLLEASDDELGLPPAAGASSSSDDAGGWEPEEAAGLFGEQIWGFEDEIDGAYAFGGVAYSPEAAVAAAAAAAEWGDDGFDAGLFGFGDESFGPSDLDVLRQETMPAV

SEQ ID NO: 986 - DNA, 912 bp, Triticum aestivum
  misc_feature: Ceres CLONE ID no.1031873
  misc_feature: Encodes the peptide sequence at SEQ ID NO. 987
gcacaacacgcaccgctttttgtactcctttctccccccgtctcgtgcgcccttcgcgtttcgcgctctctctgaggagtcgggttacgttcacgttcacgtccgttgccccgcacccacccacccctccgagggaaacgaaaagaagagtttcctctgccggccatggagagctcctcctcgtcatctctgttgctgagctcgtataccggcggcaacaggagggccagggaggccgacctcgacgttgtctcgtccgcggaggccgaggccgccaagaggatgcggcccgaggacctgctggacctgctcgacgacgacgccgacgccgcggcggccggcgacctggcctccgtcatgcgcagcctcgaggaggagatttgcgccggcgacctggccccgccgcagccggagctcggcttcctgctcgaggcctcggacgacgagctcggcctgccgccggcggcgggcgcggcgtcctcctcgtcggacgacgccgggggctgggagccggaggagccggccggcgtcttcgcggagcagatctggggcttcgaggacgagattgacggcgcctacgccttcggcggcgtcgcctcctcgccggaggcggcagcggctgccgccgcggccgcggccgagtggggcgacgacggcttcgacgccggcctcttcggcttcggcgacgagtccttcgggccgtccgatctcgccgtgctccgccacgagaccatgccggccgtctgatcagtcgtcgtcagtggacgggcggacggatggattagccttttcttttttacctttggctaaccttagcgctaccctttttttaacctttggggaatgtaaagtttctagatgcaagaaggaagaaaaaactgtggggaggaaaaaaaaaaaaaaaaaaaaaaa

SEQ ID NO: 987 - protein, 193 aa, Triticum aestivum
  misc_feature: Ceres CLONE ID no.1031873
  misc_feature: Bit score of 338.3 for HMM based on sequences of FIGURE 11.
  misc_feature: Functional Homolog Of Ceres SEEDLINE ID no. ME16630 at SEQ ID NO. 953
MESSSSSSLLLSSYTGGNRRAREADLDVVSSAEAEAAKRMRPEDLLDLLDDDADAAAAGDLASVMRSLEEEICAGDLAPPQPELGFLLEASDDELGLPPAAGAASSSSDDAGGWEPEEPAGVFAEQIWGFEDEIDGAYAFGGVASSPEAAAAAAAAAAEWGDDGFDAGLFGFGDESFGPSDLAVLRHETMPAV

SEQ ID NO: 988 - DNA, 863 bp, Zea mays
  misc_feature: Ceres CLONE ID no.1377698
  misc_feature: Encodes the peptide sequence at SEQ ID NO. 989
acctagaacatcctaatcgaaaaatccaaacacttatctttttctctctcttccctcttcaatcttcacattttctctatggagaatcatggcaacaagcgagtctgggaccagtcctctgactccaacactcagcgggtcgactcgcccgagtctaagattcgtcgagttgactcgtccgattcgggtattaactcgtccgagtctcaactcgaatcggtcctcgactcgtcggaggtgcagctacaagacgacatttttaacatgcttgacgacacggacaatgtgcccgagcgtgactcggtgcagggtcttgactcagtgatcaaaagcttcgaggatgagataaatgctccaggttcggattctggttccggtgacccggcccaggaacccgactccggggagctacaatctaacttgggctatcttctagaagcctccgacgacgagctcgggttgccgccgacggtgggtgacggcgaggaaatgggtcgggctgccccggaaatggcggagcttgccaggttcgtgggatttgaagacgacatacccagttatgatgcattcgggtttgggtcggggtttacggcggagaatgacggaggtgccggaggttttgtgacggtggatgggttgtttgactattcggacccgtcggcggatgttttgtggcggtcggagtcattacaagctatgtaggtggtggcggtggttttagtgaaacggtgcgtaggggtggaaaatgtaaatctgggaaaatattggcgttaaaaataggaggaggggtagcacagaaaggtaggaggtagatgtgaaaaagttgtagggttaggatttgtttgttgttttggttttttcgt

SEQ ID NO: 989 - protein, 207 aa, Zea mays
  misc_feature: Ceres CLONE ID no.1377698
  misc_feature: Bit score of 103.5 for HMM based on sequences of FIGURE 11.
  misc_feature: Functional Homolog Of Ceres SEEDLINE ID no. ME16630 at SEQ ID NO. 953
MENHGNKRVWDQSSDSNTQRVDSPESKIRRVDSSDSGINSSESQLESVLDSSEVQLQDDIFNMLDDTDNVPERDSVQGLDSVIKSFEDEINAPGSDSGSGDPAQEPDSGELQSNLGYLLEASDDELGLPPTVGDGEEMGRAAPEMAELARFVGFEDDIPSYDAFGFGSGFTAENDGGAGGFVTVDGLFDYSDPSADVLWRSESLQAM

SEQ ID NO: 990 - DNA, 890 bp, Zea mays
  misc_feature: Ceres CLONE ID no.371815
  misc_feature: Encodes the peptide sequence at SEQ ID NO. 991
gctttttgtactcttccgtctttgccctcgcgttaacgcgctcgtctcgcctggcctagctagctgcctgccttggcttgcttgctacgtcgtgtactatacacagcgagaggaaggaggagcaagaaaagaaagaaaagagagagagtcgcttcctttcctccaacttattccatggagacctcttctcacaagcgggcgcgggaggcggtcgacctcgccgccgccgccggagaggccgtgtggccggaggccgacgccaagaggctgcggccgcaggacctgctcgacatgctcgacgacgacaccgaagcggcggccgccggcgacctggcgtccgtcatgcggagcctggaggaggagatagccagcttcgacgaggccgcggaggcggcgccgtcgcagcagccggagctggggttcctgctcgaggcctcggacgacgagctggggctgccgccggcgggatccgccgccgccgcctcttcggaggaggccggcctcgccggcccgccggagcccgccgccgcgctctacggccagatctggggcttcgacgacgagatcgacggaggcttcggtggctactcgcccgaggctgccgccgcggccgccgccgccgccgcgtgggacgacgacgtcttcggcgccggcctgttcgcgttcggcgacgacgcgtgcgcgccgtcggatctcgcggcgctgcgccacgagtccatgcccgccgtctgatgacgcgtcccccgtgcgtgcggccgcacccaggggattagcccctatctttttttctcgtttttatttttaccttttggctaacctgaatgtaaagtttcttaggagggttaaaacagagccgtgcaaaacttgggaagacaaaaaaaaaaaaaaaa

SEQ ID NO: 991 - protein, 185 aa, Zea mays
  misc_feature: Ceres CLONE ID no.371815
  misc_feature: Bit score of 358.9 for HMM based on sequences of FIGURE 11.
  misc_feature: Functional Homolog Of Ceres SEEDLINE ID no. ME16630 at SEQ ID NO. 953
METSSHKRAREAVDLAAAAGEAVWPEADAKRLRPQDLLDMLDDDTEAAAAGDLASVMRSLEEEIASFDEAAEAAPSQQPELGFLLEASDDELGLPPAGSAAAASSEEAGLAGPPEPAAALYGQIWGFDDEIDGGFGGYSPEAAAAAAAAAAWDDDVFGAGLFAFGDDACAPSDLAALRHESMPAV

SEQ ID NO: 992 - DNA, 992 bp, Zea mays
  misc_feature: Ceres CLONE ID no.1686460
  misc_feature: Encodes the peptide sequence at SEQ ID NO. 993
agcacaacacctcgctttttgtactcttccgtctttgccctcgcgttatcgcgctcgtctcgcctggcctagctagctgcctgcctgccttggcttgcttgctacgtcgtgtacacagcgagaggaaggacaggagcaagaaaagaaagaagagagagagagagagagagtcgtttcctttcctcgaacttattccatggagacctcttctcacaagcgggcgcgggaggcggtcgatctcgccgccgccgccgccgccgccggagaggccgtgtggccggagtccgacgcaaagaggctgcggccgcaggacctgctcgacatgctcgaggacgacaccgacgcggcggccgccggcgacctggcgtccgtcatgcggagcctggaggaggagatagccagcttcgacgaggccgcggaggcggcgccgtcgcagcagccggagctggggttcctgctcgaggcctcggacgacgagctgggcctgccgccggccggatccgccgccgcctcttcggaggaggccgggctcgccggcccgccggagcccgccgcccccgccgccgccgcgctctacggccagatctgggccttcgacgacgagatcgacggaggcttcggtggctactcgcccgaggctgccgccgccgccgccgccgccgccgcgtgggacgacgacgtcttcggcgccggcctgttcgcgttcggcgacgacgcgtgcgggccctcggatctcgcggcgctgcgccacgagaccatgcccgccgtctgatgacgcgtccccccgtgcgtgcggccgcagacaggggattagcccctatcttttttctcgtttttatgtttacctttggctaacctgaatgtaaagtttcttaggagggttaaaacagagccgtgcaaacttggtaagataagattaggcggaagaatctggaaatggactccctttttttttcaaaaaaaaaaaaaaaaaagaaaaaaaaaaaaaaaaa

SEQ ID NO: 993 - protein, 191 aa, Zea mays
  misc_feature: Ceres CLONE ID no.1686460
  misc_feature: Bit score of 353.0 for HMM based on sequences of FIGURE 11.
  misc_feature: Functional Homolog Of Ceres SEEDLINE ID no. ME16630 at SEQ ID NO. 953
METSSHKRAREAVDLAAAAAAAGEAVWPESDAKRLRPQDLLDMLEDDTDAAAAGDLASVMRSLEEEIASFDEAAEAAPSQQPELGFLLEASDDELGLPPAGSAAASSEEAGLAGPPEPAAPAAAALYGQIWAFDDEIDGGFGGYSPEAAAAAAAAAAWDDDVFGAGLFAFGDDACGPSDLAALRHETMPAV

SEQ ID NO: 994 - DNA, 918 bp, Zea mays
  misc_feature: Ceres CLONE ID no.1448595
  misc_feature: Encodes the peptide sequence at SEQ ID NO. 995
acaacacgcaccgctttttgtactactcttttctctcccatcctgtgcgcccttcgcgtttcgcgcccagagtgctctttgttcacgttcacgttcacgttcacgtccgttgccttgcacccacccacccctcgacaggaaacaagaaagagaaggcagaaaaaaagctcgtctgccggacatggagagctcctcctcgtctctgttgctgagttcgtataccggcggcaacaagagggccagggaggccgaccttgacgtggcctcatccgccgaggcggaggccgccaagaggatacggcccgaggacctgctggacctgctcgacgatgacgccgacgccgcggcggccggcgacctggcctccgtcatgcgaagcctagaggaggagatatgcgccggcgacctggccgcgccgcagccggagctgggcttcctgctcgaggcctcggacgacgagctcggcctgccgccggcggcgggcgcggcgtcctcctcgtcggacgacgccgggggctgggagccggaggagcccgccggcgtgttcggggagcagatctggggcttcgaggacgagattgacggcgcctacgccttcggcggcgtcgcctcatcgccggaggcggcggcggcagccgccgcggccgcggccgagtggggcgacgacggcttcgacgccggcctcttcggcttcggcgacgagtccttcgggccgtccgatctcgccgtgctccgccaggagaccatgccggccgtttgatcagtcgtcgtcagtggacggacggatggatggatggattagccttttcttttttacctttggctaaccttagcgttaccctttttttaacctttggggatgtaaagtttctagatcaaggaaggaagaaaaaactgtgaggaaaaaaaaaaaaaaaa

SEQ ID NO: 995 - protein, 192 aa, Zea mays
  misc_feature: Ceres CLONE ID no.1448595
  misc_feature: Bit score of 357.8 for HMM based on sequences of FIGURE 11.
  misc_feature: Functional Homolog Of Ceres SEEDLINE ID no. ME16630 at SEQ ID NO. 953
MESSSSSLLLSSYTGGNKRAREADLDVASSAEAEAAKRIRPEDLLDLLDDDADAAAAGDLASVMRSLEEEICAGDLAAPQPELGFLLEASDDELGLPPAAGAASSSSDDAGGWEPEEPAGVFGEQIWGFEDEIDGAYAFGGVASSPEAAAAAAAAAAEWGDDGFDAGLFGFGDESFGPSDLAVLRQETMPAV

SEQ ID NO: 996 - DNA, 762 bp, Musa acuminata
  misc_feature: Ceres CLONE ID no.1742945
  misc_feature: Encodes the peptide sequence at SEQ ID NO. 997
gtacaaaaccgccaccgcgcatactcttcccacttgctgttcttgtactttcccactgtaccctccttccatctcggtttgttcggttccccattctatccaccgccaaaatagaagtcctctttctctcttgccatggaggaatccggcgaccacaagaggcgccgcggcgaggaggagggcgacggctccccggagatctcctcgcccgaggccaagcgcctccgcgagaacctcctcctagacgacatcctcgatgacgacgccggcgctggcgccagcgacagcgaccaggacctcgcttccgtcatgaaaagcctcgaggaggagatcgctttcccgtcacctcctcctcctcaaccgcaggccgttgtggcgatggaccagccggatctagggtaccttttcgaggcctcggacgacgagctgggcctgccgccgccgcctcccccggctccgtccatgtccgacgagggcggcgagcccccggaggcggcgatcgccgtggcccccggcgtcgggggtgaggtggatgggatcgggttcggccagatctgggggttcgacgacgaaatcaacggctacggctggctggatgagttcgggatccggccggaggagagtgccgaggccgaggtgaacggggtggtgttcgacggcgggctgttcgactacgccgatctcccctggcgatcggagacgctgcctgccgtctgatggaagcatttcgtcttctttatgaaacgtttaggttgtaaaggt

SEQ ID NO: 997 - protein, 193 aa, Musa acuminata
  misc_feature: Ceres CLONE ID no.1742945
  misc_feature: Bit score of 216.7 for HMM based on sequences of FIGURE 11.
  misc_feature: Functional Homolog Of Ceres SEEDLINE ID no. ME16630 at SEQ ID NO. 953
MEESGDHKRRRGEEEGDGSPEISSPEAKRLRENLLLDDILDDDAGAGASDSDQDLASVMKSLEEEIAFPSPPPPQPQAVVAMDQPDLGYLFEASDDELGLPPPPPPAPSMSDEGGEPPEAAIAVAPGVGGEVDGIGFGQIWGFDDEINGYGWLDEFGIRPEESAEAEVNGVVFDGGLFDYADLPWRSETLPAV

SEQ ID NO: 998 - DNA, 614 bp, Musa acuminata
  misc_feature: Ceres CLONE ID no.1734477
  misc_feature: Encodes the peptide sequence at SEQ ID NO. 999
accgtgcgctcatcggtgtctgcttactgctcttttccatcttctccgcttcccgttctgagttttccgatggaggattcgcgcgaccgcaagaggcgccgcgacgaggcggaagagcaggagtcgccggaggccaagcgcctccgagacgacctcttcctcgacatcctcgacgatgacgctgaagccggagaccaggacatcgcctccgtcatgaagagcctcgaggaggagatcgccctctcctccccaccgccgccgccgcccacccgggcattggtgaagaccgaccagccggatctgggattcctcctcgaagcctccgatgacgagctcggactgcctccgccggtgctgtcctcgtcggacgatggtggtgaggctcctgcggctgacgacccggccgcggaaggagtcgcggtggagggggtcgtgttcgggcagatctgggggttggacgacgatatcaccggctactacgacgggttcgacttggggattgggccggatgatagggtggataccacacatgcggccgaggatggggtgttctacgacggagggctgttcgactatgccgacgtgctctgtgcgccgcccgattttctggatct

SEQ ID NO: 999 - protein, 181 aa, Musa acuminata
  misc_feature: Ceres CLONE ID no.1734477
  misc_feature: Bit score of 352.9 for HMM based on sequences of FIGURE 11.
  misc_feature: Functional Homolog Of Ceres SEEDLINE ID no. ME16630 at SEQ ID NO. 953
MEDSRDRKRRRDEAEEQESPEAKRLRDDLFLDILDDDAEAGDQDIASVMKSLEEEIALSSPPPPPPTRALVKTDQPDLGFLLEASDDELGLPPPVLSSSDDGGEAPAADDPAAEGVAVEGVVFGQIWGLDDDITGYYDGFDLGIGPDDRVDTTHAAEDGVFYDGGLFDYADVLCAPPDFLD

SEQ ID NO: 1000 - DNA, 783 bp, Musa acuminata
  misc_feature: Ceres CLONE ID no.1742053
  misc_feature: Encodes the peptide sequence at SEQ ID NO. 1001
  misc_feature (763)..(763): n is a, c, t, g, unknown, or other
attcacatgcttactcacgcttccgtgctcctgttttgagttttgaccttcttcctactcggcccccttatcattttctttcccattttgcccatcgacaacctgaaatgtcttctccacccccatgccttcctcctgtagaggccttcgccgatcggaagagacgccgcgacgagatggtggagatagaggaggagggggagtcgccggagatctcctctcccgaggccaagcgcctcctcctcgacatcctcgacgatgacgccgaagccggagaccaggacctcgcctccgtcatgaagagcctcgaggaggagatcgccctcccctcgccgcctccgcaaccgcagctgctccctctggccgcggtggaccagcccgacctagggttcctcttcgaggcctccgacgacgagctcggcctgccgccccaggccgacgagcgctgcgaggcacccgagccggaggtcgccgaggagagcgccgggtttggccagatctgggggttcgacgacggcgacctgtgcggatacgaagggttcgagttcggtatccggccggacgagcgggcggaggcggacgacggggtggtgttcgacggcgggctgtttgattacgccgacgtggtgccctgcgggccgtccgatttcgcggatctatcgtggcggccggagacgctcccggccgtctgatgacagtccggacgcttttgttcttcctttcttaaaaacccccccttcttcaatttttcttttgttctttnccttctcttttgaagagcgg

SEQ ID NO: 1001 - protein, 194 aa, Musa acuminata
  misc_feature: Ceres CLONE ID no.1742053
  misc_feature: Bit score of 222.1 for HMM based on sequences of FIGURE 11.
  misc_feature: Functional Homolog Of Ceres SEEDLINE ID no. ME16630 at SEQ ID NO. 953
MSSPPPCLPPVEAFADRKRRRDEMVEIEEEGESPEISSPEAKRLLLDILDDDAEAGDQDLASVMKSLEEEIALPSPPPQPQLLPLAAVDQPDLGFLFEASDDELGLPPQADERCEAPEPEVAEESAGFGQIWGFDDGDLCGYEGFEFGIRPDERAEADDGVVFDGGLFDYADVVPCGPSDFADLSWRPETLPAV

SEQ ID NO: 1002 - DNA, 814 bp, Musa acuminata
  misc_feature: Ceres CLONE ID no.1728365
  misc_feature: Encodes the peptide sequence at SEQ ID NO. 1003
attcacatgcttactcacgcttccgtgctcctgttttgagttttgaccttcttcctactcggcccccttatcattttctttcccattttgcccatcgacaacctgaaatgtcttctccacccccatgccttcctcctgtagaggccttcgccgatcggaagagacgccgcgacgagatggtggagatagaggaggagggagagtcgccggagatctcctctcccgaggccaagcgcctcctcctcgacatcctcgacgatgacgccgatgccggagaccaggacctcgcctccgtcatgaagagcctcgaggaggagatcgccctcccctcgccgcctccgcaaccgcagctgctccctctggccgcggtggaccagcccgacctagggttcctcttcgaggcctccgacgacgagctcggcctgccgccccaggccgacgagcgctgcgaggcacccgagccggaggtcgccgaggagagcgccgggtttggccagatctgggggttcgacgacggcgacctgtgcggatacgaagggttcgagttcggtatccggccggacgagcgggcggaggcggacgacggggtggtgttcgacggcgggctgtttgattacgccgacgtggtgccctgcgggccgtccgatttcgcggatctatcgtggcggccggagacgctcccggccgtctgatgacagtccggacgcttttgttcttccttctttaaaaccccccccttcttcaacttttcttctgtttttgtccttctcttctgcggagctgcacgcggtcggtgtcaaggttaaaaaaaaag

SEQ ID NO: 1003 - protein, 194 aa, Musa acuminata
  misc_feature: Ceres CLONE ID no.1728365
  misc_feature: Bit score of 220.6 for HMM based on sequences of FIGURE 11.
  misc_feature: Functional Homolog Of Ceres SEEDLINE ID no. ME16630 at SEQ ID NO. 953
MSSPPPCLPPVEAFADRKRRRDEMVEIEEEGESPEISSPEAKRLLLDILDDDADAGDQDLASVMKSLEEEIALPSPPPQPQLLPLAAVDQPDLGFLFEASDDELGLPPQADERCEAPEPEVAEESAGFGQIWGFDDGDLCGYEGFEFGIRPDERAEADDGVVFDGGLFDYADVVPCGPSDFADLSWRPETLPAV

SEQ ID NO: 1004 - DNA, 928 bp, Parthenium argentatum
  misc_feature: Ceres CLONE ID no.1605693
  misc_feature: Encodes the peptide sequence at SEQ ID NO. 1005
acaaacaccctttgtctcctcttaaaacatttctttattcccaaaacacttttcgaattaatggaatcactgagttccaaaaaacgagtccgtaactcggacgagtccgtcgttgactcagtagaagccaaaagaatactcctcgacatcctggacgactcggacgtatgcactccgagtcacgaccttgactcgttcatgaaaaccttccaagacgaaatatccccttctccggcgccggagtttaccggaataagttcaacgtccggcgaacggccggagctagggtttctgttcgaagcgtcagatgacgaactgggtctacctccaaccgaaacaaatgaacgagttttggctgagtcggttggactcagtgagttgtgggggttagatgacgagtttataaagtatgactcgttcgagtctgggtttgtttatgacggtgataataatattaataacggtgaatacgtggcgttagatgggttatttgattatacagatgtgggttttgggtcgtcggatctgacgtggcggccggaaacgttgccggcgcagtgatatgttgttttcccggttaaccccgttgggatattgtaaattttattttattttattttatttttaattatgttcgaaaagaaatgttggaaatatatatacacgtagattaacgctgactgactaacggcgtttaatgaaccaacgaagggtattaaattattgatacatattttatacgagtattaactgtgtttgaagtttgaaaattacccgtgagtttcgtttgggttttggaagaaagtattaaatacaaagtctgagggacgattgttggaactagtttaaagtggggggacaattgttctgatgttttgttgatataatacagaactttatctttaatgaaaaaaaaaaaaaaaaaaaa

SEQ ID NO: 1005 - protein, 166 aa, Parthenium argentatum
  misc_feature: Ceres CLONE ID no.1605693
  misc_feature: Bit score of 329.2 for HMM based on sequences of FIGURE 11.
  misc_feature: Functional Homolog Of Ceres SEEDLINE ID no. ME16630 at SEQ ID NO. 953
MESLSSKKRVRNSDESVVDSVEAKRILLDILDDSDVCTPSHDLDSFMKTFQDEISPSPAPEFTGISSTSGERPELGFLFEASDDELGLPPTETNERVLAESVGLSELWGLDDEFIKYDSFESGFVYDGDNNINNGEYVALDGLFDYTDVGFGSSDLTWRPETLPAQ

SEQ ID NO: 1006 - DNA, 873 bp, Parthenium argentatum
  misc_feature: Ceres CLONE ID no.1609807
  misc_feature: Encodes the peptide sequence at SEQ ID NO. 1007
acccaccgctgtcccccactctgatataacaaaatacccaaaccacccctgcacataactctcgttaaaaatggaatcgttgagttctataaagcgagtccgttccgactcggacgagtccgagttagactcgcctgagtcgaagcgaatccaactcgaccttcttgaaaacctagacgactcggacgagtttccggccggtcacgaccttgactcgttcataaaaagcttcgaagacgaaatatctccaccggaggccgtcgagttagcctccgattccggcgagtctcgaccggacctcgagtttctactcgaggcatcggatgacgaactcggactacctcctactgagtcagaaacggtgcctgtttccaccgagtcggttgaactcggtgtgttttccttgttagatgaccagatctcgaactatgactcgtttgagtacggatttgattacgtagacggtgatgaacgttatgttagtgctaacgttaacggtaacagtaacggagaatatgtggcgttagacggactgtttgatcatgcagatctaggttttggacggacggaatcgttgccggctcagtgatgagatgattttattagttattgtaaagttttttaattttttttataaaaaaatagagaggaaggagataaggatagaacgtcatacctcagatgctgttgatttttttttttttttttttaatttcaagcgagtgctttgaaatgtttttgaggatgaacttgactttagtggtaggtaatagtgacgtggatggctaagtttacattatttttttttaagtttactgtagtattaacttttaatcatgttaaaattataatcaaaaaaaaaaaaaaaaaaaa

SEQ ID NO: 1007 - protein, 172 aa, Parthenium argentatum
  misc_feature: Ceres CLONE ID no.1609807
  misc_feature: Bit score of 187.6 for HMM based on sequences of FIGURE 11.
  misc_feature: Functional Homolog Of Ceres SEEDLINE ID no. ME16630 at SEQ ID NO. 953
MESLSSIKRVRSDSDESELDSPESKRIQLDLLENLDDSDEFPAGHDLDSFIKSFEDEISPPEAVELASDSGESRPDLEFLLEASDDELGLPPTESETVPVSTESVELGVFSLLDDQISNYDSFEYGFDYVDGDERYVSANVNGNSNGEYVALDGLFDHADLGFGRTESLPAQ

SEQ ID NO: 1008 - DNA, 1363 bp, Panicum virgatum
  misc_feature: Ceres CLONE ID no.1757400
  misc_feature: Encodes the peptide sequence at SEQ ID NO. 1009
aaaaaaaacacctcgcttttgtactcttccgtctttgccctcgcgctctcgcctcgcccccgttcgctcggccggcgcgtgtacgtgcgtacagcgagcggagaagggaaaagagagagagagagagagagagaaaagaaaagagtcttgcggcccttgccttgccttgggttgagctcattcgctgttcgttcatggagagctcctcccacaagcgggcgcgggaggcggccgacctcgccgccgccggcgacggcgcgctgccggagaagaggctgcggcccgaggacctgctcgacctgctcgacgatgacgccgacgcggccgccgccggcgacctggcgtccgtcatgcggagcctcgaggaggagttagggagcttcgacgaggccggggcccccgacgccgccgccgcgccgccggcgcaccagccggagctggggttcctgctcgaggcctcggacgacgagctggggctgccgcctgcgggcgcctcctcgtcggaggaggaggccgtggccgccggggcgccggacgtggccgccgggctcgacggccagatctgggggttcgaggacgagatcgacggcggcttcggcggctactcgccggaggcggccgccgccgccgcggcggcggcggcgtgggacgacgacggcttcgacgctgggctgttcgcgttcggggacgacgcctgcggggcctcggatctcgcggccctgcgccacgagaccatgccggccgtctgatgacgggccccggccggctagccagtggattagcgttccttttctttttcttgcttttttttacctttggctaaccttagctggaactaccctctttttttaaccttggtgtaaagtttttagaagggtaaaaacagaggcgtggaaacctggggaaggttccgaccggggaaaagaatctgaaaatggtttccctttttgcccttgggaattattttctcgcttattataaatgaaaaacggaagaagaaataagctagcataagctagcgagtagtaaaaaaacagcagtgaagtcaattgaaagatgccgacacgttagtggcttgggtggaggggatcaacatgacatgtggctgctggaaggacgctgaccaactgatgtgacagactccaaatctcagaaaagatctgtgattaattgtggacggagaaaatggacggcaaattatttcaagaaaatggacgggaatgcttggaactgtctgtccttcattcaagttggataatccatgaattttataatttttctctatagaatatagatatattgtactgcaaataactttattctgatggagtcattgagaggataaaaaaaaaaaaaaaaaaaa

SEQ ID NO: 1009 - protein, 184 aa, Panicum virgatum
  misc_feature: Ceres CLONE ID no.1757400
  misc_feature: Bit score of 357.8 for HMM based on sequences of FIGURE 11.
  misc_feature: Functional Homolog Of Ceres SEEDLINE ID no. ME16630 at SEQ ID NO. 953
MESSSHKRAREAADLAAAGDGALPEKRLRPEDLLDLLDDDADAAAAGDLASVMRSLEEELGSFDEAGAPDAAAAPPAHQPELGFLLEASDDELGLPPAGASSSEEEAVAAGAPDVAAGLDGQIWGFEDEIDGGFGGYSPEAAAAAAAAAAWDDDGFDAGLFAFGDDACGASDLAALRHETMPAV

SEQ ID NO: 1010 - DNA, 730 bp, Panicum virgatum
  misc_feature: Ceres CLONE ID no.1778566
  misc_feature: Encodes the peptide sequence at SEQ ID NO. 1011
gcgcaaaacacctcgctttttgtactcttccgtctttgccctcgcgctctcgcctcgcccccgttcgctcggccggcgcgtgtacgtgcgtacagcgagcggagaagggaaaagaaagagagagagagagagaaaaaagaaaagagtcttgcggcccttgccttgccttgggttgagctcattcgctgttcgttcatggagagctcctcctcccacaagcgggcgcgggaggcggccgacctcgccgccgccggcgacggcgcgctgccggagaagaggctgaggcccgaggacctgctcgacctgctcgacgatgacgccgacgcggccgccgccgacgacctggcgtccgtcatgcggagcctcgaggaggagttagggagcttcgacgaggccggggcccccgacgccgccgccgcgccgccggcgcaccagccggagctggggttcctgctcgaggcctcggacgacgagctggggctgccgcctgcgggcgcctcctcgtcgtcggaggaagccgtggccgccggggcgccggacgtggccgccgggctcgacggccagatctgggggttcgaggacgagatcgacggcggcttcggcggctactcgccggaggcggccgccgccgccgcggcggcggcggcgtggaacgacgacggcttcgacgctgggctgttcgcgttcggggacgacgcctgcggggcctcggatctcgcgggcctgcgcc

SEQ ID NO: 1011 - protein, 178 aa, Panicum virgatum
  misc_feature: Ceres CLONE ID no.1778566
  misc_feature: Bit score of 317.2 for HMM based on sequences of FIGURE 11.
  misc_feature: Functional Homolog Of Ceres SEEDLINE ID no. ME16630 at SEQ ID NO. 953
MESSSSHKRAREAADLAAAGDGALPEKRLRPEDLLDLLDDDADAAAADDLASVMRSLEEELGSFDEAGAPDAAAAPPAHQPELGFLLEASDDELGLPPAGASSSSEEAVAAGAPDVAAGLDGQIWGFEDEIDGGFGGYSPEAAAAAAAAAAWNDDGFDAGLFAFGDDACGASDLAGLR

SEQ ID NO: 1012 - DNA, 724 bp, Panicum virgatum
  misc_feature: Ceres CLONE ID no.2020580
  misc_feature: Encodes the peptide sequence at SEQ ID NO. 1013
gcgcaaatcacctcgctttttgtactcttccgtctttgccctcgcgctctcgcctcgccccgccccgccccgcccccgttcgctcggccggcgcgtgtacgtgcgtacagcgagcggagaagggaaaagaaagagagagagagaaaacaaaagaaaagagtcttgcggctcttgccttgccttgggttgagctcattcgctgttcgttcatggagagctcctcctcctcccacaagcgggcgcgggaggcggccgacctcgccgccgccggcgacggcgcgctgccggagaagaggatgcggcccgaggacctgctcgacctgctcgacgatgacgccgacgcggccgccgccggcgacctggcgtccgtcatgcggagcctcgaggaggagttagggagcttcgacgaggccggggcccccgacaccaccgccgcgccgccggcgcaccagccggagctggggttcctgctcgaggcctcggacgacgagctggggctgccgccggcgggcgcctcctcgtcgtcggaggaggccggcgccgccggggcgccggacgtggccgccgggctcgacggccagatctgggggttcgaggacgagatcgacggcggcttcggcggctactcgccggaggcggccgccgccgccgcggcggcggcggcgtgggacgacgacggcttcgacgccgggctgttcgcgttcggggacgacgcctgcggggc

SEQ ID NO: 1013 - protein, 171 aa, Panicum virgatum
  misc_feature: Ceres CLONE ID no.2020580
  misc_feature: Bit score of 308.0 for HMM based on sequences of FIGURE 11.
  misc_feature: Functional Homolog Of Ceres SEEDLINE ID no. ME16630 at SEQ ID NO. 953
MESSSSSHKRAREAADLAAAGDGALPEKRMRPEDLLDLLDDDADAAAAGDLASVMRSLEEELGSFDEAGAPDTTAAPPAHQPELGFLLEASDDELGLPPAGASSSSEEAGAAGAPDVAAGLDGQIWGFEDEIDGGFGGYSPEAAAAAAAAAAWDDDGFDAGLFAFGDDACG

SEQ ID NO: 1014 - protein, 174 aa, Oryza sativa subsp. indica
  misc_feature: Public GI ID no.125524285
  misc_feature: Bit score of 339.6 for HMM based on sequences of FIGURE 11.
  misc_feature: Functional Homolog Of Ceres SEEDLINE ID no. ME16630 at SEQ ID NO. 953
MDSSNNNNNKRARDAEDEADEAKRLRAEDLLDMLDDDTDAGGAAGDLASVMRSFEEEIVAGDVAGDVAPTTQPELGFLLEASDDELGLPPATASSSEEEAGAGEPEDAIGFGGQIWGFEDEIGGGGYAGFALTSPEAVAAAAAAAEWDDDGFDAGLFGFGDEVSALRHETMPAV

SEQ ID NO: 1015 - protein, 175 aa, Oryza sativa subsp. japonica
  misc_feature: Public GI ID no.115434334
  misc_feature: Bit score of 340.2 for HMM based on sequences of FIGURE 11.
  misc_feature: Functional Homolog Of Ceres SEEDLINE ID no. ME16630 at SEQ ID NO. 953
MDSSNNNNNNKRARDAEDEADEAKRLRAEDLLDMLDDDTDAGGAAGDLASVMRSFEEEIVAGDVAGDVAPTTQPELGFLLEASDDELGLPPATASSSEEEAGAGEPEDAIGFGGQIWGFEDEIGGGGYAGFALTSPEAVAAAAAAAEWDDDGFDAGLFGFGDEVSALRHETMPAV

SEQ ID NO: 1016 - protein, 168 aa, Oryza sativa subsp. japonica
  misc_feature: Public GI ID no.125568898
  misc_feature: Bit score of 232.2 for HMM based on sequences of FIGURE 11.
  misc_feature: Functional Homolog Of Ceres SEEDLINE ID no. ME16630 at SEQ ID NO. 953
MDSSNNNNNNKRARDAEDEADEAKRLRAEDLLDMLDDDTDAGGAAGDLASVMRSFEEEIVAGDVAGDVAPTTQPELGFLLEASDDELGLPPATASSSEEEAGAGEPEDAIGFGGQIWGFEDEIGGGGYAGFALTSPEAVCRRLEVNGNAGEEFTKLPWNHPFFTTPNL

SEQ ID NO: 1017 - DNA, 609 bp, Sorghum bicolor
  misc_feature: Ceres ANNOT ID no.6055303
  misc_feature: Encodes the peptide sequence at SEQ ID NO. 1018
atggagagctcttctcacaagcgggcgcgggaggtggtggacctcaccgccgccgggcccggagaggcagccgcgttgccggaggcggacgcgaagaggctgcggccgcaggatctcctggacatgctcgatgacgacaccgacgcggccgccgccggcgacctagcgtccgtcatgaggagcctggaggaggagatagctagcttcgacgaggccgtgggggccgcggaagcggcgcctacgcagcagcagcagcagccggagctggggttcctgctggaggcctcggacgacgagctggggctgccaccggctggcgcctccgcctcgtcgtcggaggaggccggcggcggcggcgggggcctcgccggggcgccgccggagtccgccgagctggacggcggccagatctggggcttcgaggacgagatagacggtggagcgggcttcggtggctactcgccggaggcggccgccgcggccgtcgccgccgcggcggcgtgggacgacgacggcttcgacgccggcctgttcgcgttcggcgaaagcgacgcgtacgggccgtcggatctcgccgcgctgcgccacgagaccatgccggccgtctga

SEQ ID NO: 1018 - protein, 202 aa, Sorghum bicolor
  misc_feature: Ceres ANNOT ID no.6055303
  misc_feature: Bit score of 318.1 for HMM based on sequences of FIGURE 11.
  misc_feature: Functional Homolog Of Ceres SEEDLINE ID no. ME16630 at SEQ ID NO. 953
MESSSHKRAREVVDLTAAGPGEAAALPEADAKRLRPQDLLDMLDDDTDAAAAGDLASVMRSLEEEIASFDEAVGAAEAAPTQQQQQPELGFLLEASDDELGLPPAGASASSSEEAGGGGGGLAGAPPESAELDGGQIWGFEDEIDGGAGFGGYSPEAAAAAVAAAAAWDDDGFDAGLFAFGESDAYGPSDLAALRHETMPAV

SEQ ID NO: 1019 - DNA, 1489 bp, Arabidopsis thaliana
  misc_feature: Ceres SEEDLINE ID no.ME17128
  misc_feature: Genomic Sequence
  misc_feature: Expected Sequence
  misc_feature: Encodes the peptide sequence at SEQ ID NO. 1024
atgtcgcgcgttctcacttgcccaccgcttgtgtttgcaagaaaccacgttggcgttcaaaacttggtcgaatcgactaaggttcgttgagctacagatctggtttcttgcttcagttttttttgtgtgattgatttctacggatttcgtaaaacctgattttggattcgtttttggggaaacttatttcaatgtagtaatctttgaatttgggttacacttcttgtgggtatggctatattttcataagtcgtatttttttctctctgaaaccctatcatgtataaatctatataagctaattatcatgtgattatcattaacactatataaagagttgcatattagttttcaataatctcatcatgtgttcactgtatcagcaatcattaggagtgaatcaggtaagttgcattgttttccattctgttagtttgattttgtaggtctagatatgtatatgattaagtttgtaggagcttctttgtttattgtaatggtttttgcacattgagtgggatggttgaactgtggttctgaaagacgtggagtctaaaaccctttactctaatggattaaagcttaaaagaatcacacttgattcaaaaaaggcgcaccggatagagaagaaggaaaagaaggagaagagaaaagaaaagaaagaaactaagcgtgagaaatcgcataaacattcgattaaagcaactgataatcatcacaagctaatatttcttccttccaagaaagtgtcagatgagtctgactcactagagaagagtggtttgacagatgagcttgaggaacctcaaaaacaccttggatatttgtctgatggaagtcagaatagtaagaagaggattagagatgattctcctccggctgttgaaagtctcatcaaaggtttgtatctatttcttagtagacattcaagaagaagatcatgttgatatctgcttttaggttatttacatgtttattttcacatgtatttgcagctgcacctgtagcaggtaaacctctacggattagaatggtcttcaaaaaaccaaaggaggaagttcctactctgcctagagaggctgttgtttgctccactacagttgcaaagtcgctcagtcaccaagatgtcataacaagttctatctcaagttcaaaaacatccgagcttgaaaagaatctgccgtcaacatcaatagcggcaatagatgaaacaaagaagagaaagaaacacagatctagcaaagaagatcaatacaatgcattgtttgatggttggactcctccttccatgtgtattgctgatgcatcttcaaatgacaatggtgattattggctatttgggaacaagacgcaagaggtgcttaagcccaaagcagcagtcaaggttgatgatgacacgatgatgagaccgggagattcatcttggcctagagctcaatttttgtctgaagttgggatttattctttaccttatactgtcccgttctaa

SEQ ID NO: 1020 - DNA, 894 bp, Arabidopsis thaliana
  misc_feature: Ceres SEEDLINE ID no.ME17128
  misc_feature: Predicted Sequence
  misc_feature: Encodes the peptide sequence at SEQ ID NO. 1024
atgtcgcgcgttctcacttgcccaccgcttgtgtttgcaagaaaccacgttggcgttcaaaacttggtcgaatcgactaagcttaaaagaatcacacttgattcaaaaaaggcgcaccggatagagaagaaggaaaagaaggagaagagaaaagaaaagaaagaaactaagcgtgagaaatcgcataaacattcgattaaagcaactgataatcatcacaagctaatatttcttccttccaagaaagtgtcagatgagtctgactcactagagaagagtggtttgacagatgagcttgaggaacctcaaaaacaccttggatatttgtctgatggaagtcagaatagtaagaagaggattagagatgattctcctccggctgttgaaagtctcatcaaagctgcacctgtagcaggtaaacctctacggattagaatggtcttcaaaaaaccaaaggaggaagttcctactctgcctagagaggctgttgtttgctccactacagttgcaaagtcgctcagtcaccaagatgtcataacaagttctatctcaagttcaaaaacatccgagcttgaaaagaatctgccgtcaacatcaatagcggcaatagatgaaacaaagaagagaaagaaacacagatctagcaaagaagatcaatacaatgcattgtttgatggttggactcctccttccatgtgtattgctgatgcatcttcaaatgacaatggtgattattggctatttgggaacaagacgcaagaggtgcttaagcccaaagcagcagtcaaggttgatgatgacacgatgatgagaccgggagattcatcttggcctagagctcaatttttgtctgaagttgggatttattctttaccttatactgtcccgttctaa

SEQ ID NO: 1021 - DNA, 1124 bp, Arabidopsis thaliana
  misc_feature: Ceres SEEDLINE ID no.ME17128
  misc_feature: Genomic Sequence
  misc_feature: Expected Sequence
  misc_feature: Encodes the peptide sequence at SEQ ID NO. 1024
atgtgttcactgtatcagcaatcattaggagtgaatcaggtaagttgcattgttttccattctgttagtttgattttgtaggtctagatatgtatatgattaagtttgtaggagcttctttgtttattgtaatggtttttgcacattgagtgggatggttgaactgtggttctgaaagacgtggagtctaaaaccctttactctaatggattaaagcttaaaagaatcacacttgattcaaaaaaggcgcaccggatagagaagaaggaaaagaaggagaagagaaaagaaaagaaagaaactaagcgtgagaaatcgcataaacattcgattaaagcaactgataatcatcacaagctaatatttcttccttccaagaaagtgtcagatgagtctgactcactagagaagagtggtttgacagatgagcttgaggaacctcaaaaacaccttggatatttgtctgatggaagtcagaatagtaagaagaggattagagatgattctcctccggctgttgaaagtctcatcaaaggtttgtatctatttcttagtagacattcaagaagaagatcatgttgatatctgcttttaggttatttacatgtttattttcacatgtatttgcagctgcacctgtagcaggtaaacctctacggattagaatggtcttcaaaaaaccaaaggaggaagttcctactctgcctagagaggctgttgtttgctccactacagttgcaaagtcgctcagtcaccaagatgtcataacaagttctatctcaagttcaaaaacatccgagcttgaaaagaatctgccgtcaacatcaatagcggcaatagatgaaacaaagaagagaaagaaacacagatctagcaaagaagatcaatacaatgcattgtttgatggttggactcctccttccatgtgtattgctgatgcatcttcaaatgacaatggtgattattggctatttgggaacaagacgcaagaggtgcttaagcccaaagcagcagtcaaggttgatgatgacacgatgatgagaccgggagattcatcttggcctagagctcaatttttgtctgaagttgggatttattctttaccttatactgtcccgttctaa

SEQ ID NO: 1022 - DNA, 852 bp, Arabidopsis thaliana
  misc_feature: Ceres SEEDLINE ID no.ME17128
  misc_feature: Predicted Sequence
  misc_feature: Encodes the peptide sequence at SEQ ID NO. 1024
atgtgttcactgtatcagcaatcattaggagtgaatcagcttaaaagaatcacacttgattcaaaaaaggcgcaccggatagagaagaaggaaaagaaggagaagagaaaagaaaagaaagaaactaagcgtgagaaatcgcataaacattcgattaaagcaactgataatcatcacaagctaatatttcttccttccaagaaagtgtcagatgagtctgactcactagagaagagtggtttgacagatgagcttgaggaacctcaaaaacaccttggatatttgtctgatggaagtcagaatagtaagaagaggattagagatgattctcctccggctgttgaaagtctcatcaaagctgcacctgtagcaggtaaacctctacggattagaatggtcttcaaaaaaccaaaggaggaagttcctactctgcctagagaggctgttgtttgctccactacagttgcaaagtcgctcagtcaccaagatgtcataacaagttctatctcaagttcaaaaacatccgagcttgaaaagaatctgccgtcaacatcaatagcggcaatagatgaaacaaagaagagaaagaaacacagatctagcaaagaagatcaatacaatgcattgtttgatggttggactcctccttccatgtgtattgctgatgcatcttcaaatgacaatggtgattattggctatttgggaacaagacgcaagaggtgcttaagcccaaagcagcagtcaaggttgatgatgacacgatgatgagaccgggagattcatcttggcctagagctcaatttttgtctgaagttgggatttattctttaccttatactgtcccgttctaa

SEQ ID NO: 1023 - DNA, 1489 bp, Arabidopsis thaliana; identical to SEQ ID NO: 1019
  misc_feature: Ceres SEEDLINE ID no.ME17128
  misc_feature: Inplanta Sequence
  misc_feature: Encodes the peptide sequence at SEQ ID NO. 1024

SEQ ID NO: 1024 - protein, 297 aa, Arabidopsis thaliana
  misc_feature: Ceres SEEDLINE ID no.ME17128
  misc_feature: Bit score of 521.8 for HMM based on sequences of FIGURE 12.
MSRVLTCPPLVFARNHVGVQNLVESTKLKRITLDSKKAHRIEKKEKKEKRKEKKETKREKSHKHSIKATDNHHKLIFLPSKKVSDESDSLEKSGLTDELEEPQKHLGYLSDGSQNSKKRIRDDSPPAVESLIKAAPVAGKPLRIRMVFKKPKEEVPTLPREAVVCSTTVAKSLSHQDVITSSISSSKTSELEKNLPSTSIAAIDETKKRKKHRSSKEDQYNALFDGWTPPSMCIADASSNDNGDYWLFGNKTQEVLKPKAAVKVDDDTMMRPGDSSWPRAQFLSEVGIYSLPYTVPF

SEQ ID NO: 1025 - protein, 283 aa, Arabidopsis thaliana
  misc_feature: Ceres SEEDLINE ID no.ME17128
  misc_feature: Ceres LOCUS ID no.At1g75860
  misc_feature: Ceres ANNOT ID no.838490
  misc_feature: Bit score of 521.8 for HMM based on sequences of FIGURE 12.
  misc_feature: Functional Homolog Of Ceres SEEDLINE ID no. ME17128 at SEQ ID NO. 1024
MCSLYQQSLGVNQLKRITLDSKKAHRIEKKEKKEKRKEKKETKREKSHKHSIKATDNHHKLIFLPSKKVSDESDSLEKSGLTDELEEPQKHLGYLSDGSQNSKKRIRDDSPPAVESLIKAAPVAGKPLRIRMVFKKPKEEVPTLPREAVVCSTTVAKSLSHQDVITSSISSSKTSELEKNLPSTSIAAIDETKKRKKHRSSKEDQYNALFDGWTPPSMCIADASSNDNGDYWLFGNKTQEVLKPKAAVKVDDDTMMRPGDSSWPRAQFLSEVGIYSLPYTVPF

SEQ ID NO: 1026 - DNA, 1389 bp, Populus balsamifera subsp. trichocarpa
  misc_feature: Ceres ANNOT ID no.1442522
  misc_feature: Encodes the peptide sequence at SEQ ID NO. 1027
atgtctcggtgcttcccttacccgcctccgggctactaccggatcgagtcgattaagatccaaaaggaaaaggagctttctgtaacagaaagctatagagaggcaaagaaggagaagaaaggaaggaggcagaggaaagaaaacagtaaccaaactggttattacgggggtaagtctcagcaagaggggaaaggaaggcttccaaaggaaaaaagggaagaagctgaaaagagtggtcttactgaagaacacaatgagcccgtatgccttcaaaatgtttgctatttgtctgatgatggcattcggagcaacaagaggaggaaactggactcctcaacaactactgatgacaaacctcgcaatgtctttcgcattcggctgcccttgacaaggcataaagagccagatgtgtctctcaatagtaaagggttgtgctctacttcgggtggggcagattctgtttctgggcagagtgaaattgtccgtttatctgatcaagaaactgtcaactcaaaggctggggaacttgcatctccaccagaaaatataccttgcagttcagtttcagataagttggagagctctgtttccgaaacttcttggttcagatttcatgatcgcaagacgttgaaagctgactcacaatacaaaggtttagttgaggattgggttccaccacctcttcagtttgagcttaaagattctgacgatgaagagtggctttttgggaccttaaagcaagaaaggcatggaaacaagagactaaacgcacgccatgatatctcgtgtcgtgaaagttctactctgtggccacgagcacattacttgcccgagtctgatgtttacgctttaccgtttagagcagccaagtggatgttacccgctcagaatctccaaagggagagtgtcgaaacggaaaagcgtaaagggagagaaggacaggagaaaaagctgaaaagagcgatcttactgaggaagacaagcagcctgtgtcttctcagagcctttgctacttgtctgatggtgggaaatctcatgctggcattgagaaggcatagagggcctgatgcgtctgttgatggggaaggggtagggttgctctctactatgggaaagcggattctttctcaggagcatcaaattattgaaacttcttcggggtctagaatgtatgatgataagaggcggaaagcagaatcactttaccaaggtttgattgcgaatttaaaggaatttttttttcattttgagctaaacaatcctgattttgggacacaacaaagcaagaaacatgggtgccaaagattgaaagtttgccgtgatgtctcatgtcatgctgaatctacgtcaatgctgcgttcacagtacctgcccgaggctgatgtttag

SEQ ID NO: 1027 - protein, 462 aa, Populus balsamifera subsp. trichocarpa
  misc_feature: Ceres ANNOT ID no.1442522
  misc_feature: Bit score of 346.9 for HMM based on sequences of FIGURE 12.
  misc_feature: Functional Homolog Of Ceres SEEDLINE ID no. ME17128 at SEQ ID NO. 1024
MSRCFPYPPPGYYRIESIKIQKEKELSVTESYREAKKEKKGRRQRKENSNQTGYYGGKSQQEGKGRLPKEKREEAEKSGLTEEHNEPVCLQNVCYLSDDGIRSNKRRKLDSSTTTDDKPRNVFRIRLPLTRHKEPDVSLNSKGLCSTSGGADSVSGQSEIVRLSDQETVNSKAGELASPPENIPCSSVSDKLESSVSETSWFRFHDRKTLKADSQYKGLVEDWVPPPLQFELKDSDDEEWLFGTLKQERHGNKRLNARHDISCRESSTLWPRAHYLPESDVYALPFRAAKWMLPAQNLQRESVETEKRKGREGQEKKLKRAILLRKTSSLCLLRAFATCLMVGNLMLALRRHRGPDASVDGEGVGLLSTMGKRILSQEHQIIETSSGSRMYDDKRRKAESLYQGLIANLKEFFFHFELNNPDFGTQQSKKHGCQRLKVCRDVSCHAESTSMLRSQYLPEADV

SEQ ID NO: 1028 - DNA, 882 bp, Populus balsamifera subsp. trichocarpa
  misc_feature: Ceres ANNOT ID no.1452905
  misc_feature: Encodes the peptide sequence at SEQ ID NO. 1029
atgtctcggtgctttccttacccgcctccgggctaccagatcgagtcgatcaagatccgaaaggaaaaggagaagtctataacagaaagccataaagatataaagaaggagaagaaagaaagaaggaagcataggaaagaaaacaaggaccaaatatgttatactgtgggtaagtctcatcaaaaggggaaaaccttccttccaagggaaaaaaaggaagaagctgaaaagagtgatcttactgaagaacacaatgagcccgtatgccttcagaatatttgctatttgtctgatgatggcattcggagcaacaagaagaggaaattggaacaagcaactaatgatgacaaaccccgtaatgtcttccgcattaggttacccttgacaaggcataaagagccagatgtgcctctcaatagtgaagggttgtgttctacttcgggaagggcagattctgtttctgggcagaatgaaggtgtccatttatcccatcaagaaactgtcaattcaaaggcaggtactgttgtcggggaacttgcatctccagaaaaaatgccttgcatttcagtttcagagaagaagagcactgtttgccatgaatctgggatttctcggttcaaattgcccaataagaagatgcggaaagcagactcaccatacaaagtcttaattgaggattgggtttcaccacctcctcagtttgagcttaatgattctgatgatcaagaatggctttctgaggcctcaaagcgagaaaggcatgggaacaagatactaaatgcttgccgtgatgtcttgtgtcacgaaagttctttgtttccacgcgggcattacttgcctgaagctgatgtatacgcattaccttatactattccattttga

SEQ ID NO: 1029 - protein, 293 aa, Populus balsamifera subsp. trichocarpa
  misc_feature: Ceres ANNOT ID no.1452905
  misc_feature: Bit score of 591.5 for HMM based on sequences of FIGURE 12.
  misc_feature: Functional Homolog Of Ceres SEEDLINE ID no. ME17128 at SEQ ID NO. 1024
MSRCFPYPPPGYQIESIKIRKEKEKSITESHKDIKKEKKERRKHRKENKDQICYTVGKSHQKGKTFLPREKKEEAEKSDLTEEHNEPVCLQNICYLSDDGIRSNKKRKLEQATNDDKPRNVFRIRLPLTRHKEPDVPLNSEGLCSTSGRADSVSGQNEGVHLSHQETVNSKAGTVVGELASPEKMPCISVSEKKSTVCHESGISRFKLPNKKMRKADSPYKVLIEDWVSPPPQFELNDSDDQEWLSEASKRERHGNKILNACRDVLCHESSLFPRGHYLPEADVYALPYTIPF

SEQ ID NO: 1030 - protein, 293 aa, Arabidopsis thaliana
  misc_feature: Public GI ID no.8778818
  misc_feature: Bit score of 482.0 for HMM based on sequences of FIGURE 12.
  misc_feature: Functional Homolog Of Ceres SEEDLINE ID no. ME17128 at SEQ ID NO. 1024
MCSLYQQSLGVNQVNVESKTLYSNGLKLKRITLDSKKAHRIEKKEKKEKRKEKKETKREKSHKHSIKATDNHHKLIFLPSKKVSDESDSLEKSGLTDELEEPQKHLGYLSDGSQNSKKRIRDDSPPAVESLIKAGKPLRIRMVFKKPKEEVPTLPREAVVCSTTVAKSLSHQDVITSSISSSKTSELEKNLPSTSIAAIDETKKRKKHRSSKEDQYNALFDGWTPPSMCIADASSNDNGDYWLFGNKTQEVLKPKAAVKVDDDTMMRPGDSSWPRAQFLSEVGIYSLPYTVPF

SEQ ID NO: 1031 - DNA, 1195 bp, Arabidopsis thaliana
  misc_feature: Ceres CLONE ID no.108095
  misc_feature: Encodes the peptide sequence at SEQ ID NO. 1032
accacacgcgcttagctatcttctccccctcactgtctgctctaggtcgagattttttagggtttatctccggatttgggttagcgaaatcgagctcacggggttgtctcgattattcctttttaggttgcttgaatctgaagctaatcttgggttaattggattgttagaatcgagacctaaatccttcgattggatcagagaaaatatgtcgcgcgttctcacttgcccaccgcttgtgtttgcaagaaaccacgttggcgttcaaaacttggtcgaatcgactaagcttaaaagaatcacacttgattcaaaaaaggcgcaccggatagagaagaaggaaaagaaggagaagagaaaagaaaagaaagaaactaagcgtgagaaatcgcataaacattcgattaaagcaactgataatcatcacaagctaatatttcttccttccaagaaagtgtcagatgagtctgactcactagagaagagtggtttgacagatgagcttgaggaacctcaaaaacaccttggatatttgtctgatggaagtcagaatagtaagaagaggattagagatgattctcctccggctgttgaaagtctcatcaaagctgcacctgtagcaggtaaacctctacggattaggttggtcttcaaaaaaccaaaggaggaagttcctactctgcctagagaggctgttatttgctccactacagttgcaaagtcgctcagtcaccaagatgtcataacaagttctatctcaagttcaaaaacatccgagcttgaaaagaatctgccgtcaacatcaatagcggcaatagatgaaacaaagaagagaaagaaacacagatctagcaaagaagatcaatacaatgcattgtttgatggttggactcctccttccatgtgtattgctgatgcatcttcaaatgacaatggtgattattggctatttgggaacaagacgcaagaggtgcttaagcccaaagcagcagtcaaggttgatgatgacacgatgatgagaccgggagattcatcttggcctagagctcaatttttgtctgaagttgggatttattctttaccttatactgtcccgttctaatgctcgattctttttgttctagctttagacttagcttgtacagtgtttgactgtttgtaacaacaattctaatctaacccgattttgatacag

SEQ ID NO: 1032 - protein, 297 aa, Arabidopsis thaliana
  misc_feature: Ceres CLONE ID no.108095
  misc_feature: Bit score of 496.8 for HMM based on sequences of FIGURE 12.
  misc_feature: Functional Homolog Of Ceres SEEDLINE ID no. ME17128 at SEQ ID NO. 1024
MSRVLTCPPLVFARNHVGVQNLVESTKLKRITLDSKKAHRIEKKEKKEKRKEKKETKREKSHKHSIKATDNHHKLIFLPSKKVSDESDSLEKSGLTDELEEPQKHLGYLSDGSQNSKKRIRDDSPPAVESLIKAAPVAGKPLRIRLVFKKPKEEVPTLPREAVICSTTVAKSLSHQDVITSSISSSKTSELEKNLPSTSIAAIDETKKRKKHRSSKEDQYNALFDGWTPPSMCIADASSNDNGDYWLFGNKTQEVLKPKAAVKVDDDTMMRPGDSSWPRAQFLSEVGIYSLPYTVPF

SEQ ID NO: 1033 - protein, 285 aa, Arabidopsis thaliana
  misc_feature: Public GI ID no.18394821
  misc_feature: Bit score of 346.7 for HMM based on sequences of FIGURE 12.
  misc_feature: Functional Homolog Of Ceres SEEDLINE ID no. ME17128 at SEQ ID NO. 1024
MSRYFTSPPPVYARNWANGQNLVEWTKIERPIVDSKKLHRKEKKEKKKEKKLKKEKKSLEQKYSTTKTVSYESEQLEKSCLTEEFEQPQVGYLSDGSQNSKKRRRETSPAVVESQIKATPVAGKPLRIRIVFKKPKEAEAVPQEDPVCSTSGTQRPSELPSSVSLPSICDHDVAVPSTSLESGKVAIISESKKRKKHKPSKESRYNSLFDELVPPCISLEEDDSSSDDWLFGTSRKENVSSAKSSYKTDEDTIMSLQTSRDCSSLPRAMLLSEVGIFSLPYTVPF

SEQ ID NO: 1034 - DNA, 1235 bp, Arabidopsis thaliana
  misc_feature: Ceres CLONE ID no.6332
  misc_feature: Encodes the peptide sequence at SEQ ID NO. 1035
tcaaccgcaattggtttttttcttctttctctctctctcatcgattaacaaaatcgaatcgaaaaaaaaaattagggttcttctctcttccgtctctcgttatcgatttcgttttgatttcgcgccacaaagaagaagtttcattaggcgcgaatctgaaacctaggttcgatttagttctgtccgaattactgtccgttgtcttgtccgttagtcgattcgatctgagaaagaaagaaagagaagaagaaaaaacgatgtcacgatatttcacatccccaccgcctgtgtatgcgaggaactgggcgaacggtcaaaacttggtcgaatggactaagatcgaaagaccaatagttgattctaaaaagctgcatcggaaagagaagaaggagaaaaagaaagaaaagaaattaaagaaagagaagaaatcccttgaacagaagtattccacaaccaagacagtctcatatgaatccgaacagcttgagaaatcttgtttaacagaagaatatgagcaacctcgggttggatatttgtctgattgtagccagaacagtaagaagagaagaagggaaacttctcctgctgttgttgagagtcaaatcaaagctacacctgtagctggtaaaccactacggattcgtattgttttcaagaaaccgaaagaagctgaagctgtacctcaagaggatcctgtttgttccacttcagggactcagagacctagcgaattaccaagttctgtctctcttccaagtatctgtgatcatgatgtggctgtaccctcaacttctcttgagagtggcaaggtagcaattatttccgaatcaaagaagagaaagaaacataagcctagcaaagaatcccggtacaattcattgtttgatgaattagttcctccctgtatttccttggaggaagatgatagcagcagcgatgactggctttttggaacaagtcggaaagaaaatgtttcttctgccaagtcttcttataagactgatgaagacacgatcatgagcttgcagacgtcaagagattgttcctctttgcctagagctatgttattgtctgaagttggaattttttcattaccatatactgtcccgttttaggtcccatattgttttgttctttctcagcttagccttaggccttagctttgtgcagttatcattgtaacaatcacagtgatctatgatacttgaacgatctctgtatttttgacactaatc

SEQ ID NO: 1035 - protein, 285 aa, Arabidopsis thaliana
  misc_feature: Ceres CLONE ID no.6332
  misc_feature: Bit score of 337.7 for HMM based on sequences of FIGURE 12.
  misc_feature: Functional Homolog Of Ceres SEEDLINE ID no. ME17128 at SEQ ID NO. 1024
MSRYFTSPPPVYARNWANGQNLVEWTKIERPIVDSKKLHRKEKKEKKKEKKLKKEKKSLEQKYSTTKTVSYESEQLEKSCLTEEYEQPRVGYLSDCSQNSKKRRRETSPAVVESQIKATPVAGKPLRIRIVFKKPKEAEAVPQEDPVCSTSGTQRPSELPSSVSLPSICDHDVAVPSTSLESGKVAIISESKKRKKHKPSKESRYNSLFDELVPPCISLEEDDSSSDDWLFGTSRKENVSSAKSSYKTDEDTIMSLQTSRDCSSLPRAMLLSEVGIFSLPYTVPF

SEQ ID NO: 1036 - DNA, 1123 bp, Brassica napus
  misc_feature: Ceres CLONE ID no.1069047
  misc_feature: Encodes the peptide sequence at SEQ ID NO. 1037
atcgagttaggttttttagcgtttcttcttcttcttcctccttaagctgcaggattgtctcgggtgcttagtattggctggtttagatctgaacccctttcgaatcgattacatccgtacccaaacccctccctcctccccccatccccctcccgcaccctcgattcgaaaacatgatgccatcgatcctgattgcaaggaaccaggcgagcggtcagaacttggtcgattcgactaagatcgcaagaatcgtaaatgattccaaaacgtctctccccaaagagaagaaggataaggagaggagaaaacagaagaaagaaaagcgtgagaaatctcacaaacattcttccaaaaagtctagtaagtccccaggcgtttctgagaagagtggtgtgaccgaggagcttgatggacctcaaaaccacctcggttatctatctgacggaagccagaatagtaacaagaggaagagagactgctctcctccggctgttgaaagtgtcgtcaaagttgtgcctgtagcaggtaaacctctacggattcgtttgaccttcaaaaaacctaagcttgaaagtcctcttccccgtgaggatgttgttacctgttctacttccggtgctgagtctctcaatcaggcaccacaagctaccgtattctcttctctatgtgagcctgagctgaatgttccctcaacatctgagacgaagaagatatgtgagcctgaagtgaatgtcccctcagcatcagaagctgcagtagctggtgaagctaataagagaaagaaacacaagccgaccaaagaagaccgatacaatgcattgtttgatgattggactccaatttccaccattgccatggaggttgattgttcctctaagaacgatgacgactggctatttggcagcaggactaaagagagaacaagctgcaaagcagcaaacaagattgatgaagacgtgcgtgcatcttgtgattcgtcttggcccaaagctcagtttctgtctcaagtcgggatctattctttgccgtataccgtcccgttctagtgtttgttagtctttactcgtgtacagtacctgattgtaacaacagttctctaatctaacccaattttgacacggtc

SEQ ID NO: 1037 - protein, 290 aa, Brassica napus
  misc_feature: Ceres CLONE ID no.1069047
  misc_feature: Bit score of 201.8 for HMM based on sequences of FIGURE 12.
  misc_feature: Functional Homolog Of Ceres SEEDLINE ID no. ME17128 at SEQ ID NO. 1024
MMPSILIARNQASGQNLVDSTKIARIVNDSKTSLPKEKKDKERRKQKKEKREKSHKHSSKKSSKSPGVSEKSGVTEELDGPQNHLGYLSDGSQNSNKRKRDCSPPAVESVVKVVPVAGKPLRIRLTFKKPKLESPLPREDVVTCSTSGAESLNQAPQATVFSSLCEPELNVPSTSETKKICEPEVNVPSASEAAVAGEANKRKKHKPTKEDRYNALFDDWTPISTIAMEVDCSSKNDDDWLFGSRTKERTSCKAANKIDEDVRASCDSSWPKAQFLSQVGIYSLPYTVPF

SEQ ID NO: 1038 - DNA, 1166 bp, Brassica napus
  misc_feature: Ceres CLONE ID no.956176
  misc_feature: Encodes the peptide sequence at SEQ ID NO. 1039
aaccaattgtttattcttctctctctctctctctctctctctctctctctccgtttttggatttgacaataccaatcgagaaaaagaaattagcgtttgattagatttcgattgatttcgcgccacagagagagacgttccgtaggcttgtctggatctaaggttgttgtattagtcctgcccgtatccttgtccgtgtccgttttttactgttgaaaccgattagatagaaaaagacaaacgatgtcgagatatttcacatcaccaccgcctgtgtatgcgaggaactgggccaacggtcagaacttggtcgaatcgactaagattgagagacaaatagtcacttcaaaaaaggtgcaccctaaagagaagaaggagagaaagaaagataagaaacagaagaatgagaaaaccattgaacatgtgtatctaccaaccaagcaagtgtctgatgaatctgaacaacttgagaagagttgtttgacagaagaacatgagaaatatctgtctgatggtagccaaagtagtaagaagagaagaagggaagcttctccttctgttgagagtaatatcaaagctacgcctgtaactggtaatcctctacggatacgttttgtcttcaagaagcctaaggaagctgagtttgttgtccctcaagaggatctcgtttgttccacctcagggactgaaatatcaagttctgtctcaggtcatgatgagaatctgcttccagcttctctcgagagtgtcgagactgcaattctttctgaatcaaagaagaaaaagaaacataagactagcaaagaatcacggtacagttcactgtttgatgaaccggttcttccttgtctctccattgaggaagatgatggcaacagcgatgactggcttcttagtggaaggcggcaagagaatagttctaccaagtctactatggatgaagacatggtcatgaacttgcagaagtcgggagagtcctgttttcctagttctcagtttttgtctgaagtaggaactttttcattgccatacacagtcctgttctaggtcccagataattgttttgttctttctcagcttaggctaggcgctaagctaggccttaacttgtacagttccacgaattgtaacaaccacaaagataagtaatacttgaatgatccccc

SEQ ID NO: 1039 - protein, 267 aa, Brassica napus
  misc_feature: Ceres CLONE ID no.956176
  misc_feature: Bit score of 499.7 for HMM based on sequences of FIGURE 12.
  misc_feature: Functional Homolog Of Ceres SEEDLINE ID no. ME17128 at SEQ ID NO. 1024
MSRYFTSPPPVYARNWANGQNLVESTKIERQIVTSKKVHPKEKKERKKDKKQKNEKTIEHVYLPTKQVSDESEQLEKSCLTEEHEKYLSDGSQSSKKRRREASPSVESNIKATPVTGNPLRIRFVFKKPKEAEFVVPQEDLVCSTSGTEISSSVSGHDENLLPASLESVETAILSESKKKKKHKTSKESRYSSLFDEPVLPCLSIEEDDGNSDDWLLSGRRQENSSTKSTMDEDMVMNLQKSGESCFPSSQFLSEVGTFSLPYTVLF

SEQ ID NO: 1040 - protein, 295 aa, Medicago truncatula
  misc_feature: Public GI ID no.92870366
  misc_feature: Bit score of 573.8 for HMM based on sequences of FIGURE 12.
  misc_feature: Functional Homolog Of Ceres SEEDLINE ID no. ME17128 at SEQ ID NO. 1024
MSRCFPFPPPGYMIKLRFDLDTPKKDRKKKNRKEDKNERKEKREKRKREKELKQKDSTTSHASFGGAMKLKDINGKLLMGEDYENEQLERSGITEELEQPVSSPQEPYSSDSTQSSKRKRCTLLPNQDHEDAIKTRLPLTKHSEPEKSKQGFQFGSCSTSVGIGDSLTQETRRIDRPLTKVETPNQQLHRNSASKVCKPLQNLVPVDALEANKTVDDESRCVESLYKSLLHIQPIAYELFDALDQDWLFSSVKIEAKHVSKKQKTDAFRCSKSLWPRAQFMPEVNILALPYTIPF

SEQ ID NO: 1041 - DNA, 1789 bp, Zea mays
  misc_feature: Ceres CLONE ID no.294166
  misc_feature: Encodes the peptide sequence at SEQ ID NO. 1042
ttttagtttccttctcccaccgcggccccggaaaatttcccccttccccgtagcgaaaccctagccgccgcgccaaaaccaaatcccgccacgcccgaaaatttccggtggtttccttgccgcgaatcgatcgattccgagcgattcggttgatttgatcgatttcgggtgcttcgcgattgattaggccggcaaagccgccaatccttgtgatctctcgaaggggtagagcgcggtcgaccgtcggtcatgtcgaggtgcttcccctacccgccgcctgtgtacttgggaaacccagtggccgtggccgaggcggagtcgaccgctaagcttcagaaagaaagggaaagggctcacaagaagaaagataaaaggagtgacaagaaagctccccaactgggtgagacgtccaaacattcaaagcacaaccataagaagagaaagctcgaagatgtcagcacaggtgatcaggagcccaaaaaagtattcaaagaatcagctgagctattggagaagagtggactctcagaagagcatggagctccttgttttgtacagatgtttcgtgactctcctgagagctcgcaggacagcagcaagagaagaaaggctgtcctgcccagtcccagccaagctaagaatggtaacatcattcgcatcaagctaaaaagtaaccaagatccccaatcagttcttttggagaaaccaagggttctggagcaaccactggtccaacaaatgagttcggtttcatccctgtcgagcaaacaaaattcaatcaatcgtaaggtgaatgtgagatctacagctggccagcagtgggtcaatggtgactcccaagcagtacaaaaatctttggttacagaaaccctgtcaagggcaatgcagagaactgtcccccagcctgcagtgaaggtcacacgtcgggctgatccccagctatctgttaaggcgccggttggaagatctgacctacctccaaagttttcgggaagtgtgggcccttcacctgctagagtgaccggaagattttgtcctgcacctgttaagacgcaacagagaattgagcatccaccttccatggtgtcacagagagttgatcctcaggcgaaggtgtcacagaaggaaatgggatctgctgtttgcctgccacaagctccacatcctcctgttttgcagaaacccaaggacttgcctgttcctaaacagcgggagcctatcaactctttgccaaaagaagagccttgtttctctggaaggactgtggaagcagatcaagggaaggaagctaagctctcccgttcagatcggaagaaaatccacaaaactgagaagaaaaataagaagttcagagatctgtttgttacctggaatccgctattgatggagaatgaaggttcagatttgggtggtcaagactggctgttcagcagtacaagaagctctgatggtagcatggctcaacccacagtacctgatggtttagggccgattcatccgatggtgcagcagcagccttatttgcaacccagggcaacttttttgccggaccttcatatctatcagctgccttatgttgtaccgttttaagtctgttcgtagatgagaagtagatgagatgttgtgaaggagctgtgtggatgtgggatataatggttccctgccgcaattttccagctttgttagcaagattgtaatgtaatgttggttaattattttgctcatttatgtaagcagttgaactgcaaaaaaaaaaaaaaaaaaaaaaaaaaaaaaaaaaaaaaaaaaa

SEQ ID NO: 1042 - protein, 446 aa, Zea mays
  misc_feature: Ceres CLONE ID no.294166
  misc_feature: Bit score of 1026.6 for HMM based on sequences of FIGURE 12.
  misc_feature: Functional Homolog Of Ceres SEEDLINE ID no. ME17128 at SEQ ID NO. 1024
MSRCFPYPPPVYLGNPVAVAEAESTAKLQKERERAHKKKDKRSDKKAPQLGETSKHSKHNHKKRKLEDVSTGDQEPKKVFKESAELLEKSGLSEEHGAPCFVQMFRDSPESSQDSSKRRKAVLPSPSQAKNGNIIRIKLKSNQDPQSVLLEKPRVLEQPLVQQMSSVSSLSSKQNSINRKVNVRSTAGQQWVNGDSQAVQKSLVTETLSRAMQRTVPQPAVKVTRRADPQLSVKAPVGRSDLPPKFSGSVGPSPARVTGRFCPAPVKTQQRIEHPPSMVSQRVDPQAKVSQKEMGSAVCLPQAPHPPVLQKPKDLPVPKQREPINSLPKEEPCFSGRTVEADQGKEAKLSRSDRKKIHKTEKKNKKFRDLFVTWNPLLMENEGSDLGGQDWLFSSTRSSDGSMAQPTVPDGLGPIHPMVQQQPYLQPRATFLPDLHIYQLPYVVPF

SEQ ID NO: 1043 - protein, 446 aa, Oryza sativa subsp. indica
  misc_feature: Public GI ID no.125543067
  misc_feature: Bit score of 1034.1 for HMM based on sequences of FIGURE 12.
  misc_feature: Functional Homolog Of Ceres SEEDLINE ID no. ME17128 at SEQ ID NO. 1024
MSRCFPYPPPGYVRNPVVAVAAAEAQATTKLQKEREKAEKKKEKRSDRKALPHGEISKHSKRTHKKRKHEDINNADQKSRKVSSMEPGEQLEKSGLSEEHGAPCFTQTVHGSPESSQDSSKRRKVVLPSPSQAKNGNILRIKIRRDQDSSASLSEKSNVVQTPVHQMGSVSSLPSKKNSMQPHNTEMMVRTASTQQQSIKGDFQAVLKQGMPTPAKVMPRVDVPPSMRASKERVGLRPAEMLANVGPSPSKAKQIVNPAAAKVTQRVDPPPAKASQRIDPLLPSKVHIDATRSFTKLSQTEIKPEVQPPIPKVPVAMPTINRQQIDTSQPKEEPCSSGRNAEAASVSVEKQSKSDRKKSRKAEKKEKKFKDLFVTWDPPSMEMDDMDLGDQDWLLGSTRKPDAGIGNCREIVDPLTSQSAEQFSLQPRAIHLPDLHVYQLPYVVPF

SEQ ID NO: 1044 - protein, 520 aa, Oryza sativa subsp. japonica
  misc_feature: Public GI ID no.115480956
  misc_feature: Bit score of 147.6 for HMM based on sequences of FIGURE 12.
  misc_feature: Functional Homolog Of Ceres SEEDLINE ID no. ME17128 at SEQ ID NO. 1024
MARCFPYTRNPVAESMSSAAAAAVEPGIDKLQKEREMMQKKEKKERKKEKRRQKKAAQLGEKYETDDHHSKHGHKKRKHSGCEIVGEETRKVCNVTMEHLEKSSLSEEHEAPSYSQALRCTPESSLDSTKRLRTEVSSSPSQTRNGVNIRVKFTPTNQRRDPEATTGMSMKPRVTEQSPVKETGMDLSMANRKREFQPHVNTVSVVKQVVSQQKNMSIRNGNCLDESRKVSQQHDAKSMQRVNMVQRVRTKSTPIAAMQRVDPPSSEKAVMQRANPAPTKVMQGVEAAPVKSMQRANPTSTKVMQEVEATPVKAMQIAGHITLSKVFNRESTQVQLRKETGGPLLGGQLNTGRPTLLNKPKVCADPPILLSKPEMLCVEPPGLLNKPKAHVEPPVVKQQQQIVPEAQEEPCSVGSVLAAASPVTEAQQSSSDRKSRKAEKKGRKLADLFVNWKPSPTQMEDTDVGDQDWLFSCRATPKNNCRTFDGSARCQPTEQLFSLQPRAVHLPDLLMYQLPFVVPF

SEQ ID NO: 1045 - DNA, 1003 bp, Arabidopsis thaliana
  misc_feature: Ceres SEEDLINE ID no.ME17578
  misc_feature: Genomic Sequence
  misc_feature: Expected Sequence
  misc_feature: Encodes the peptide sequence at SEQ ID NO. 1047
atggctgttcaagctcatcacatgaacattttctctcagtttatatcaccaaacaggtaaaaatctcatttttatattcttctcacaaacaaacttcctctgtttttattttcctctaatcttttttatttttgttatttgcagagattgtgttaaatttcaagaaaacatgaaccacggcgagtttgagtttaccggcggtgaagttccgttaataaccggagaatctttcgccgttgagcctttagctgcgaaagccaacttcaacaaagcagaaagtggtctcagttacaatttcactgttcctcctctgtctacaaaacgccagcgagattttcaattctcagactcaaacgctccggttaaacggaggtccgtagcgtttgactcatcatcaccgtcgttgataaacgttgaactcgtatctcagattcaaaaccaacaacagtcagagatcgataggttcgtagctcagcaaacggagaagctaagaatagagattgaagcaaggcaacaaacgcaaacgcggatgttagcgtctgcggttcaaaacgttatagccaagaaactaaaagagaaagacgatgaaatcgtacggattcgaaacctaaactgggttttacaagagagggtgaagagtctttacgtcgaaaatcagatttggcgtgatatcgctcaaaccaacgaagcaaacgctaatactcttcgaacaaacctagaccaagttcttgctcaactcgaaacgtttccaaccgcttcagccgttgtagaagacgatgcggaatcgagttgtggaagttgttgcggtgatggtggtggtgaagcggtaacggcggttggtggtggttgtaaacggtgcggtgagagagaagcgagtgtgttggtgttaccatgtcgtcatttgtgtttgtgtacggtttgtggtggttcggctttgttacggacttgtccggtttgcgatatggtcatgaacgctagtgtgcatgttaacatgtcttcttga

SEQ ID NO: 1046 - DNA, 915 bp, Arabidopsis thaliana
  misc_feature: Ceres SEEDLINE ID no.ME17578
  misc_feature: Predicted Sequence
  misc_feature: Encodes the peptide sequence at SEQ ID NO. 1047
atggctgttcaagctcatcacatgaacattttctctcagtttatatcaccaaacagagattgtgttaaatttcaagaaaacatgaaccacggcgagtttgagtttaccggcggtgaagttccgttaataaccggagaatctttcgccgttgagcctttagctgcgaaagccaacttcaacaaagcagaaagtggtctcagttacaatttcactgttcctcctctgtctacaaaacgccagcgagattttcaattctcagactcaaacgctccggttaaacggaggtccgtagcgtttgactcatcatcaccgtcgttgataaacgttgaactcgtatctcagattcaaaaccaacaacagtcagagatcgataggttcgtagctcagcaaacggagaagctaagaatagagattgaagcaaggcaacaaacgcaaacgcggatgttagcgtctgcggttcaaaacgttatagccaagaaactaaaagagaaagacgatgaaatcgtacggattcgaaacctaaactgggttttacaagagagggtgaagagtctttacgtcgaaaatcagatttggcgtgatatcgctcaaaccaacgaagcaaacgctaatactcttcgaacaaacctagaccaagttcttgctcaactcgaaacgtttccaaccgcttcagccgttgtagaagacgatgcggaatcgagttgtggaagttgttgcggtgatggtggtggtgaagcggtaacggcggttggtggtggttgtaaacggtgcggtgagagagaagcgagtgtgttggtgttaccatgtcgtcatttgtgtttgtgtacggtttgtggtggttcggctttgttacggacttgtccggtttgcgatatggtcatgaacgctagtgtgcatgttaacatgtcttcttga

SEQ ID NO: 1047 - protein, 304 aa, Arabidopsis thaliana
  misc_feature: Ceres SEEDLINE ID no.ME17578
  misc_feature: Bit score of 559.3 for HMM based on sequences of FIGURE 13.
MAVQAHHMNIFSQFISPNRDCVKFQENMNHGEFEFTGGEVPLITGESFAVEPLAAKANFNKAESGLSYNFTVPPLSTKRQRDFQFSDSNAPVKRRSVAFDSSSPSLINVELVSQIQNQQQSEIDRFVAQQTEKLRIEIEARQQTQTRMLASAVQNVIAKKLKEKDDEIVRIRNLNWVLQERVKSLYVENQIWRDIAQTNEANANTLRTNLDQVLAQLETFPTASAVVEDDAESSCGSCCGDGGGEAVTAVGGGCKRCGEREASVLVLPCRHLCLCTVCGGSALLRTCPVCDMVMNASVHVNMSS

SEQ ID NO: 1048 - DNA, 1084 bp, Gossypium hirsutum
  misc_feature: Ceres CLONE ID no.1837746
  misc_feature: Encodes the peptide sequence at SEQ ID NO. 1049
aaagccaaagaactctccttatatctctctaccctttttctctcgcaaactctaaaaacatcaaagagagcttaaaagcaaaagaatcaatggcagtcgaagctcgtaatatgaatcttttccctcctcagttaatccctaatgcagattttatgaaaggtgatcaagggagtggaaatatacacaacacccagatgcagcaagaagtttcacagattttccctgcagtttatcagtcgcttgtacgtgatccgatttcagccaaagctgatagtggggttacttataatatgaatatcccagtttcggccccaaggaaaaggcctagggattcatattcatacacagttgctcgaaagaacgacttttgtggggtttcttctgttcttgacgatgatgtcttttcccagatccaacaacaacaacaacaagaaatcgaccgtttcattgctcaacatacagaaaaagtgaggttggagattgaagaaaggaggaagaggcaatcgaggatgttgattacagcgatccaagaaggggttatgaagaaactgaaggaaaaagatgaagagatacaaagaatggggaaactgaactgggttcttcaagaaagagtgaaaagcctgtatttagagaaccaactgtggagggacttggcgcaaacgaacgaagccaccgccaattccttacgcaccaatctagaacaagtccttgcccacgtcggtgaggaacgtcacgccagcggcggaggagcggccgcgttggccgacgacgcgggatctagctgtggaagcagcgatgaagggtggcgcaaggtggtgttgccgcctactcagccacatgatacgacggcagcggtggttgggaacggtaataataatggaaggaagtgtagaaagtgtggggagaaagagtcaagtgtgctgttgctgccatgcaggcatctctgtctctgtacaatgtgtgggtccactctggtaggcacttgccctgtttgtgactctgtcaccaatgccagtgttcatgttaacatgtcttgaaacaatttttttttcttttttagatattttagtgaaaacaaaacagc

SEQ ID NO: 1049 - protein, 315 aa, Gossypium hirsutum
  misc_feature: Ceres CLONE ID no.1837746
  misc_feature: Bit score of 509.8 for HMM based on sequences of FIGURE 13.
  misc_feature: Functional Homolog Of Ceres SEEDLINE ID no. ME17578 at SEQ ID NO. 1047
MAVEARNMNLFPPQLIPNADFMKGDQGSGNIHNTQMQQEVSQIFPAVYQSLVRDPISAKADSGVTYNMNIPVSAPRKRPRDSYSYTVARKNDFCGVSSVLDDDVFSQIQQQQQQEIDRFIAQHTEKVRLEIEERRKRQSRMLITAIQEGVMKKLKEKDEEIQRMGKLNWVLQERVKSLYLENQLWRDLAQTNEATANSLRTNLEQVLAHVGEERHASGGGAAALADDAGSSCGSSDEGWRKVVLPPTQPHDTTAAVVGNGNNNGRKCRKCGEKESSVLLLPCRHLCLCTMCGSTLVGTCPVCDSVTNASVHVNMS

SEQ ID NO: 1050 - DNA, 1183 bp, Gossypium hirsutum
  misc_feature: Ceres CLONE ID no.1834764
  misc_feature: Encodes the peptide sequence at SEQ ID NO. 1051
tttgttttgcaagctcatctctttctcccttattctctcctgcttcaaagccaaagactctctctcttccctttgtatcgttcccttttctcttttatttctaaactaaattacgttgaagcaaagaataaaagaagcccacaccttagccttttatccaatggcagttgaagctcctcatatgaatcctttccctcctcagttaatcaccaacagcagtggttttatgaaaacaaaccaagggagtggtaatatatgcagtggccaggtggattattgtattccgttggttgattcaatgaaacaagattcccagttttttccattatatcaatccattgtctgtgatccggtttcggccaaaacttcaatcaacaaagctgacagtggccttacctataatatgaatatcccagtatccgcaacaagaaaaaggcccagagattcaatcatcaatggctttgattcatacactgtctcccaaaagaacaaactttgtggtgtttcctctcttcttgatgatgatgtcttctcccagatccaacaacaacaagaagaaatcgagcgtttcattgccgaacacacagagaaagtgaggtttgaacttgaagaaataagaaaaaggcaatcgagaatgttgattactgcaatccaagaaggggcaatgaagaaactgatggaaaaagaagaagagatgcagagaatgggaaaactgaactggattcttcaagaaagggttaaaagcctgtacgtagagaaccaactatggacagacctggcacaaacaaacgaagccactgccaagtccctgcgtaccaatttagagcaagtcctggcgcacgtcagcgaggaacgccacgtgagcggcggaggcgcagccgcgctggctgatgatgcggagtctagctgcggaagcagcgatgaagggtggcgcacggtggtgccaccgcagccacaagggagcggtggatgtgtgccggataaggcggtggtggttgggaatcataatattaggaagtgtaggaagtgcggggaaagggagtcaagtgtgctgttgctgccatgcaggcatctttgtctctgtacagtttgtgggtccactctggtaggcacttgccctgtttgtgattctattaccaatgccagtgttcatgttaacatgtcatgaaacaattcttttttc

SEQ ID NO: 1051 - protein, 335 aa, Gossypium hirsutum
  misc_feature: Ceres CLONE ID no.1834764
  misc_feature: Bit score of 509.8 for HMM based on sequences of FIGURE 13.
  misc_feature: Functional Homolog Of Ceres SEEDLINE ID no. ME17578 at SEQ ID NO. 1047
MAVEAPHMNPFPPQLITNSSGFMKTNQGSGNICSGQVDYCIPLVDSMKQDSQFFPLYQSIVCDPVSAKTSINKADSGLTYNMNIPVSATRKRPRDSIINGFDSYTVSQKNKLCGVSSLLDDDVFSQIQQQQEEIERFIAEHTEKVRFELEEIRKRQSRMLITAIQEGAMKKLMEKEEEMQRMGKLNWILQERVKSLYVENQLWTDLAQTNEATAKSLRTNLEQVLAHVSEERHVSGGGAAALADDAESSCGSSDEGWRTVVPPQPQGSGGCVPDKAVVVGNHNIRKCRKCGERESSVLLLPCRHLCLCTVCGSTLVGTCPVCDSITNASVHVNMS

SEQ ID NO: 1052 - DNA, 1028 bp, Gossypium hirsutum
  misc_feature: Ceres CLONE ID no.1837694
  misc_feature: Encodes the peptide sequence at SEQ ID NO. 1053
caaattcaatgcatgaaggttcacaacttttaccattatatcaacccctcctctgtcatccaaatatttcagccaacaaagctgatagcggtcttacaacttacaacatgagtatcccagtttcagctccaagaaaaaggtctagagattcattcaccaatggctttgattcatattcactccctcaaaacaacaacctttctggtgcttcctcagacgttgatgatgtcttctcccagatccaacaacaacatgatattgaccgttttatttctgatcatacagaaaaattgaggttggaagttgaagagagacgaaagaggcagtcaagaatgtttattacagcgatccaagaaagggtgatgaagaaactcaaggaaaaagatgaagaaatccagagaatagggaaactcaactgggttcttcaagaacgggttaaaagcctatacgtagagaatcaactgtggagagacttggcacaaacaaacgaagcgacggccaattccctacgcaacaatctagaacaagtcctggcacatgcgggagacagcgggggaggaggtgccgctttggcagatgacgcagagtccagctgtggcagcagcgaccaagggtggcgcgaggtggtgacaccacaagcacaggggagttgtggggcgcaggataataataaggcggtggttgttgggaacaataataggaagtgcagaaagtgtggggagaaagagtcaagtgtcctgttgctgccatgcagacatctatgtctttgtacaatgtgtgggtccaccatggtaggcacttgccctgtttgtctttctcttaccaacgccagtgttcatgttaacatgttatgaacacttgcttttctttttattttttcttacagttgtttagtgaaacaaaatcaagaaaaaggaaatgcaaatatctttctacaaatggatcaagagttttactttgatgaattttgtataacaaaaatggtcaaagttacagctctattgttcgaaaaaaaaaaaaaaaaaaaa

SEQ ID NO: 1053 - protein, 281 aa, Gossypium hirsutum
  misc_feature: Ceres CLONE ID no.1837694
  misc_feature: Bit score of 493.8 for HMM based on sequences of FIGURE 13.
  misc_feature: Functional Homolog Of Ceres SEEDLINE ID no. ME17578 at SEQ ID NO. 1047
MHEGSQLLPLYQPLLCHPNISANKADSGLTTYNMSIPVSAPRKRSRDSFTNGFDSYSLPQNNNLSGASSDVDDVFSQIQQQHDIDRFISDHTEKLRLEVEERRKRQSRMFITAIQERVMKKLKEKDEEIQRIGKLNWVLQERVKSLYVENQLWRDLAQTNEATANSLRNNLEQVLAHAGDSGGGGAALADDAESSCGSSDQGWREVVTPQAQGSCGAQDNNKAVVVGNNNRKCRKCGEKESSVLLLPCRHLCLCTMCGSTMVGTCPVCLSLTNASVHVNML

SEQ ID NO: 1054 - DNA, 1293 bp, Gossypium hirsutum
  misc_feature: Ceres CLONE ID no.1853547
  misc_feature: Encodes the peptide sequence at SEQ ID NO. 1055
aaggcaaagccaaaatgttggtggtgagaaaccaaattaaagaaacaagaaaattagaagaagggtgatctattctcttgttgttgatcagcttttatcatccattctttgattgcttcattcattcattctttctttcttatcttcttcaaacttgattgctttcccttcacaatcacattgctgtaatggccgttcaagctcagtatccttccaatgtcctcctcttaaacagtggacaagaagggcatgagttttcgttgcaacaacaagggggaggggtttatgttgatcaatcccatatgtttaacagcagcaacaacaataataatccaaggaaaagaggaagagaaatggcagcggtagcaacaacagcgcccgtgaattcattttctttgcaaacgcaaccgcctcaattcatagagctttctcaactccaaagaccaaatgtagtctccacggggctctgcttatcttttggggaccaacaacacttgcaccaaaaccaaaaccaaagttatgaacaccaacatcaaaatctcgtttccagctccactgcttttctgtctataatatctgatgaattggctacccaaatcaaacgccagagagaagaactagaccaatttcttcaagcccagggggaggcattgcggcgtacgttagcggagaaaagacataggcacttccgtgcgctactgggggcagcggaagaatcggtggcgaggagattaagggataaagaggcggaagttgagaaagcaaagcagcggaacgcagagttggagacacgcgtggcgcaacttaacgtggaggcgcaggtttggcaggcgaaagcccgggcacaggaggctacggcggcttcattacaagcgcagcttcaacaggctataatgagcggaggggctgccgtctcgatgcacgacagcaggagaggggaggagggggtaaagtgcggtgaagggcaagcggtggacgccgagtcggcttacgtggacccggaccgggtggtggcttcatggggtccggcatgcaaggcgtgtcggaaacgtctggcgtcgatggtgctgctgccgtgtcggcatctatgcttgtgtacagagtgtgatcgagtggcgcaagcctgcccgctttgcctcaccgccaggaattctagcgtcgaggcttttctttcttgaattttttttttaaagtccagattaaaaaaaaaagggggggaaaaacaatttggaaaaaagaaagaaaatcaaatagtataaaccttgattatgataaaaaaaaaaaaaaaaaaaa

SEQ ID NO: 1055 - protein, 329 aa, Gossypium hirsutum
  misc_feature: Ceres CLONE ID no.1853547
  misc_feature: Bit score of 179.8 for HMM based on sequences of FIGURE 13.
  misc_feature: Functional Homolog Of Ceres SEEDLINE ID no. ME17578 at SEQ ID NO. 1047
MAVQAQYPSNVLLLNSGQEGHEFSLQQQGGGVYVDQSHMFNSSNNNNNPRKRGREMAAVATTAPVNSFSLQTQPPQFIELSQLQRPNVVSTGLCLSFGDQQHLHQNQNQSYEHQHQNLVSSSTAFLSIISDELATQIKRQREELDQFLQAQGEALRRTLAEKRHRHFRALLGAAEESVARRLRDKEAEVEKAKQRNAELETRVAQLNVEAQVWQAKARAQEATAASLQAQLQQAIMSGGAAVSMHDSRRGEEGVKCGEGQAVDAESAYVDPDRVVASWGPACKACRKRLASMVLLPCRHLCLCTECDRVAQACPLCLTARNSSVEAFLS

SEQ ID NO: 1056 - DNA, 1005 bp, Populus balsamifera subsp. trichocarpa
  misc_feature: Ceres ANNOT ID no.1483367
  misc_feature: Encodes the peptide sequence at SEQ ID NO. 1057
atggcagttgaagctcctcatacaaaccttaatttcccttcacatcttctcacaaacagggattttgcgaaagtaaatcaagcaaacatgagtttgtacaatacccagatggattctggccttgtttttaatgaaccaatgcctgaaacactcttgtcgttctatcaatcctctcttggttgtgacccagtttctgctaaagcttctaataaagatgatagtgggctcacctacaatgttcctgctgttgttgctccaagaaagaggtctagagattcaatcaatgacaactttgatgcttttcatgcctctcagaagaccaaagtctgccctttttcttcttttattgatcaagacatcatctttcagatccaacaacaacaatctgaaattgaccgcttcattgctgaacataatcagaaagttagaatggaacttgaagacaggagaaagaggcagtcaagaatgctggtatcggcaatacaaggagggatggtgaggaaattaatagagaaagatgaagagattcaaaggatgggaaaattgaactgggttcttcaagaaaaagtgaagagcttatacgttgagactcaaatttggagggatttagctcaagccaatgaggctacagcaaattcattacgcagcaatttagaacaagttttggcgcacgttagcgaggaccgctacataaatggtggtggtgccacggtggcagatgacgcggaatccagttgtggaagtagtgatcatgggaggtgcccgttagcaggtggagaagagggcgcggtgaaggataagttggtggtggtgaaggataacaatagcagcaaaaatattaaccacaaccggatgtgtaaaaagtgtggggagagggaatcaagtgtgttgctgctgccatgcaggcatctgtgcctgtgtacattatgtgggtccaatctgattggtacttgcccagtatgtgattctgtcatggatgctagtgtacatgttaacatggcttga

SEQ ID NO: 1057 - protein, 334 aa, Populus balsamifera subsp. trichocarpa
  misc_feature: Ceres ANNOT ID no.1483367
  misc_feature: Bit score of 644.0 for HMM based on sequences of FIGURE 13.
  misc_feature: Functional Homolog Of Ceres SEEDLINE ID no. ME17578 at SEQ ID NO. 1047
MAVEAPHTNLNFPSHLLTNRDFAKVNQANMSLYNTQMDSGLVFNEPMPETLLSFYQSSLGCDPVSAKASNKDDSGLTYNVPAVVAPRKRSRDSINDNFDAFHASQKTKVCPFSSFIDQDIIFQIQQQQSEIDRFIAEHNQKVRMELEDRRKRQSRMLVSAIQGGMVRKLIEKDEEIQRMGKLNWVLQEKVKSLYVETQIWRDLAQANEATANSLRSNLEQVLAHVSEDRYINGGGATVADDAESSCGSSDHGRCPLAGGEEGAVKDKLVVVKDNNSSKNINHNRMCKKCGERESSVLLLPCRHLCLCTLCGSNLIGTCPVCDSVMDASVHVNMA

SEQ ID NO: 1058 - DNA, 981 bp, Populus balsamifera subsp. trichocarpa
  misc_feature: Ceres ANNOT ID no.1474088
  misc_feature: Encodes the peptide sequence at SEQ ID NO. 1059
atggcagttgaaactcctcatatgagcctcaatttcccttcacaacttatcacaaacagggatcttgtgaaagcaaatcacgcaaacatgaatttatacaatacccagatggattctggccttgttttcaatgaaccagtgcctgaaacactcatgtcgttctatcagtcttctcttggttgtgacccaatttctgctgctaaggcttctaataaagatgatagtagtctcacctacaatgttcctgctgttgctgctccaagaaagagggctagagactcgatcaatgatgacaactttgatgcttttcatgcctctcaaaagaccaaagtctctcctttatcttctttcattgatcacgatatcctctttcagatccaacaacagcaatctgaaatcgaccgtttcattgatgatcataatcagaaagttagaatggaacttgaagagaggaaaaagaggcaatcaagaatgttggtatcagcaatacaagaaggaatgattaagaaagtgaaagagaaagacgaagagattcaaagaatgggaaaaataaactggtttcttcaagaaaaagcgaagagtttatacgtagagaatcaaatttggagggatttagcacaagccaatgaggccacagcaaattcattacggagcaatttagaacaagtcttggcgcacgcaagtggtggcgctgccactctggcagatgatgcagaatccagttgctgtggaagtagtgatcatgggaggtgcacgttagctggtggagaagagggtgcggtgaaggataagatggtagtggttaaggataatcttaaccacaacaggatgtgtaaaaagtgtggggagagggagtcaagtgtgctgctgctgccgtgcaggcatctttgcctgtgtacattatgtgggtccaatctgattggttcttgcccagtatgtgattctgtcatgactgctagtgtccatgttaacatgtcttga

SEQ ID NO: 1059 - protein, 326 aa, Populus balsamifera subsp. trichocarpa
  misc_feature: Ceres ANNOT ID no.1474088
  misc_feature: Bit score of 555.8 for HMM based on sequences of FIGURE 13.
  misc_feature: Functional Homolog Of Ceres SEEDLINE ID no. ME17578 at SEQ ID NO. 1047
MAVETPHMSLNFPSQLITNRDLVKANHANMNLYNTQMDSGLVFNEPVPETLMSFYQSSLGCDPISAAKASNKDDSSLTYNVPAVAAPRKRARDSINDDNFDAFHASQKTKVSPLSSFIDHDILFQIQQQQSEIDRFIDDHNQKVRMELEERKKRQSRMLVSAIQEGMIKKVKEKDEEIQRMGKINWFLQEKAKSLYVENQIWRDLAQANEATANSLRSNLEQVLAHASGGAATLADDAESSCCGSSDHGRCTLAGGEEGAVKDKMVVVKDNLNHNRMCKKCGERESSVLLLPCRHLCLCTLCGSNLIGSCPVCDSVMTASVHVNMS

SEQ ID NO: 1060 - DNA, 1014 bp, Populus balsamifera subsp. trichocarpa
  misc_feature: Ceres ANNOT ID no.1536919
  misc_feature: Encodes the peptide sequence at SEQ ID NO. 1061
atggccgttgaagccaggcacctcaatctcttccctcctcaactcttaagcaacagggaaatgatgatgaaccccattgaagcagatacatatatgtacaacacccagatgggatatggtgtgccattatcaggaactacaacaacagcagagacagtgcttcctatgtatagctctgtgatcactgattcaatccctcataaaacgcaaatcaaatcagaaagtggtctcacttacaatctccctgtacagaggaagcgcccaagagacaccatcaatcctctcctctcatatccaattccagtacagtccactaagacttgcactcccttctcctttcttggccaggacctctcttttcagatccaacaacagcaattagacacagattgccttatttctcaacatatggagaaagtaaggatggagatagaagagaaaaggaagaggcaggcaagaaggttactcgaggcattagagacagggatggtgaagcgactaagagcaaaagaagaagaaatcgaaaagataggcaaattaaactgggcccttgaagagaaagtcaagtctttatgcatggagaatcaaatatggagagacctagcgcaatccaatgaagcaacagccaatgctctacgttccaatcttgaacaagtcctcgcagcccaggttaacgaagaacgcacccttggtgcaggattagataatcaggcagcagcattaatggacgatgcgcaatcatgctgtggcagcagcggtggtgatggacctgttggcgacgatggatgggaagaaagagtgtcggagagatgcacgttagccaatggggcgcaggataataaaggtacaggagcaggtagttggatgtgcaggaattgtaacaaggaagagtcatgtgtgttgctgttgccttgcaggcatctgtgcttgtgtactgtttgtgggtcaagcctccatacttgccccatctgtagagccaccaagaatgctagcgtccatgttaacttgtcatga

SEQ ID NO: 1061 - protein, 337 aa, Populus balsamifera subsp. trichocarpa
  misc_feature: Ceres ANNOT ID no.1536919
  misc_feature: Bit score of 408.5 for HMM based on sequences of FIGURE 13.
  misc_feature: Functional Homolog Of Ceres SEEDLINE ID no. ME17578 at SEQ ID NO. 1047
MAVEARHLNLFPPQLLSNREMMMNPIEADTYMYNTQMGYGVPLSGTTTTAETVLPMYSSVITDSIPHKTQIKSESGLTYNLPVQRKRPRDTINPLLSYPIPVQSTKTCTPFSFLGQDLSFQIQQQQLDTDCLISQHMEKVRMEIEEKRKRQARRLLEALETGMVKRLRAKEEEIEKIGKLNWALEEKVKSLCMENQIWRDLAQSNEATANALRSNLEQVLAAQVNEERTLGAGLDNQAAALMDDAQSCCGSSGGDGPVGDDGWEERVSERCTLANGAQDNKGTGAGSWMCRNCNKEESCVLLLPCRHLCLCTVCGSSLHTCPICRATKNASVHVNLS

SEQ ID NO: 1062 - DNA, 1023 bp, Populus balsamifera subsp. trichocarpa
  misc_feature: Ceres ANNOT ID no.1467033
  misc_feature: Encodes the peptide sequence at SEQ ID NO. 1063
atggctgttgaagcaaggcacctcaatctcttccctcctcaactcataagcagcagggaaataacgaaccccattgaagcaaatacaaatatgtacaacacccaaatgggatatggtgtgccattatcaggaggaactacaacgacaacagctgatacacttcttcctatgtacagttctgtgatcactgattcaatctcccataaaacaccaatcaaatcagacagtggtctcacttacaacgtccctgtacaaagaaagcgcccaagagactctatcaatcctctcctctcatatccaactctagtacaatccaataagacttgcgctcccttctcctttcttggccaagacctctcttttcagatccaacaacagcaattagacatcgattgccttgtttctcaacatatggagaaagtaaggatggagatagaagagaagaggaggaggcaagcaaggaggataatagaggcaatagagacagggatgatgaagagactaagagcaaaagaagaagaaattgaaaagataggcaaattgaattgggccctcgaagagaaagtcaagtctttgtgcgtagagaaccaaatatggagagacttggcacaatccaacgaagcaacagccaatactctacgttccaatcttgaacaagtccttgcagcacaggttaaggaagaccgcacccttggtgcaggattggatgatcagacagcagcattactggacgatgcccaatcatgttgtggtagcaatggtggtgatggtgatgatggatgggaagaaaaagtgtcggagaggtgcacgttagcaaatggggcgcaggacaataatggtgcaggtccaaggggtacaggtacaagtagttggttgtgcaggaactgtaacaaggcagagtcttgtgtgttgctgttgccttgtaggcatctgtgcttgtgtactgtttgtgggtcaagtctccatacttgccccatctgtaaagccaccaagaatgctagtgtccatgttaacttgtcatga

SEQ ID NO: 1063 - protein, 340 aa, Populus balsamifera subsp. trichocarpa
  misc_feature: Ceres ANNOT ID no.1467033
  misc_feature: Bit score of 430.4 for HMM based on sequences of FIGURE 13.
  misc_feature: Functional Homolog Of Ceres SEEDLINE ID no. ME17578 at SEQ ID NO. 1047
MAVEARHLNLFPPQLISSREITNPIEANTNMYNTQMGYGVPLSGGTTTTTADTLLPMYSSVITDSISHKTPIKSDSGLTYNVPVQRKRPRDSINPLLSYPTLVQSNKTCAPFSFLGQDLSFQIQQQQLDIDCLVSQHMEKVRMEIEEKRRRQARRIIEAIETGMMKRLRAKEEEIEKIGKLNWALEEKVKSLCVENQIWRDLAQSNEATANTLRSNLEQVLAAQVKEDRTLGAGLDDQTAALLDDAQSCCGSNGGDGDDGWEEKVSERCTLANGAQDNNGAGPRGTGTSSWLCRNCNKAESCVLLLPCRHLCLCTVCGSSLHTCPICKATKNASVHVNLS

SEQ ID NO: 1064 - DNA, 1047 bp, Populus balsamifera subsp. trichocarpa
  misc_feature: Ceres ANNOT ID no.1485401
  misc_feature: Encodes the peptide sequence at SEQ ID NO. 1065
atggctgtccaagctcaatatccttctaatgccctccttctaaacagaaacggtcaagacggtcacgattattcattgcaaccacagcctggaggatatcttgatcaatcccatatgttactcaacaatggaggtggcaataatccgcgcaagagaggaagaacagcgccaacagctactactacaacgacaacaatcaataaattatgtatgcaacctcaaactcagcctcagcctctgtcaacaactcagttaatagacctatctcaactccacaaccatcgaagttatcatcctcaaccaaatccaaatgtcgtgtctactggccttcgtttatcttttggtgaccaacaccaccaacaacaacagaatcatcattaccaacagcagaattttggcactagtacatgtcaatcctctgctttgttatcaatatcagaagatttctccacccaaattaaacggcaacgagatgagattgatcaattccttcaagcccagggggagcagctgaggcgcgcattagcagagaaaagacagcagcactaccgtgcgctattaggcgcagcggaggaatcaatagccagacgattaagggaaagtgaagcggaagtccagagggccacgcgcaaaaacgccgagttagaagcacgtgcgtcgcaactcagcattgaggcacaagtttggcaggcaaaggcaaggacccaggaggtaacagcaacttccctgcaggcccaactgcagcaggctataatgaacgggggagtggtgcaggatagcaggagaggggatggtggaacaggatgttcggggggagttgaaggccagggccaggctgaggatgctgagtcggcttatgttgatcctgaccgggtcaccgtcgttccaggccgaccaagctgcaaatcgtgtcggaaacggatggcttcggttgtgcttctgccgtgtcggcatctttgtgtctgtacagaatgtgaccaaatggtccaagcctgcccactttgcctccatgttagaaattccagtgttgaggtatttctgtgttaa

SEQ ID NO: 1065 - protein, 278 aa, Populus balsamifera subsp. trichocarpa
  misc_feature: Ceres ANNOT ID no.1485401
  misc_feature: Bit score of 146.6 for HMM based on sequences of FIGURE 13.
  misc_feature: Functional Homolog Of Ceres SEEDLINE ID no. ME17578 at SEQ ID NO. 1047
MQPQTQPQPLSTTQLIDLSQLHNHRSYHPQPNPNVVSTGLRLSFGDQHHQQQQNHHYQQQNFGTSTCQSSALLSISEDFSTQIKRQRDEIDQFLQAQGEQLRRALAEKRQQHYRALLGAAEESIARRLRESEAEVQRATRKNAELEARASQLSIEAQVWQAKARTQEVTATSLQAQLQQAIMNGGVVQDSRRGDGGTGCSGGVEGQGQAEDAESAYVDPDRVTVVPGRPSCKSCRKRMASVVLLPCRHLCVCTECDQMVQACPLCLHVRNSSVEVFLC

SEQ ID NO: 1066 - DNA, 1014 bp, Populus balsamifera subsp. trichocarpa
  misc_feature: Ceres ANNOT ID no.1486505
  misc_feature: Encodes the peptide sequence at SEQ ID NO. 1067
atggctcatccccaacaccagtttcaacagcactaccaacctcaacagcaacaacaacaacctaagaatttgaggaatttatatgcaatcgacagccagatttctccggcagtggcttattttaatccctctaatttgcaagatcagtctcagcatcctccctatgtccctccttttcatgtggtggggtttgctccgggtcctgggaatgatggcagtgatgggggacttgaattgcagtggaattatgggctagaacccaagagaaagagattgaaggagcaagactttttggagaataattcccagatttcctctgttgatttcttgcaagcacgatcagtctcaactgggttagggttgtctcttgacaatacccgtgtttcatcttctggtgactcggctttgttatcgcttattggtgatgatattgatagtgaattgcagcgacaggacgtggaggttgataaattcctcaaaattcagggtgatcgactgcggcaaaccatcctagagaaggtccaagccgaccaacttcaaactatctcacttgtggaagagaaggttcttcaaaaacttcgtcagaaagaagcagaggtggagagcatcaataagaagaacatggaacttgaagagaaaatggaacagttgtctatggaagcaggtgcatggcaggaacgggccagatacaatgaaaacatgataaatgccatcaagttcaacatccagcaagtctatgctcaaagtagagatagtaaagaaggttgtggtgacagtgaggtggatgatacagcttcgtgctgcaatggccgtgccattgattttcacctgctttccaatgacaataatgacatgaaggagctgatgacttgtaaggcttgcagagtcaatgaagtttgcatgcttttgttaccttgtaagcatctctgcctctgtaaggattgtgaaagtaagcttagtttttgtcccctgtgtcattcctccaagtttattggcatggaagtttatatgtaa

SEQ ID NO: 1067 - protein, 337 aa, Populus balsamifera subsp. trichocarpa
  misc_feature: Ceres ANNOT ID no.1486505
  misc_feature: Bit score of 553.1 for HMM based on sequences of FIGURE 13.
  misc_feature: Functional Homolog Of Ceres SEEDLINE ID no. ME17578 at SEQ ID NO. 1047
MAHPQHQFQQHYQPQQQQQQPKNLRNLYAIDSQISPAVAYFNPSNLQDQSQHPPYVPPFHVVGFAPGPGNDGSDGGLELQWNYGLEPKRKRLKEQDFLENNSQISSVDFLQARSVSTGLGLSLDNTRVSSSGDSALLSLIGDDIDSELQRQDVEVDKFLKIQGDRLRQTILEKVQADQLQTISLVEEKVLQKLRQKEAEVESINKKNMELEEKMEQLSMEAGAWQERARYNENMINAIKFNIQQVYAQSRDSKEGCGDSEVDDTASCCNGRAIDFHLLSNDNNDMKELMTCKACRVNEVCMLLLPCKHLCLCKDCESKLSFCPLCHSSKFIGMEVYM

SEQ ID NO: 1068 - protein, 303 aa, Arabidopsis thaliana
  misc_feature: Public GI ID no.17065054
  misc_feature: Bit score of 552.5 for HMM based on sequences of FIGURE 13.
  misc_feature: Functional Homolog Of Ceres SEEDLINE ID no. ME17578 at SEQ ID NO. 1047
MAVQAHHMNIFSQFISPNRDCVKFQENMNHGEFEFTGEVPLITGESFAVEPLAAKANFNKAESGLSYNFTVPPLSTKRQRDFQFSDSNAPVKRRSVAFDSSSPSLINVELVSQIQNQQQSEIDRFVAQQTEKLRIEIEARQQTQTRMLASAVQNVIAKKLKEKDDEIVRIRNLNWVLQERVKSLYVENQIWRDIAQTNEANANTLRTNLDQVLAQLETFPTASAVVEDDAESSCGSCCGDGGGEAVTAVGGGCKRCGEREASVLVLPCRHLCLCTVCGGSALLRTCPVCDMVMNASVHVNMSS

SEQ ID NO: 1069 - protein, 294 aa, Arabidopsis thaliana
  misc_feature: Public GI ID no.30694690
  misc_feature: Bit score of 431.1 for HMM based on sequences of FIGURE 13.
  misc_feature: Functional Homolog Of Ceres SEEDLINE ID no. ME17578 at SEQ ID NO. 1047
MAVEARHMNLFSSQYITNRECVKSQTNMNNGQQIAGGGFPVTIGDRNLQYIDPINSFNKSESELTAISKRQRDSTFDSDALIASQKRRAIAFSPASLIDAELVSQIQQQNSEIDRFVAQQTETLRIELEARQRTQTRMLASAVQNAILKKLKAKDEEIIRMGKLNWVLQERVKNLYVENQIWRDLAQTNEATANNLRSNLEQVLAQVDDLDAFRRPLVEEADDAESSCGSCDGGDVTAVVNGGCKRCGELTASVLVLPCRHLCLCTVCGSSALLRTCPVCDMVMTASVHVNMSS

SEQ ID NO: 1070 - DNA, 1114 bp, Arabidopsis thaliana
  misc_feature: Ceres CLONE ID no.12997
  misc_feature: Encodes the peptide sequence at SEQ ID NO. 1071
accagtcttcttcttcttcctccaaactctctctttctctctcgagaaccttaagaaaacgttacaaatggctgttgaagcaagacacatgaatctcttctcttctcaatacattaccaacagagaatgtgttaaatctcaaacgaatatgaacaacggacaacaaatcgccggcggtggttttccgttaacaatcggtgatcggaatttacagtacatagatccgattaacagcttcaacaaatcagaaagcgagctcacagctatttcaaaacgtcagagagattcaacgtttgattcagacgctttaatcgcatctcagaaacgcagagcaatcgcgttttctccggcgtcattaatcgacgcagagttagtttcacagatccaacagcaaaactcagaaatcgatagattcgtagcgcaacaaacggaaacgttgagaatcgaattagaagcgagacaaagaacgcaaacgcggatgttagcgtcagcggtacaaaacgcgatattgaaaaagctgaaagcgaaagacgaagagattataagaatggggaaattaaactgggttttacaagaacgtgtgaagaatctctacgtagagaatcagatctggcgtgatttagcacaaactaatgaagctactgctaataatctcagatcaaatctcgaacaagttttagctcaagtcgatgatttagatgcgtttcgtcgtcctttggttgaagaagctgatgatgcagaatctagctgtggaagctgtgacggaggtgatgtaacggcggttgttaacggaggatgtaaacggtgcggtcaattaacggcgagtgtgttggtgttgccttgtcgtcatttgtgtttgtgtacggtttgtggatcgtcggctttgttacggacgtgtcctgtatgtgatatggtcatgactgctagtgtacatgttaacatgtcatcatgaccattttatttatttttttcaagttaaaaagtttagttttattgttttgatttgaggattaaagagtaaaattaggtgaaaaacaaaagaagaagaaatgtgactcttttttgactttttttggagacttttaaagatggaattgattcattatttgtttgc

SEQ ID NO: 1071 - protein, 294 aa, Arabidopsis thaliana
  misc_feature: Ceres CLONE ID no.12997
  misc_feature: Bit score of 428.0 for HMM based on sequences of FIGURE 13.
  misc_feature: Functional Homolog Of Ceres SEEDLINE ID no. ME17578 at SEQ ID NO. 1047
MAVEARHMNLFSSQYITNRECVKSQTNMNNGQQIAGGGFPLTIGDRNLQYIDPINSFNKSESELTAISKRQRDSTFDSDALIASQKRRAIAFSPASLIDAELVSQIQQQNSEIDRFVAQQTETLRIELEARQRTQTRMLASAVQNAILKKLKAKDEEIIRMGKLNWVLQERVKNLYVENQIWRDLAQTNEATANNLRSNLEQVLAQVDDLDAFRRPLVEEADDAESSCGSCDGGDVTAVVNGGCKRCGQLTASVLVLPCRHLCLCTVCGSSALLRTCPVCDMVMTASVHVNMSS

SEQ ID NO: 1072 - protein, 267 aa, Arabidopsis thaliana
  misc_feature: Public GI ID no.30694694
  misc_feature: Bit score of 369.7 for HMM based on sequences of FIGURE 13.
  misc_feature: Functional Homolog Of Ceres SEEDLINE ID no. ME17578 at SEQ ID NO. 1047
MNNGQQIAGGGFPVTIGDRNLQYIDPINSFNKSESELTAISKRQRDSTFDSDALIASQKRRAIAFSPASLIDAELVSQIQQQNSEIDRFVAQQTETLRIELEARQRTQTRMLASAVQNAILKKLKAKDEEIIRMGKLNWVLQERVKNLYVENQIWRDLAQTNEATANNLRSNLEQVLAQVDDLDAFRRPLVEEADDAESSCGSCDGGDVTAVVNGGCKRCGELTASVLVLPCRHLCLCTVCGSSALLRTCPVCDMVMTASVHVNMSS

SEQ ID NO: 1073 - protein, 355 aa, Arabidopsis thaliana
  misc_feature: Public GI ID no.42572167
  misc_feature: Bit score of 360.2 for HMM based on sequences of FIGURE 13.
  misc_feature: Functional Homolog Of Ceres SEEDLINE ID no. ME17578 at SEQ ID NO. 1047
MAVDAHHLFLSPPQLFSNRELTMNNNTMEPTSGGFCNNNQTGYGVVSPFSVPNHTSTTTTATPPLLHVYGGSDTIPTTAGYYADGATNLDCEFFPLPTRKRSRDSSRSNYHHLLLQNPRSSSCVNAATTTTTTTLFSFLGQDIDISSHMNQQQHEIDRFVSLHMERVKYEIEEKRKRQARTIMEAIEQGLVKRLRVKEEERERIGKVNHALEERVKSLSIENQIWRDLAQTNEATANHLRTNLEHVLAQVKDVSRGAGLEKNMNEEDDAESCCGSSCGGGGEETVRRRVGLEREAQDKAERRRRRMCRNCGEEESCVLLLPCRHLCLCGVCGSSVHTCPICTSPKNASVHVNMSS

SEQ ID NO: 1074 - protein, 355 aa, Arabidopsis thaliana
  misc_feature: Public GI ID no.110739742
  misc_feature: Bit score of 358.8 for HMM based on sequences of FIGURE 13.
  misc_feature: Functional Homolog Of Ceres SEEDLINE ID no. ME17578 at SEQ ID NO. 1047
MAVDAHHLFLSPPQLFSNRELTMNNNTMEPTSGGFCNNNQTGYGVVSPFSAPNHTSTTTTATPPLLHVYGGSDTIPTTAGYYADGATNLDCEFFPLPTRKRSRDSSRSNYHHLLLQNPRSSSCVNAATTTTTTTLFSFLGQDIDISSHMNQQQHEIDRFVSLHMERVKYEIEEKRKRQARTIMEAIEQGLVKRLRVKEEERERIGKVNHALEERVKSLSIENQIWRDLAQTNEATANHLRTNLEHVLAQVKDVSRGAGLEKNMNEEDDAESCCGSSCGGGGEETVRRRVGLEREAQDKAERRRRRMCRNCGEEESCVLLLPCRHLCLCGVCGSSVHTCPICTSPKNASVHVNMSS

SEQ ID NO: 1075 - protein, 358 aa, Arabidopsis thaliana
  misc_feature: Public GI ID no.18412263
  misc_feature: Bit score of 348.8 for HMM based on sequences of FIGURE 13.
  misc_feature: Functional Homolog Of Ceres SEEDLINE ID no. ME17578 at SEQ ID NO. 1047
MAVDAHHLFLSPPQLFSNRELTMNNNTMEPTSGGFCNNNQTGYGVVSPFSVPNHTSTTTTATPPLLHVYGGSDTIPTTAGYYADGATNLDCEFFPLPTRKRSRDSSRSNYHHLLLQNPRSSSCVNAATTTTTTTLFSFLGQDIDISSHMNQQQHEIDRFVSLHLYQMERVKYEIEEKRKRQARTIMEAIEQGLVKRLRVKEEERERIGKVNHALEERVKSLSIENQIWRDLAQTNEATANHLRTNLEHVLAQVKDVSRGAGLEKNMNEEDDAESCCGSSCGGGGEETVRRRVGLEREAQDKAERRRRRMCRNCGEEESCVLLLPCRHLCLCGVCGSSVHTCPICTSPKNASVHVNMSS

SEQ ID NO: 1076 - DNA, 1212 bp, Arabidopsis thaliana
  misc_feature: Ceres CLONE ID no.36412
  misc_feature: Encodes the peptide sequence at SEQ ID NO. 1077
atcttcttctctctaaacctctccttcaatggccgtcgatgctcaccatctctttctttctcctcctcaactcttctccaacagagaattaacgatgaataataacactatggaaccaactagtggcggtttctgcaataacaatcaaaccggttacggcgtcgtttcacctttctccgttccaaaccatacatcaacaacaacaacagcaacgcctcctcttcttcatatgtacggcggctctgatactattcccaccaccgccggttactacgccgatggtgctactaatctcgactgtgaatttttccctttaccaacgagaaaacgctcaagagattcttcaagatcaaattatcatcatcttcttcttcagaacccgagatcatcatcatgtgttaacgctgctactacaacaactacaacaactccgttctcgtttcttggccaagacattgatatctcctctcacatgaatcaacaacaacacgaaatagatcgattcgtctcccttcacttatatcagatggagagagtgaaatatgagatagaagagaagaggaaaagacaagcgagaacgataatggaggcgatagagcaaggactggttaaaaggcttcgtgtcaaagaagaagaaagagagaggatcggcaaggttaaccacgcgcttgaggagcgagtgaagtcactttctatagagaaccaaatctggagagaccttgctcagacgaacgaagccacggctaaccacctccgaaccaacctcgagcatgttctggcgcaggttaaggacgtatcacgcggcgcaggattagagaaaaacatgaacgaagaggacgatgcggagtcgtgctgcggaagcagctgtggtggtggtggtgaagaaacggtaaggcgcagggtaggattagaaagggaggcgcaggataaggcggagaggaggaggaggaggatgtgtagaaactgtggggaggaggaatcgtgtgtgttgctgttaccgtgcagacacttgtgcttgtgtggagtatgcgggtccagtgtgcacacgtgtcccatctgtacatctcctaaaaacgctagcgttcatgtcaacatgtcatcttgaccccgtcccgtttatggaatactcctcttcttcttttttttttttttttttgttctttagaaaatttgtaaggatattttagttgaatattattattatttttagct

SEQ ID NO: 1077 - protein, 358 aa, Arabidopsis thaliana
  misc_feature: Ceres CLONE ID no.36412
  misc_feature: Bit score of 348.0 for HMM based on sequences of FIGURE 13.
  misc_feature: Functional Homolog Of Ceres SEEDLINE ID no. ME17578 at SEQ ID NO. 1047
MAVDAHHLFLSPPQLFSNRELTMNNNTMEPTSGGFCNNNQTGYGVVSPFSVPNHTSTTTTATPPLLHMYGGSDTIPTTAGYYADGATNLDCEFFPLPTRKRSRDSSRSNYHHLLLQNPRSSSCVNAATTTTTTTPFSFLGQDIDISSHMNQQQHEIDRFVSLHLYQMERVKYEIEEKRKRQARTIMEAIEQGLVKRLRVKEEERERIGKVNHALEERVKSLSIENQIWRDLAQTNEATANHLRTNLEHVLAQVKDVSRGAGLEKNMNEEDDAESCCGSSCGGGGEETVRRRVGLEREAQDKAERRRRRMCRNCGEEESCVLLLPCRHLCLCGVCGSSVHTCPICTSPKNASVHVNMSS

SEQ ID NO: 1078 - protein, 335 aa, Arabidopsis thaliana
  misc_feature: Public GI ID no.18399792
  misc_feature: Bit score of 349.6 for HMM based on sequences of FIGURE 13.
  misc_feature: Functional Homolog Of Ceres SEEDLINE ID no. ME17578 at SEQ ID NO. 1047
MAVEAHHLNPLFSSNREMIHPVEASGVVYNTQMRYGTVPTFNPTVECQTSLFNPIYNISPVDRLVHQSMKPTIQSVDSSLTFNSDNNVDFLRPVSSRKRSREESVVLNPSAYMQIQKNPTDPLMFLGQDLSSNVQQHHFDIDRLISNHVERMRMEIEEKRKTQGRRIVEAVEQGLMKTLRAKDDEINHIGKLNLFLEEKVKSLCVENQIWRDVAQSNEATVNALRSNLQQVLAAVERNRWEEPPTVADDAQSCCGSNDEGDSEEERWKLAGEAQDTKKMCRVGMSMCRSCGKGEASVLLLPCRHMCLCSVCGSSLNTCPICKSPKTASLHVNLSS

SEQ ID NO: 1079 - DNA, 1250 bp, Arabidopsis thaliana
  misc_feature: Ceres CLONE ID no.924
  misc_feature: Encodes the peptide sequence at SEQ ID NO. 1080
gttttttagtttctccttctctctgcagaaaccgtaattaaaaaccccccacaacttcttcaacataacgtcttcttcttccatctttcgttgcattcacgtttttaaaggttctctgaatcactccattaaaaatagctttgaacaagttttctcaatagtcaacaaaaacaatggccgttgaagctcaccatctaaatcctctgttctcttccaacagagaaatgattcatcccgttgaagcaaacggtgtagtctataacacccagatgagatacggcaccgttccgacgtttaaccccaccgtggaatgtcaaacttctctgtttaacccaatctacaacatctcaccagtcgatggtttggttcatcaatccatgaaaccaacgatacagtccgttgatagttctctcacattcaacagcgacaacaacgtcgattttcttcgtcctgtgtcgtcgagaaaacgttctagagaagaatccgttgttctaaaaccttccgcttatatgcaaattcagaaaaatcccaccgatcctcttatgttccttggccaagacttgtcttctaacgttcaacaacatcatttcgatatcgatcgtttgatctctaatcacgttgagagaatgagaatggagattgaagagaagagaaaaacacaagggagaaggatagtggaagccgtcgaacaaggtttgatgaagacactaagagccaaagacgatgagataaatcacatcgggaaactaaacctctttctcgaagagaaggttaagtctttgtgcgtagagaatcagatatggcgtgacgtggcacagtctaatgaagccaccgtaaacgccctacgttctaacttgcaacaagttctcgcagccgtggagcgtaaccggtgggaggagccgcccacggtggctgacgacgcacagtcttgttacggtagcaacgacgaaggtgatagcgaggaagaacggtggaagttagcgggagaggcgcaggatacgaaaaagatgtgtagggtagggatgagtatgtgtagaagctgtgggaaaggagaagcaagtgtgttactgttaccgtgcagacacatgtgtctatgttctgtgtgtggctcttcactcaacacttgtcctatatgtaaatctccaaagaccgctagtctacatgttaatctttcctcttagacctaaccaataccagtaaaatgtaaatgcccccaaaaaaagtaaatagtagacaaaagtttcttggtc

SEQ ID NO: 1080 - protein, 335 aa, Arabidopsis thaliana
  misc_feature: Ceres CLONE ID no.924
  misc_feature: Bit score of 339.5 for HMM based on sequences of FIGURE 13.
  misc_feature: Functional Homolog Of Ceres SEEDLINE ID no. ME17578 at SEQ ID NO. 1047
MAVEAHHLNPLFSSNREMIHPVEANGVVYNTQMRYGTVPTFNPTVECQTSLFNPIYNISPVDGLVHQSMKPTIQSVDSSLTFNSDNNVDFLRPVSSRKRSREESVVLKPSAYMQIQKNPTDPLMFLGQDLSSNVQQHHFDIDRLISNHVERMRMEIEEKRKTQGRRIVEAVEQGLMKTLRAKDDEINHIGKLNLFLEEKVKSLCVENQIWRDVAQSNEATVNALRSNLQQVLAAVERNRWEEPPTVADDAQSCYGSNDEGDSEEERWKLAGEAQDTKKMCRVGMSMCRSCGKGEASVLLLPCRHMCLCSVCGSSLNTCPICKSPKTASLHVNLSS

SEQ ID NO: 1081 - protein, 300 aa, Arabidopsis thaliana
  misc_feature: Public GI ID no.15238000
  misc_feature: Bit score of 104.2 for HMM based on sequences of FIGURE 13.
  misc_feature: Functional Homolog Of Ceres SEEDLINE ID no. ME17578 at SEQ ID NO. 1047
MAVQAHHHPSTLFFLNNGQEGNDQPHKSQFHSINAGVDTRKRAREVSSVIDLDITAAPMNPPPQTPPQVIGRRQNPNVVSTGLRLSREQSQNQEQRFLSFPITGDVAGEIKSQTDELNRFLQIQGEQLKRMLAENSERNYRELLRTTEESVRRRLREKEAEIEKATRRHVELEARATQIETEARAWQMRAAAREAEATSLQAQLHQAVVVAHGGGVITTVEPQSGSVDGVDEAEDAESAYVDPDRVEMIGPGCRICRRRSATVLALPCRHLVMCTECDGSVRICPLCLSTKNSSVEVFYS

SEQ ID NO: 1082 - DNA, 1063 bp, Brassica napus
  misc_feature: Ceres CLONE ID no.1077781
  misc_feature: Encodes the peptide sequence at SEQ ID NO. 1083
accacaaccctccttcctctttctctcccttcgttcatagcctcttggatcctttttaacaaacgtatctatgcctgttcaagctaggcacatgaacattttctctcctcagttgttatcaaacagagttaacttcaaacaagacatgaaccacggtgaatttattaccggagaaactctcgccgtagatcctttgtcaaacgcggctgcgaaacctagcttcaacaaatcagaaagtggtctcacttacaacttcaactccttcaacgttgttccaccgcccagaaaacgtccgcgagtatctcaataccttgactcagacgctcgctttgcgtctgcggttaaactggggtccgggccatttggttcaccatcatcgttgataaacgctgaactcgtgtcacacatccaaaaccaacaacagttagagattgatcggttcgtagctcagcaaacggagaagcttagaatagaaatcgaagctcgtcagcaaactcaaacgcagatgctagcgtctgccgttcaaaacgcgttagccatgaagttaaaagagaaagacgacgaaattttacggatgagaaaccttaactgcgttttacaagagcgggtaaagagtctttttgttgaaaatcaaatatggcgagatatagctcagaccaacgaggcacaagctaacaatcttcgaacaaacctcgaccaagttcttgctcaaatcgaaacgctaccaaccgctgtagaaaacgacgtggagtcgagctgcggaagttgcgttgaaggtggtgaagctattacagcggttagtggcggttgcaagcggtgcggtgagagagaagcgagtgtgctggtgttaccttgtcgtcatttgtgtttgtgtacggtctgtggttcggctttgttacgaacttgtccggtttgtgattcggtcatgaacgctagtgtacatgttaacatgtcttcttaactttttttctcttcttttagtgctattattaaattcgtattttgtttttctagaaactttagctgtttaattcttttatttttataagtacagtttttttgt

SEQ ID NO: 1083 - protein, 296 aa, Brassica napus
  misc_feature: Ceres CLONE ID no.1077781
  misc_feature: Bit score of 517.4 for HMM based on sequences of FIGURE 13.
  misc_feature: Functional Homolog Of Ceres SEEDLINE ID no. ME17578 at SEQ ID NO. 1047
MPVQARHMNIFSPQLLSNRVNFKQDMNHGEFITGETLAVDPLSNAAAKPSFNKSESGLTYNFNSFNVVPPPRKRPRVSQYLDSDARFASAVKLGSGPFGSPSSLINAELVSHIQNQQQLEIDRFVAQQTEKLRIEIEARQQTQTQMLASAVQNALAMKLKEKDDEILRMRNLNCVLQERVKSLFVENQIWRDIAQTNEAQANNLRTNLDQVLAQIETLPTAVENDVESSCGSCVEGGEAITAVSGGCKRCGEREASVLVLPCRHLCLCTVCGSALLRTCPVCDSVMNASVHVNMSS

SEQ ID NO: 1084 - DNA, 1187 bp, Glycine max
  misc_feature: Ceres CLONE ID no.471026
  misc_feature: Encodes the peptide sequence at SEQ ID NO. 1085
attcattcagcctccctaatacttagccacatctattgcatgctctctcccctcatctccttcttattctctgcaatatatcatagtgccaaactctcatctttctctctctctctcacacacacaatataagtccaccctaaacaatcaccatggcagttgaagctagttacatgaatctcttgccttctcagttactcactaacagagaactcatcaaatccaatcaacagctacagcatcaattaaactctgattacatgtacaacactactacccagatggattcttcttcagctttgcctcaaccagcaacaatgcctgaatcactcttgtccttctaccaatccaacttttgtgatccaaacaaggcagatagtggtctcacctaccatattcctctccagagaaagcgttcaagagatttcaccaccgaattaacctctctcccagctcaccagaagaacaaaatctcctctgatccttcctttctcaaccaagagattctctaccaatttcagaaccaacaatcggaaattgatcgagtccttgcccatcatactgagaaagtgagaatggagctggaggaacaaaaaatgaggcaatcaaggatgtttgtgagcgcaatccaagaagcaatggcgaagaagctgaaggaaaaagaccaagagattcagagaatggggaagctgaattgggcccttcaagaaagagtcaaaagcttgtgcatggagaaccaaatttggagggaattggcacaaacaaacgaatccacagccaactacctacgaagcaatttggaacaagtgctggcacatgtcggcgaggaacgcgccaccgtggccgatgatgctcaatctagctgtggcagcaatgatgcggcggaggccggaaacgacactgcggcgtccgcggcggcgaccggtcgtggtaggttgtgtaagaactgtgggctgagggagtcagtggtgctgttgttgccatgcaggcatctttgcctttgcacaatgtgtgggtccacagtaaggaattgtcctatttgtgactctgacatggatgctagcgtgcatgtcaatctctcttagtacaactttttttcttttttctttttacataattttcattgtagagtttagaacaacagaaactagaaaaaaaatagtttatcttgtcaaaaagacagttag

SEQ ID NO: 1085 - protein, 310 aa, Glycine max
  misc_feature: Ceres CLONE ID no.471026
  misc_feature: Bit score of 571.1 for HMM based on sequences of FIGURE 13.
  misc_feature: Functional Homolog Of Ceres SEEDLINE ID no. ME17578 at SEQ ID NO. 1047
MAVEASYMNLLPSQLLTNRELIKSNQQLQHQLNSDYMYNTTTQMDSSSALPQPATMPESLLSFYQSNFCDPNKADSGLTYHIPLQRKRSRDFTTELTSLPAHQKNKISSDPSFLNQEILYQFQNQQSEIDRVLAHHTEKVRMELEEQKMRQSRMFVSAIQEAMAKKLKEKDQEIQRMGKLNWALQERVKSLCMENQIWRELAQTNESTANYLRSNLEQVLAHVGEERATVADDAQSSCGSNDAAEAGNDTAASAAATGRGRLCKNCGLRESVVLLLPCRHLCLCTMCGSTVRNCPICDSDMDASVHVNLS

SEQ ID NO: 1086 - DNA, 1144 bp, Glycine max
  misc_feature: Ceres CLONE ID no.1626330
  misc_feature: Encodes the peptide sequence at SEQ ID NO. 1087
attctctatatttctctccctctttctcttcacactctggctttcattcatttgcattgcgagaaaacgaaaaactctgaaaaccgcaacaaactcacactcactcacaagagagtaacaaccaaacaaacaacaaatctctcatcatggcagttgaggctcctccgcacaacatgaatctcttcccctcgcagttactaaccgccagagaaatgatgaaaccgaatcttggcttctacaccgcacagcaaacggaagctgctgctacgcctcttcttcagtcaacggcgttaccttttctccaccaatccgatagtggcctcacctgccacgtcaccaccaccgctccgacgagaaaacgctccagagactccatcaccactgtaccaaacgcgcttctaccacttccgcagaagaacaaactatcatcatcatcatcatcatcaccaccaccgtccattctcgatcaagagcttctcttccatttccagaaccagcaatccgagatcgaccgcttcatcgtacaacacacggagaaagtgagaatggagatggcggagcagcgagtgaggcaatcgagaatgttgataacggcgattcaagaagccgtggcgaagaaactgaaggagaaagacgaagagattcagcgcgtggggaagttgaattgggttctgcaagaacgagtgaagagcatctgcgtggagaatcagatttggaaagaactagcgcaaacaaacgaagccaccgcgaataatcttcggaacaatctagaacaagttctggcgcacgttagcgaagatcaccataaccacaaccaccacgccgtcgaagcggcggaatcgagttgcgcgagcaacaacaacaacaaccaccaccaccaccgcgaggaggaggaggtttgcggcggatacgagcgaaacgacggcgttttggggaagaggatgtgcaatcagtgtggggtaagagaatcgatagtgctgttgttgccatgtaggcatctgtgtttgtgcacaatgtgtgggtccaccgtacacaattgccctctttgtcaatctggcattaatgccagtgttcatgttaattactcttaggaggagttttttttctccttcttcttttcttttcttaaaaaaaaaaaaaaaaa

SEQ ID NO: 1087 - protein, 314 aa, Glycine max
  misc_feature: Ceres CLONE ID no.1626330
  misc_feature: Bit score of 402.6 for HMM based on sequences of FIGURE 13.
  misc_feature: Functional Homolog Of Ceres SEEDLINE ID no. ME17578 at SEQ ID NO. 1047
MAVEAPPHNMNLFPSQLLTAREMMKPNLGFYTAQQTEAAATPLLQSTALPFLHQSDSGLTCHVTTTAPTRKRSRDSITTVPNALLPLPQKNKLSSSSSSSPPPSILDQELLFHFQNQQSEIDRFIVQHTEKVRMEMAEQRVRQSRMLITAIQEAVAKKLKEKDEEIQRVGKLNWVLQERVKSICVENQIWKELAQTNEATANNLRNNLEQVLAHVSEDHHNHNHHAVEAAESSCASNNNNNHHHHREEEEVCGGYERNDGVLGKRMCNQCGVRESIVLLLPCRHLCLCTMCGSTVHNCPLCQSGINASVHVNYS

SEQ ID NO: 1088 - DNA, 1280 bp, Glycine max
  misc_feature: Ceres CLONE ID no.1650419
  misc_feature: Encodes the peptide sequence at SEQ ID NO. 1089
actctttgtatatttttctttctcccttcttccttcacatccattgctctctcttctctcacccaacaaaaactcattccttttaagcacaatagaagaagaagaacaacaacaacaacagcagcatatctcagatatcatcatggccgttgaagcgcgccatctcaatctcttcccttctcaactcatcaccaaccggcaagtgatggattctggtgaggcgaatatgatgaacatgtacaacaacagcactccgattggtggttactcttcgtttctgccgttatccggcgccgtcacggagacggcgcttccgtcctcggttttcaaccattctctcgccaacgccgtcaaatccgaaagcggcgttacctacaacaacaacaacaacaacaacaacgtttctgtttctcccatgtcgagaaagcgttcccgagataataacaacaattacggttacaacaacaacaacaacgattcattttcgtttctcggccaagacgtttctctccagatccagcagcagcaactcgacatcgagcatttaatcatgcaacgcatggagaaggtgagaatggagattgatgagaagaggaagaggcaagcgaggaggatcattgaagcgattgaggttggagtgatgaagaagctgaagacgaaggaagaggagatagagaaaatcggaaaactgaattgggcgttggaagagaaagtgaagcatctctgcatggagaatcaggtgtggcgtaacatagcggaaaccaacgaagccacagcgaatgctctgcggtgtaatttagagcaggttctcgcgcagcgcggcggaatggcggcggaggaagacgtcggcggaggcgccaccgtgtgcggcggcgcggagatggacgacgccgagtcctgctgcgggagcaccgaggaggacggtttagaaaaggaaacggggggttggcgcacgttagcggggtgcgcaggggtgaaggataaggagggtggtggtaatgggaggttgtgcaggaactgtaggaaggaagagtcttgtgtgctgattttgccgtgccgtcatttgtgcttgtgtactgtgtgtgggtcttcactccacatttgtcccatttgtaaatcctataagactgctagtgtgcatgttaacatgtcctaatttttggataagataggactctaggaccttaatgagaatcatctctttgtctcaactcaatctcataaaaggaaaaaatatatcaaattttcataaattgacaaattgttgaaaaaaaaaaaaa

SEQ ID NO: 1089 - protein, 337 aa, Glycine max
  misc_feature: Ceres CLONE ID no.1650419
  misc_feature: Bit score of 377.8 for HMM based on sequences of FIGURE 13.
  misc_feature: Functional Homolog Of Ceres SEEDLINE ID no. ME17578 at SEQ ID NO. 1047
MAVEARHLNLFPSQLITNRQVMDSGEANMMNMYNNSTPIGGYSSFLPLSGAVTETALPSSVFNHSLANAVKSESGVTYNNNNNNNNVSVSPMSRKRSRDNNNNYGYNNNNNDSFSFLGQDVSLQIQQQQLDIEHLIMQRMEKVRMEIDEKRKRQARRIIEAIEVGVMKKLKTKEEEIEKIGKLNWALEEKVKHLCMENQVWRNIAETNEATANALRCNLEQVLAQRGGMAAEEDVGGGATVCGGAEMDDAESCCGSTEEDGLEKETGGWRTLAGCAGVKDKEGGGNGRLCRNCRKEESCVLILPCRHLCLCTVCGSSLHICPICKSYKTASVHVNMS

SEQ ID NO: 1090 - DNA, 1306 bp, Glycine max
  misc_feature: Ceres CLONE ID no.1641329
  misc_feature: Encodes the peptide sequence at SEQ ID NO. 1091
aactcattccttttaagcacaatagaagaagaagaacaacaacaacaacagcagcatatctcagatatcatcatggccgttgaagcgcgccatctcaatctcttcccttctcaactcatcaccaaccggtatatatatcactaccccttcctcttctaatctttcttaaaaattcttgtttttgtttattatttactattattctcacttttgtgaaatttcttaaatgattattcaggcaagtgatggattctggtgaggcgaatatgatgaacatgtacaacaacagcactccgattggtggttactcttcgtttctgccgttatccggcgccgtcacggagacggcgcttccgtcctcggttttcaaccattctctcgccaacgccgtcaaatccgaaagcggcgttacctacaacaacaacaacaacaacaacaacgtttctgtttctcccatgtcgagaaagcgttcccgagataataacaacaattacggttacaacaacaacaacaacgattcattttcgtttctcggccaagacgtttctctccagatccagcagcagcaactcgacatcgagcatttaatcatgcaacgcatggagaaggtgagaatggagattgatgagaagaggaagaggcaagcgaggaggatcattgaagcgattgaggttggagtgatgaagaagctgaagacgaaggaagaggagatagagaaaatcggaaaactgaattgggcgttggaagagaaagtgaagcatctctgcatggagaatcaggtgtggcgtaacatagcggaaaccaacgaagccacagcgaatgctctgcggtgtaatttagagcaggttctcgcgcagcgcggcggaatggcggcggaggaagacgtcggcggaggcgccaccgtgtgcggcggcgcggagatggacgacgccgagtcctgctgcgggagcaccgaggaggacggtttagaaaaggaaacggggggttggcgcacgttagcggggtgcgcaggggtgaaggataaggagggtggtggtaatgggaggttgtgcaggaactgtaggaaggaagagtcttgtgtgctgattttgccgtgccgtcatttgtgcttgtgtactgtgtgtgggtcttcactccacatttgtcccatttgtaaatcctataagactgctagtgtgcatgttaacatgtcctaatttttggataagataggactctaggaccttaatgagaatcatctctttgtctcaactcaatctcataaaaggaaaaaatatatcaaatttcaaaaaaaaaaaaaaaaaaa

SEQ ID NO: 1091 - protein, 316 aa, Glycine max
  misc_feature: Ceres CLONE ID no.1641329
  misc_feature: Bit score of 327.7 for HMM based on sequences of FIGURE 13.
  misc_feature: Functional Homolog Of Ceres SEEDLINE ID no. ME17578 at SEQ ID NO. 1047
MDSGEANMMNMYNNSTPIGGYSSFLPLSGAVTETALPSSVFNHSLANAVKSESGVTYNNNNNNNNVSVSPMSRKRSRDNNNNYGYNNNNNDSFSFLGQDVSLQIQQQQLDIEHLIMQRMEKVRMEIDEKRKRQARRIIEAIEVGVMKKLKTKEEEIEKIGKLNWALEEKVKHLCMENQVWRNIAETNEATANALRCNLEQVLAQRGGMAAEEDVGGGATVCGGAEMDDAESCCGSTEEDGLEKETGGWRTLAGCAGVKDKEGGGNGRLCRNCRKEESCVLILPCRHLCLCTVCGSSLHICPICKSYKTASVHVNMS

SEQ ID NO: 1092 - DNA, 1438 bp, Glycine max
  misc_feature: Ceres CLONE ID no.1620406
  misc_feature: Encodes the peptide sequence at SEQ ID NO. 1093
tcttgtgtgtttgtgattattgccctgtcctctgcattcctttaattcccccattcatttcccacctttctctcacaaaccaaactcatcatggccgttcaagctcaatacccttccaatgtactactcttcctaaacagcaaaaccgggcaagaagcacatgattattcattgcaatctccgccaggacaacaactccttgatcaatcccatatgctattcaacaacggaggtactaattctcgaaagagaggaagagaaacaactgcagctaccgggattgcgccaaacgttatcaattcattctctttgcaatcccaatctccacaggcacagctcatagaactcactcaacttcataatcaaaatgtagtctccaccgggttacgcttatcctttggtgaccaacaacaaagacaacaattacaacatcaacatcaacatcatgggtgtcactcctctcctttcgtatctctactatccgaaggcttgtcttctcaaatcaaacaacagcgtgacgaaatagaccaattccttcaagcccaggaggagcaattgcggcgggcattagcggagaagagacagagacattatcggacgctgctaagggcagcggaggaatcggtgttgcggaggctgagggagaaggaagcggagttggagaaagccacgcgccataacgcggagttggaggcacgcgcgacgcagcttagcgttgaggcgcagctttggcaggcgagggcgaaggcgcaggaagcaacggcggcggcgttgcaggcgcagctgcagcaggctatgatgatcggcgacggtgagaacggtggcgggggagggctatcgtgcgccgggggcggagcggaggatgctgagtcagcgtacgttgacccggatcgagtgggtcccactccgaaatgcagagggtgcgcgaaacgggtggcttcggtggtggtgttgccgtgtcgccacctatgcatctgcgccgaatgcgacacgcattttcgggcgtgccccgtttgcctcaccgttaaaaattcaaccgttgaagtctatctatcttaaaagtttaaatagattaaaatgaaaaaaaaaaaagattactttctctctctggtctctatctttttaatgaatggaaattgaaggaggacctttttttagtcgttgtacatgatgatggtgagaaaactgagaaggttgggtagtttggccgtgagacccgatgttttttctttttttcttttttagttttcaatcctccttacattttatatttcttagtgatgtacatggatggccaaatgggtagtggagtggcctttaatttttttttagctgttgggatatttctctcctttagaaactgatatttattatattctttcttggataaatacttgactgagaatctgagatgcctttccaaaaaaaaaaaaaaaaa

SEQ ID NO: 1093 - protein, 322 aa, Glycine max
  misc_feature: Ceres CLONE ID no.1620406
  misc_feature: Bit score of 171.3 for HMM based on sequences of FIGURE 13.
  misc_feature: Functional Homolog Of Ceres SEEDLINE ID no. ME17578 at SEQ ID NO. 1047
MAVQAQYPSNVLLFLNSKTGQEAHDYSLQSPPGQQLLDQSHMLFNNGGTNSRKRGRETTAATGIAPNVINSFSLQSQSPQAQLIELTQLHNQNVVSTGLRLSFGDQQQRQQLQHQHQHHGCHSSPFVSLLSEGLSSQIKQQRDEIDQFLQAQEEQLRRALAEKRQRHYRTLLRAAEESVLRRLREKEAELEKATRHNAELEARATQLSVEAQLWQARAKAQEATAAALQAQLQQAMMIGDGENGGGGGLSCAGGGAEDAESAYVDPDRVGPTPKCRGCAKRVASVVVLPCRHLCICAECDTHFRACPVCLTVKNSTVEVYLS

SEQ ID NO: 1094 - DNA, 1139 bp, Glycine max
  misc_feature: Ceres CLONE ID no.546832
  misc_feature: Encodes the peptide sequence at SEQ ID NO. 1095
agatctctcaccttcttcttcttcctctgtgccacccttttgttccatgattgttttttgtgtctgtatcagcttgatctttttgtttttttccttgttgtaaaaacatttcaatctgcaagataattattggcagcttcactaatatcttttaagactacatactttagcctaggcaatcacatttcttgggataatgttgggaggcaacaacggaaattgcttgcttcctgttttcttggacgaaactcaatttcagcatcaaactaatgtgtcaaatcaattgcagttgtttggaaatttacaagctggatgtagtgttgacccagttaattactttggaaatgagcatatcagctccatgattcagcctaataaacgaagcaaggaaatggaagatatatcaaaacaaaggcttcagatttccttaaactacaatgttcatcaagatgatgctgaacgattagcaagtattccaaatcctaaccccgtgtcaacaggattgaggctttcatatgatgatgatgagcgtaactcatctgttacttctgcaagtggaagcatggctgccacaccgtctatcatattgtctcttggtgacaatatcagaactgagcttgataggcagcaagaagagttggaccagtatgttaaacttcaggaacaactgtcaaagggagtgagagacatgaagcaaaagcacatggctgctctccttacctccattgagaaaggtattagcacgaagctaaaggaaaaagacgtggagatagaaaacatgaaccgaaaaaatagggagctggctgaaagaataaagcaggtggctgttgaagtgcaaagctggcattacagagcaaagtataatgagtcaattgtcaatactttaaggaacaaccttcagcaggcaatctcacaaggagctgaacaggggaaggaagggtttggagacagtgaagttgatgatgatgcctcatatatagatcctaataacttcctgaacattctggctgcgcctataaactctactcacaagagctaccaagatatggagaatctgacttgtagagcatgcaaggtgaagacagtttcgatgttgttgatgccttgtaggcacctgtgcttgtgtaaggattgtgagg

SEQ ID NO: 1095 - protein, 314 aa, Glycine max
  misc_feature: Ceres CLONE ID no.546832
  misc_feature: Bit score of 99.7 for HMM based on sequences of FIGURE 13.
  misc_feature: Functional Homolog Of Ceres SEEDLINE ID no. ME17578 at SEQ ID NO. 1047
MLGGNNGNCLLPVFLDETQFQHQTNVSNQLQLFGNLQAGCSVDPVNYFGNEHISSMIQPNKRSKEMEDISKQRLQISLNYNVHQDDAERLASIPNPNPVSTGLRLSYDDDERNSSVTSASGSMAATPSIILSLGDNIRTELDRQQEELDQYVKLQEQLSKGVRDMKQKHMAALLTSIEKGISTKLKEKDVEIENMNRKNRELAERIKQVAVEVQSWHYRAKYNESIVNTLRNNLQQAISQGAEQGKEGFGDSEVDDDASYIDPNNFLNILAAPINSTHKSYQDMENLTCRACKVKTVSMLLMPCRHLCLCKDCE

SEQ ID NO: 1096 - DNA, 1258 bp, Glycine max
  misc_feature: Ceres CLONE ID no.1243138
  misc_feature: Encodes the peptide sequence at SEQ ID NO. 1097
cttctgcgtcgaccacctcgtcatttcttcctttccattttcatttctcggtgttgttgttcttcatccatggcttttcctcagcaccacttccaacagcactaccaaacccaacagcaacaacagccacaaaacaaatccttcagaaatctgcaaacaatcgatggtcagatgtcacagcaggtggcgttttacaaccctactgatttgcaagatcaatcccaacatccaccctacattcctccatttcatgttgttgggtttgctccgggtcctgttcctcctgctgatggcagtgatggtggagttgatttgcaattgcaatggaattatggtttggagccagagaggaagagrmytaaaagaacaggattttttggagaacaattctcagatatcttctgttgatttccttcaaccacgatcagtgtcgactgggttgggcttgtcactagacaatactcgcctgacatccactggagactcagctttgttgtcactcatcggtgatgacatcgagcgtgagttgcagcagcaggacgcagagatagatagatttctcaaagtgcagggtggacgtttgcggcaagcagtcttggagaaggttcaggcaacacagcttcagagtgtctcactaattgaagacaaaatccttcagaaactttgcgagaaagaagctatggtagaaagcatcaacaagaggaacattgaactcgaagatcaaatggagcagttgactgtggaagctggttcgtggcaacagcgagcaagatataatgaaaatatgattgctgctctcaagttcaaccttcagcaagcgtatgtccaaagcagagatagtaaagaaggatgtggtgacagtgaggtcgacgatacagcttcttgctgcaatggccgttccctmgattttcatctgctttcaagggagaacaccgacatgaaagagatgatgacatgcaaggcttgcagagtcaatgaagtgaccatggttttgttaccttgtaagcatctttgcctctgtaaagattgtgaaagtaagcttagtttctgtcctctatgtcaatcctccaaatttatcggcatggaggtctacatgtaactgcaaagtatacttctacttgtgaaatctctaatttcatgtttttattatgtgtcctttcatgtagcttgtgtctcaaggaccatgacaccttgtaactagtttttaagatgtatttgaccataatgaatttcacttgcttgagaacagtgaattttg

SEQ ID NO: 1097 - protein, 342 aa, Glycine max
  misc_feature: Ceres CLONE ID no.1243138
  misc_feature: Bit score of 574.2 for HMM based on sequences of FIGURE 13.
  misc_feature: Functional Homolog Of Ceres SEEDLINE ID no. ME17578 at SEQ ID NO. 1047
MAFPQHHFQQHYQTQQQQQPQNKSFRNLQTIDGQMSQQVAFYNPTDLQDQSQHPPYIPPFHVVGFAPGPVPPADGSDGGVDLQLQWNYGLEPERKRLKEQDFLENNSQISSVDFLQPRSVSTGLGLSLDNTRLTSTGDSALLSLIGDDIERELQQQDAEIDRFLKVQGGRLRQAVLEKVQATQLQSVSLIEDKILQKLCEKEAMVESINKRNIELEDQMEQLTVEAGSWQQRARYNENMIAALKFNLQQAYVQSRDSKEGCGDSEVDDTASCCNGRSLDFHLLSRENTDMKEMMTCKACRVNEVTMVLLPCKHLCLCKDCESKLSFCPLCQSSKFIGMEVYM

SEQ ID NO: 1098 - protein, 366 aa, Medicago truncatula
  misc_feature: Public GI ID no.92887260
  misc_feature: Bit score of 364.7 for HMM based on sequences of FIGURE 13.
  misc_feature: Functional Homolog Of Ceres SEEDLINE ID no. ME17578 at SEQ ID NO. 1047
MAVEAHHLHLFSPQLITNREMMNPVETNTNIIYNNISQMGYSSIPPSTIKTTATETMILPPYNSITTDSLPQKTAMNSDSGLTYNVPPLRKRSRDSRDYSNSINFPYPNSYISPSTPQQQNNHRSCASSSFSFLGEDISLQIQRQQLDIDQLISQQMEKVKYEIEEKRKRQAMRLIQAIDMSVTKRMKAKEEEIEKIGKMNWALEERVKSLCMENQIWRDLAQSNEATANALRTNLEQLLQQRAPAGDGNEDTVVPARPVALMDDAESCCDSNESINDDDAVDQWRNVVGHNGKNIGAMKMVGNCGGGDSNFVNSMKLCSNCGKDESCVLILPCRHLCLCAVCGSSLHICPICKSFKTASIHVNMS

SEQ ID NO: 1099 - protein, 337 aa, Medicago truncatula
  misc_feature: Public GI ID no.92888885
  misc_feature: Bit score of 619.9 for HMM based on sequences of FIGURE 13.
  misc_feature: Functional Homolog Of Ceres SEEDLINE ID no. ME17578 at SEQ ID NO. 1047
MAFLQDQFQRHYQQQQQPQPQTKSFRNLQTIEGQMSQQMAFYNPTDLQDQSQHPPYIPPFGFAPGPVIPADGSDGGVDLHWNFGLEPERKRLKEQDFLENNSQISSVDFLQPRSVSTGLGLSLDNTRLASTGDSALLSLIGDDIDRELQQQDLEMDRFLKLQGEQLRQTILEKVQATQLQSVSIIEDKVLQKLREKETEVENINKRNMELEDQMEQLSVEAGAWQQRARYNENMIAALKFNLQQAYLQGRDSKEGCGDSEVDDTASCCNGRSLDFHLLSNENSNMKDLMKCKACRVNEVTMVLLPCKHLCLCKDCESKLSFCPLCQSSKFIGMEVYM

SEQ ID NO: 1100 - protein, 338 aa, Solanum lycopersicum
  misc_feature: Public GI ID no.45544873
  misc_feature: Bit score of 634.3 for HMM based on sequences of FIGURE 13.
  misc_feature: Functional Homolog Of Ceres SEEDLINE ID no. ME17578 at SEQ ID NO. 1047
MALPHHHLQLHIQQQPHQQQQQSKSYRDLYNNMDGQITNPVVYFNGSNLPEQSQHPPYIPPFQVVGLAPGTADDGGLDLQWNYGLEPKKKRPKEQDFMENNNSQISSVDLLQRRSVSTGLGLSLDNGRLASSCDSAFLGLVGDDIERELQRQDAEIDRYIKVQGDRLRQAVLEKVQANQIQAITYVEEKVLQKLRERDTEVDDINKKNMELELRMEQLALEANAWQQRAKYNENLINTLKVNLQHVYAQSRDSKEGCGDSEVDDTASCCNGRATDLHLLCRDSKEMKELMTCRVCRTNEVCMLLLPCKHLCLCKECESKLSLCPLCQSTKYIGMEVYM

SEQ ID NO: 1101 - protein, 337 aa, Solanum chacoense
  misc_feature: Public GI ID no.45758663
  misc_feature: Bit score of 640.9 for HMM based on sequences of FIGURE 13.
  misc_feature: Functional Homolog Of Ceres SEEDLINE ID no. ME17578 at SEQ ID NO. 1047
MALPHHHLQLHIQQQQPHQQQSKSYRDLYNNMDGQITTPVVYFNGSNLPEQSQHPPYIPPFQVVGLAPGTADDGGLDLQWNYGLEPKKKRPKEQDFMENNNSQISSVDLFQRRSVSTGLGLSLDNGRLASSCDSAFLGLVGDDIERELQRQDAEIDRYIKVQGDRLRQAVLEKVQANQIQAITYVEEKVLQKLRERDTEVDDINKKNMELELRMEQLDLEANAWQQRAKYNENLINTLKVNLQHVYAQSRDSKEGCGDSEVDDTASCCNGRATDLHLLCRDSKEMKELMTCRVCRTNEVCMLLLPCKHLCLCKECESKLSLCPLCQSTKYIGMEVYM

SEQ ID NO: 1102 - DNA, 1392 bp, Triticum aestivum
  misc_feature: Ceres CLONE ID no.885628
  misc_feature: Encodes the peptide sequence at SEQ ID NO. 1103
gttttctttgccaccctgcccgcccgtccctcgccgatcgatgaccgcacctcccaccacatctgactaactccggccagggacgcatcgccttgcctgtatatataggagcgagcggacgacccgcgcgccccatcaatcgccatggctgtggacctgcaacgccttcgccacatgttactcaccaccggcgacggcggcggtcaccaccagctctactccgccgctgctatgccagcgagtgggccttgttatggcgctgcggtgtcgtgcgagcgggggcaccagccgtacgcggacctcttcacgctgccgccgccgccgacgatgacttcggccccgtatcagtgttcagagttcttggcgatggacgcggttgatctggctaagaagggcggcaaccccgacggtgttcaggaaatgatcaccaagaagcggaggcgcgaggagcggtcgtcgatgcttagcgcggccgacgctcttgcggcccacgcgcagcagcagaccatcgacgtccaccgcatcctgctcaaacatgcgcaaaagatgtggactactctggcggagcagaggcagagccacacgaggctcatcgtgtggaccgtggaggccagggcggcgaagcggctcaaggccaaggatgaggacattgagcggatcaggagcatgaactgggcgctcgaggagcgtcttcggaacctcctcatggaggctcagatgtggcgcgatgtcgcgcagtcccatgaggccacggccaacgtgctccgcggcgacctacagcgggcgctcgactcccaggcggttcgtggcggtggaagcgacgacggtcaggaggacgacgccgagtcgtgctgctggggagagaagcaggtgcctttgtgcgcggaggaggaggtgggcacgccggtagtggaggagcgtcacgcgacaggagcaggaaggtgcaaggggtgccgcgagggcgcggccgttgtgctgctgctgccgtgcaggcacctctgcgtgtgcgcgccgtgcgcggccgcggcgcaggcgtgcccggcgtgcggaagcgccaagaatggcatcgtctgcatcaacttttcgtgatgcgggaggaatagttttagagtagacattttgtttccttctgaaacttactagagtcgacttttgtttgtattcttttgttcactttttctattgttgttgaccgaaagcggctcctctgccatgcgccgtgtgaggttgggctgctgacatgtgggccaggttttcaacgggtccacatgtcaatggtagaacgatagggtgccgaaggttagagtatcctcctacttgtgttgacgggatgataaataggaggatggttggatcacatagatatgagaggacttgtatcccctttttgtt

SEQ ID NO: 1103 - protein, 314 aa, Triticum aestivum
  misc_feature: Ceres CLONE ID no.885628
  misc_feature: Bit score of 261.2 for HMM based on sequences of FIGURE 13.
  misc_feature: Functional Homolog Of Ceres SEEDLINE ID no. ME17578 at SEQ ID NO. 1047
MAVDLQRLRHMLLTTGDGGGHHQLYSAAAMPASGPCYGAAVSCERGHQPYADLFTLPPPPTMTSAPYQCSEFLAMDAVDLAKKGGNPDGVQEMITKKRRREERSSMLSAADALAAHAQQQTIDVHRILLKHAQKMWTTLAEQRQSHTRLIVWTVEARAAKRLKAKDEDIERIRSMNWALEERLRNLLMEAQMWRDVAQSHEATANVLRGDLQRALDSQAVRGGGSDDGQEDDAESCCWGEKQVPLCAEEEVGTPVVEERHATGAGRCKGCREGAAVVLLLPCRHLCVCAPCAAAAQACPACGSAKNGIVCINFS

SEQ ID NO: 1104 - DNA, 1478 bp, Triticum aestivum
  misc_feature: Ceres CLONE ID no.772927
  misc_feature: Encodes the peptide sequence at SEQ ID NO. 1105
cacgcccacgaccgtctcctcatccgtttccctctcctctctcttccttcgccaaacccgaaagctagcacgccgtagtacttggccatggccgtgcaggcgcaacacctctcccacgccttcccccacgacctccacgcctacaacagcgtcggtgctctggaggacgagatgacgggcggctccctcttctttcccgagaacctcaagcgcgggccggaactggagggtgctgggaacacggtgttcggcgacattccgcgcgtcgatcccacttggcacgacaacaccacccgcagccacggttttgcgcagaggaagcgggcgcgcgtcgtcccggaggcgccttcgtacttggagaatcagcgcgggcaggggcttgtgcccgtcggtgatgtgctgaccagggcggtgggctccggcacggcgtccaccagtgggagaatgatcaatgccgccggcccgccgcaggacctgctctcgcagctgtaccgtcagggcatggagatcgatgcagtcctacgactcgagaccgaccgcatgcgcgccgggctggaggaggcgcggcagcagcacgtcagggcgctggtatcggcggcggagcgtgctgcggcgaggcggctgcgtgccgcggaggccgcgctggagctggcgcgctgccgcaacgccaagctgtcagagaggctcacccagatttgcgccgagggccaggcgtggatacgcgtcgccaagagccacgaggcagtcgctgcgggcctccaagctacactcgaccagctcctgcagtccccttgcgctgccgtcgccgccaccggagcggatggagacggcgacgccgaggacgcgcggtcctgctgtttcgagacccccgccggcgacgacgctgcggcatccaaggcgtcggcggcggcgtgcagggcttgcggcgagggcgagtcgtgcgtgttgctgctgccgtgcaggcacctgtgcctctgcagcgcgtgcgacgccgccgtggacacctgcccgctgtgcgcgaccaccaagaacgcgtcgctccatgtcctgctctcgtgattcaaggaaccagtggcctcctccgaaacggtttgcgataggaaactcagcaggcttgatcaacttgcacatgttatcaagctacagtgggttcagtttgccgaagaagtcgcggtgcttcaagaatttggcggcaggtcatgtggaatctcagctctctaaagagacccgcgtctaaatgtacaagtggttcctgtagttttgtagagcatattactttcaggagccgcctgaattagccagaaaaacaaactgttgtgggtttgttatttcggacaaggatggcaggaactgaatgcaatttcaaatagagcgcctagtttgattttagcgttttcgtcttccaagtagggttagaatgtattttgtttaggatttcgataacatgcgaacgtttgctggcaaaaaaaaaaaaaaaa

SEQ ID NO: 1105 - protein, 323 aa, Triticum aestivum
  misc_feature: Ceres CLONE ID no.772927
  misc_feature: Bit score of 504.2 for HMM based on sequences of FIGURE 13.
  misc_feature: Functional Homolog Of Ceres SEEDLINE ID no. ME17578 at SEQ ID NO. 1047
MAVQAQHLSHAFPHDLHAYNSVGALEDEMTGGSLFFPENLKRGPELEGAGNTVFGDIPRVDPTWHDNTTRSHGFAQRKRARVVPEAPSYLENQRGQGLVPVGDVLTRAVGSGTASTSGRMINAAGPPQDLLSQLYRQGMEIDAVLRLETDRMRAGLEEARQQHVRALVSAAERAAARRLRAAEAALELARCRNAKLSERLTQICAEGQAWIRVAKSHEAVAAGLQATLDQLLQSPCAAVAATGADGDGDAEDARSCCFETPAGDDAAASKASAAACRACGEGESCVLLLPCRHLCLCSACDAAVDTCPLCATTKNASLHVLLS

SEQ ID NO: 1106 - DNA, 981 bp, Zea mays
  misc_feature: Ceres CLONE ID no.1376391
  misc_feature: Encodes the peptide sequence at SEQ ID NO. 1107
atcttcctttgttatcgtagccacaaccctctctcaactacatctcttaacatgaacaaccaaatcatcgccgacgattttccggtgacactgggagaccggcagttacaatacatgcagtctcgcgccatagatctgattcaaaccgcaccaagcttcaataaatatcatttcaaccaatctcccgtgatgttaaaacgacagagagattatgcgtttgactccgaagctctaatgacagctcggaaacgtaggtccgttgcgtttgtcccgccgcagtctctaattgaggcacaactcgtttctcaaatccagcagcaacaaacagatatcgatctgttcgtcgctcagcaaacgcaaacgctcagattggagttagaagcgaggcagagaacgcaaacgttgtccttagtgtcagcggttcagtccgtgattgtcaaaaagcttaaacagagagacgacgagattgtccgaatgggtaaactaaactatgtcttgcaagagcgagtgaagagtctctacgtcgagaatcagatcttgcgtgacctcgctcataccaatgaagctacagctaaaactctccggtcaaatcttgaacatgttctcgctcaggtcgacgagttaccggcgaccgcagcaaccggcggagatgtttttcatcctccggtagaagaggatgctgtatcgagctgcggaagctgcgacggtgctgatggtaatgatttcacggcggggacaggaggatgtaaacggtgcggtgaaaggacggctagtgtgttggtgctgccttgccgtcacttgtgtttgtgtacagtttgtggatcggctctgttacaggcgtgccctgtatgcgatacggtcatgaatgctagtgttcatgttaacatgtgatgagactcatgacccatttttaattttttagttttctttttagtgaaggatttaatagcatagtaaaagtaatactattataatttttgg

SEQ ID NO: 1107 - protein, 279 aa, Zea mays
  misc_feature: Ceres CLONE ID no.1376391
  misc_feature: Bit score of 317.8 for HMM based on sequences of FIGURE 13.
  misc_feature: Functional Homolog Of Ceres SEEDLINE ID no. ME17578 at SEQ ID NO. 1047
MNNQIIADDFPVTLGDRQLQYMQSRAIDLIQTAPSFNKYHFNQSPVMLKRQRDYAFDSEALMTARKRRSVAFVPPQSLIEAQLVSQIQQQQTDIDLFVAQQTQTLRLELEARQRTQTLSLVSAVQSVIVKKLKQRDDEIVRMGKLNYVLQERVKSLYVENQILRDLAHTNEATAKTLRSNLEHVLAQVDELPATAATGGDVFHPPVEEDAVSSCGSCDGADGNDFTAGTGGCKRCGERTASVLVLPCRHLCLCTVCGSALLQACPVCDTVMNASVHVNM

SEQ ID NO: 1108 - DNA, 1226 bp, Zea mays
  misc_feature: Ceres CLONE ID no.465893
  misc_feature: Encodes the peptide sequence at SEQ ID NO. 1109
  misc_feature (955)..(955): n is a, c, t, g, unknown, or other
aggaatcgtacgtactcctacataagagaggacgcggacgcatcttcttcttccctcccggaacctgagggcaagggcgttgccgcccagccgtgccacccacgatcgggtgcgtagccatggccgtcgaagcgcatcgcctcctcttggcaggaggacacaggcagcagcaacagcagcagcagctcgccagcgcggggtggccttgggccggcgccgacgaagataggtgcgcgacgacggcgagaccgagccaacatcatcaccatcaacaacaacagccgcagcaggagttgaggctccacaacgcctcgtgcgtgggcgtcctggctccacgggtctcgacgatcgctgccggcggacagatgttcctgggcgacgcggcggagagcgacgtcacgttcggaggaggaggagctgcggcgcggcaggaggtgacggcagtggcgccggcgcccaagaggcggaagcgcgccgagcagcagcagacgccgccggtgtyccaggtctgcgcggccgacgatgtggcggcgcagtttcagcagcatatcgtcgacgtcaaccgcctcgtgttccaacaaaccgccaacatgtgggcggcgctcacggagctgcggcggcggcaggcccgccaggtcgtggccgccgtggaggcagcggcggcgacgcggctgcgcgccagggaggaggaggtccagcggacggcgcgcatcaacggcacgctcgaggagcgggccaggagcctctacgtggaggcgcagctgtggcgtgacctggcgcgggccaacgaggccacggccaacgagctccgcgccgagctgcagcaggcgctcgacgaccagcggacgcgcggcgcacctggcgccggcgccgacgccgacgacgccgggtcgtgctgccgcgggggggaggacggcgggacgggtacgtcgttggcgaggacgtgcscggtgtncggcctgagcgcggccgacgtgctgctgctcccgtgccggcacctgtgcgcgtgcgcgccgtgcgccggtgcggccagggcgtgccccgcgtgcgggtgcgccaagaacggcagcgtctgcgtcaacttttcgtgatggctggttggttgtcaaaccgataggataggattgctggattagagtagtagtagtagtagtaggtttttttgggggtcttgtttatggcagcgacggttcagtgatgcggatatgagacggatgcatcttttg

SEQ ID NO: 1109 - protein, 323 aa, Zea mays
  misc_feature: Ceres CLONE ID no.465893
  misc_feature: Bit score of 337.9 for HMM based on sequences of FIGURE 13.
  misc_feature: Functional Homolog Of Ceres SEEDLINE ID no. ME17578 at SEQ ID NO. 1047
  misc_feature (128)..(128): Xaa is any aa, unknown, or other
  misc_feature (277)..(277): Xaa is any aa, unknown, or other
  misc_feature (279)..(279): Xaa is any aa, unknown, or other
MAVEAHRLLLAGGHRQQQQQQQLASAGWPWAGADEDRCATTARPSQHHHHQQQQPQQELRLHNASCVGVLAPRVSTIAAGGQMFLGDAAESDVTFGGGGAAARQEVTAVAPAPKRRKRAEQQQTPPVXQVCAADDVAAQFQQHIVDVNRLVFQQTANMWAALTELRRRQARQVVAAVEAAAATRLRAREEEVQRTARINGTLEERARSLYVEAQLWRDLARANEATANELRAELQQALDDQRTRGAPGAGADADDAGSCCRGGEDGGTGTSLARTCXVXGLSAADVLLLPCRHLCACAPCAGAARACPACGCAKNGSVCVNFS

SEQ ID NO: 1110 - DNA, 1229 bp, Zea mays
  misc_feature: Ceres CLONE ID no.895080
  misc_feature: Encodes the peptide sequence at SEQ ID NO. 1111
gtcgtcttcttatataagacgccaacgacgcatgtcctcggagcctgccgaggccaggatatagaggcgtcgccgggccgggccactgcacggtcggcggatatggctgtcgaagcgcacagcctcctcttagcaggagggcacaagcaactcaccagcgcgggatggccttggacgaccggcgacgaagctagatgcgcgacggcgcgaccgagccaccagcaggctttccagctccagcaggcctcgtgtgtgggcgtgggcgtgggcctgccggcggcggctccggtctcgtcggccgcggcggcgccaccagcgccgatgatagcgcagcagtacgctgctggcggacggctgttcgtgggagacgcggcggagagcggcgtcacgttcggaggaggaggtgcggtgcagcaggaggcgccccggaagcggaagcgcgccgagcaggggcagacgccgccgccggttcttgggaccggcgcggccgacgtggcggcgcagtttcaacagcagctcgtcgacgtcgaccgtctcgtcctccaacacaccgccaagatgtgggcggggctcaccgagcagcggcggcggcacgcccggcaggtcgtggccaccgtggaggccgccgcggcgccgcggctgcgcgcaaaggaggaggagatccagcggatgcggcgcgtcaactgggcgctcgaggagcgggtcaagagcatgtacgtcgaggcgcacatgtggcgtgacttggcgcagtccaacgacgccgcggtcaccgcgctccgcggcgagctgcagcaggcgctcgacgcccagcagacgcgccgccgcgccgacgacgccgactcgtgctgctgcggggagaacgacgtcttcatcaccgaagcaggcgcggcggagaacgaagaggaggccgggacgtcgtcgtcgtcgggccacgtcatcagggcgtgcgccgtgtgcggcgacaacgcggccgacgtgctgctgctgccgtgccgccacctctgcgcgtgcgcgccgtgcgcggccgcggcgagggcgtgcccggcgtgcgggtgcgccaagaatggcagcgtctgcgtcaacttttcgtgatggtcctgaaaccgatagaattactggatagactagaattttttttggagacggatgcatcttttgcacttgccttcccccctccccccctccaaaaaccctcgagcgagaagaaaaaatatagtcccaaagttcgg

SEQ ID NO: 1111 - protein, 329 aa, Zea mays
  misc_feature: Ceres CLONE ID no.895080
  misc_feature: Bit score of 561.4 for HMM based on sequences of FIGURE 13.
  misc_feature: Functional Homolog Of Ceres SEEDLINE ID no. ME17578 at SEQ ID NO. 1047
MAVEAHSLLLAGGHKQLTSAGWPWTTGDEARCATARPSHQQAFQLQQASCVGVGVGLPAAAPVSSAAAAPPAPMIAQQYAAGGRLFVGDAAESGVTFGGGGAVQQEAPRKRKRAEQGQTPPPVLGTGAADVAAQFQQQLVDVDRLVLQHTAKMWAGLTEQRRRHARQVVATVEAAAAPRLRAKEEEIQRMRRVNWALEERVKSMYVEAHMWRDLAQSNDAAVTALRGELQQALDAQQTRRRADDADSCCCGENDVFITEAGAAENEEEAGTSSSSGHVIRACAVCGDNAADVLLLPCRHLCACAPCAAAARACPACGCAKNGSVCVNFS

SEQ ID NO: 1112 - DNA, 1271 bp, Zea mays
  misc_feature: Ceres CLONE ID no.218243
  misc_feature: Encodes the peptide sequence at SEQ ID NO. 1113
acccagtagtcagtaaccacatctcctccccctctcccgcaaagacaaggccggtgtccatggccgtscaggcgcagacctactcaaccccgccttcctgccccacgacatggggcacgccttcagggcactggagggcgccacggtcggcggcggcggctccgcgttcctcgacgagctcggcttcggcgggtgcrcgccggcgccggcgccggccgccyttcgaggtcgccgcgtttggcgacacccagccgcgcagcgagctcacctgcaacggcggcggcggcgacaacagcaacgtgtttctcccgaggaagcgtgcacgcgtcgcgcccgggttcctggatgatgcccaccagcaggggttggttctgccggtgccgcagggccaggtgttcgccggcgacgtgcagagcagggaggcagggtgcggcgcggcgtccaccagtggtcgggcggcggccaccaccaacggcgtcctgtcgctgctctaccgccagggcatggagatcgacgcgctggtgcggctcgagaccgagaggatgcgtgcggggctgcaggaggctcggcggaggcacgcgcgcgcggtggcggcggccgtgcagcgcgccgcggcggggcggctgcggctggcggaggccgagctggggcgcgcccgccgccgcaacgccgagctggaggagaggctccggcagctggccgccgaggggcaggcgtggctgggcgtcgcgcggagccacgaggccgtcgccgccgggctccgcgccacgctggaccagctgatgctgcarcagcagcccggccccggcggcgatggcggcgaggcggaggacgcgcggtcctgctgcttcgagacctccccgccgggccccgtcgccgacgactgcgacgccgcgtcccggggctcctcgccgccgtcgtgcaagtcatgcggasscggcgacgcgtccgtgctgctcctcccgtgccgccacctctgcctgtgccgcgcgtgcgaggccgccgccgaggcgtgccccgtctgcggcgctagcaagaacgcctcgctccaggtcctgctgtgacgaggcgggagggcccwrcwgcggcgtgctggtcccgcgcggtggcggcactcgtcgtccaatgagatccgctggctcccggggtcaggcggcgagctttgttgtgagtagtacatgtasagatgctccaagttgcagcatagtaggctaattttagacgcagttggctgtactactggtaattggcactaactttggttgtccccc

SEQ ID NO: 1113 - protein, 334 aa, Zea mays
  misc_feature: Ceres CLONE ID no.218243
  misc_feature: Bit score of 309.8 for HMM based on sequences of FIGURE 13.
  misc_feature: Functional Homolog Of Ceres SEEDLINE ID no. ME17578 at SEQ ID NO. 1047
  misc_feature (3)..(3): Xaa is any aa, unknown, or other
  misc_feature (46)..(46): Xaa is any aa, unknown, or other
  misc_feature (54)..(54): Xaa is any aa, unknown, or other
  misc_feature (244)..(244): Xaa is any aa, unknown, or other
  misc_feature (293)..(293): Xaa is any aa, unknown, or other
MAXQAQTYSTPPSCPTTWGTPSGHWRAPRSAAAAPRSSTSSASAGXRRRRRRPXFEVAAFGDTQPRSELTCNGGGGDNSNVFLPRKRARVAPGFLDDAHQQGLVLPVPQGQVFAGDVQSREAGCGAASTSGRAAATTNGVLSLLYRQGMEIDALVRLETERMRAGLQEARRRHARAVAAAVQRAAAGRLRLAEAELGRARRRNAELEERLRQLAAEGQAWLGVARSHEAVAAGLRATLDQLMLXQQPGPGGDGGEAEDARSCCFETSPPGPVADDCDAASRGSSPPSCKSCGXGDASVLLLPCRHLCLCRACEAAAEACPVCGASKNASLQVLL

SEQ ID NO: 1114 - DNA, 1477 bp, Zea mays
  misc_feature: Ceres CLONE ID no.1558456
  misc_feature: Encodes the peptide sequence at SEQ ID NO. 1115
agcactacccagtacccagtagtcagtaaccacatctcctcccccctctcctgcaaagacaaggccgctgtccatggccgtccaggcgcagcacctactcaaccccgccttcctgccccacgacatggggcacgccttcagggcgctggagggcgccacggtcggcggcggcggcggctccgcgttcctggaagagctcggcttcggcgggtgcgcgccggcgccggcgcccatcgaggtcgccgcgtttggcgacacccagccgcgcagcgagctcacctgcaacggcggcggcggcggcgacaacagcaacgtgtttctcccgaggaagcgtgcacgcgtcgcgcccgggttcctggatgatgcccaccagcaggggttggttctgcccctgccggtgccggtgccggtgccgcagggccaggtgttcgccggcgacgtgcagagcagggagggagggtgcggcgcggcgtccaccagcggtcgggcggcggccaccaccaacggcgtcctgtcgctgctctaccgccagggcatggagatcgacgcgctggtgcggctcgagaccgagaggatgcgtgcggggctgcaggaggcgcggcggaggcacgcgcgcgcggtggcggcggccgtggagcgcgccgcggcggggcggctgcggctggcggaggccgagctggggcacgcccgccgccgcaacgccgagctggaggagaggctccggcagctggccgccgaggggcaggcgtggctgggcgtcgcccggagccacgaggccgtcgccgccgggctccgcgccacgctggaccagctgatgctgcagcagcagcccggcgtcgaggcggaggacgcgcggtcctgctgcttcgagacctccccgccgggccccgtcgccgacgactgcgacgccgcgtcccggggctcctcgccgccgtcgtgcaagtcctgcggaggcggcgacgcgtccgtgctgctgctcccgtgccgccacctctgcctgtgccgcgcgtgcgaggccgccgccgaggcgtgccccgtctgcggcgctagcaagaacgcctcgctccaggtcctgctgtgacgaggcgggtgggccctgccggcgtgttggtcccgcgcggtggcggcactcgtcgtccaatgagatccgctggctcccggggccaggcggcgagctttgttgagtagtacatgtagagatgctccaagttgcagcatagtaggctaattttagacgcagttagctgtactactggtaattggcactaacttctgttctcccctcgaatatctttctggtaccttgtttctcagatgtgctagtagtatcttttctggggtagtgttggcttgttttgtattaatgaggagatcggctaaagcttagatacgaaaagctatggtattctactatacttggagcttccctcgacatgtattattgtttcagcgtgacgcctaaaaaaaaaaaaaaaaa

SEQ ID NO: 1115 - protein, 335 aa, Zea mays
  misc_feature: Ceres CLONE ID no.1558456
  misc_feature: Bit score of 347.8 for HMM based on sequences of FIGURE 13.
  misc_feature: Functional Homolog Of Ceres SEEDLINE ID no. ME17578 at SEQ ID NO. 1047
MAVQAQHLLNPAFLPHDMGHAFRALEGATVGGGGGSAFLEELGFGGCAPAPAPIEVAAFGDTQPRSELTCNGGGGGDNSNVFLPRKRARVAPGFLDDAHQQGLVLPLPVPVPVPQGQVFAGDVQSREGGCGAASTSGRAAATTNGVLSLLYRQGMEIDALVRLETERMRAGLQEARRRHARAVAAAVERAAAGRLRLAEAELGHARRRNAELEERLRQLAAEGQAWLGVARSHEAVAAGLRATLDQLMLQQQPGVEAEDARSCCFETSPPGPVADDCDAASRGSSPPSCKSCGGGDASVLLLPCRHLCLCRACEAAAEACPVCGASKNASLQVLL

SEQ ID NO: 1116 - DNA, 1246 bp, Zea mays subsp. mays
  misc_feature: Ceres CLONE ID no.343008
  misc_feature: Encodes the peptide sequence at SEQ ID NO. 1117
actacccacttctctcctcttccctctccccgcccactcgcctagacaaacgcggcggcgatggccgtccaggcgcagcaccttttcgcaccagccttcctgccccacgacgtcggccacgccttgagggcgctggagggtgccgcggcagtcggtggctccgcgctcctggacgagctcggcctcggcgggtgcgcgccggcgcccctcggggacgccgcgttcggcgacgcccggccgcgaagcgagctcacctgcaacgccggcgacgacaacagcgtgttcctcccgaggaagcgggcacgcgttgtgccggggttcctgctggacgaggtgcagaacaggtgcggcgcggcgtccaccagcggccgggcgatggccagtggcgtcctgtcgcagctgtaccaccagggcgtggaggtcgacgcgctggtgcgggtcgagatggacaggatgcgcgcggcgctccacgaggctcggctgcggcacgcgcgcgcggtggtagcggccgtgcggggtgcggcggaggctcggctccgcacgggggaggccgagctggagcgcgcccgacgccgcggcgcggagctggaggagcggctccggcagctggctgccgagggccaggcgtggctgggcgtcgccaggagccacgaggccgtcgccgctggcctccgcgccacgctcgacaaggtgctccagcaacccgccgtcgccggcggcggcggaggagaatgcggcgaggcggaagacgcgcagtcctgctgcttcgtggcatccccgtcggggcccgtgtcgacgggttcgtcgccgtcgtgcaaggcctgcggtggcggcgacgcgtgcgttctggtcctgccgtgccggcacctgtgcctgtgccgcgcgtgcgaggccggtgccgaggtgtgccccgtctgcggcgccgtgaagaacgcctcgctccaggtcctgctgtgacggcgaggaggcactggcagcggaagggagtcactccagcttgcctcccgcggtgcctcggtaggtgagtcacgacaccggggtcaggcatgaaacttttgttggttagtagcagtagagagtagccccgttggagtagaatcatgtagaaatgcattttggctagtttattagacaacccagctggtttatatgtccaaatcccagacttggttcacaactggagagtatctcatgtgtaatacaaccacacgacatagttccggtttgcttaaaaaaaaaaaaaaaa

SEQ ID NO: 1117 - protein, 298 aa, Zea mays subsp. mays
  misc_feature: Ceres CLONE ID no.343008
  misc_feature: Bit score of 294.9 for HMM based on sequences of FIGURE 13.
  misc_feature: Functional Homolog Of Ceres SEEDLINE ID no. ME17578 at SEQ ID NO. 1047
MAVQAQHLFAPAFLPHDVGHALRALEGAAAVGGSALLDELGLGGCAPAPLGDAAFGDARPRSELTCNAGDDNSVFLPRKRARVVPGFLLDEVQNRCGAASTSGRAMASGVLSQLYHQGVEVDALVRVEMDRMRAALHEARLRHARAVVAAVRGAAEARLRTGEAELERARRRGAELEERLRQLAAEGQAWLGVARSHEAVAAGLRATLDKVLQQPAVAGGGGGECGEAEDAQSCCFVASPSGPVSTGSSPSCKACGGGDACVLVLPCRHLCLCRACEAGAEVCPVCGAVKNASLQVLL

SEQ ID NO: 1118 - DNA, 1467 bp, Zea mays subsp. mays
  misc_feature: Ceres CLONE ID no.218463
  misc_feature: Encodes the peptide sequence at SEQ ID NO. 1119
actcctcccactggcggtcggttcccacgcccgcccaacgccttcgcggtcgtccttgccatggccgtgcaagggcggcacctgtcgcacgacctagcagcccaggcggccggcggctacctgttcctggacgagtacgccgggtgcgcgccggccccggccccggcccggatcggggacgccacgacggcgctcagcgacttcccgcgcgtcgaggttgcctggtgcaactacgacggcttcctgccgaggaagcggccgcgcctggagacggcggcgccagcagcgggcggtggtctcttggaagaccagcgcgcgggtttgcctccggcgggcacggagctcctgctgccactgccagtggcaccgttcgtcgacgcgcggagccgccgggcggttgcggcctccggcacggcgtccaccagtgggagggtggcaagtggcgcgaccgtggcggcctcgcggggactgctgtcgtcgtggacgcaccgccacggcgtggagatcgacgcgctcgttagacttgaggcagagaggatgcgcgcggcgctggaggaggcgcggcggcggcacgcccgcgcgctgctggccgccgtggggcgcgccgcgtcggggcggctgcgcgcgtcggagacggacctcgagcgcgcgctccggcgcggcgcggagctggaggagaaggcccggcaggcgggcgccgagtgccaggcgtggatgggcgtcgccaggaggcacgaggccgccgccgctggcctccgcgccacgctggaccagctcctgcagccaccctgtggcgccggcggcggccgcgaggaaggcggtgaggccsaggacgccgagtcgtgttgcttcgaggacggcggcgcggcgtgcgcgtccaggtccaagctggcgtgcaggtcgtgcggcggcggcgaggcgtccgtgctgctgctcccgtgccggcacctgtgcctgtgccccgcgtgcgaggccggcgtggacgcctgccccgtctgcgcggccgccaagaacggctcgctccacgtcctcgtctcctgatggactgaacatgttcgtcgccgactggttacgctacgtcacacgaggccatggcaggagacgaggcttcctgcggacgcgatgcgccggttacggttgatgcgcggttcatgcgcgaacgcaatgtggcacagcacagaacgtcctggcaaatcgtgcgatggccattctgttaataaccggagatatggccgcagaagtggatcggggacgatgtccaacgaagggtgaaaaaaaaagttctcttcacgtgcaccaacaacaagtcacaaactcaccagtgtccactgccttctcttcaaagcaccgcgttggatgctggatggagatcgttctcctggcggagattgccaagggtttagtcagtccttgaggcgttgtctagttctgattctgaagatatcattttttttcttcttctaaacg

SEQ ID NO: 1119 - protein, 326 aa, Zea mays subsp. mays
  misc_feature: Ceres CLONE ID no.218463
  misc_feature: Bit score of 263.0 for HMM based on sequences of FIGURE 13.
  misc_feature: Functional Homolog Of Ceres SEEDLINE ID no. ME17578 at SEQ ID NO. 1047
  misc_feature (257)..(257): Xaa is any aa, unknown, or other
MAVQGRHLSHDLAAQAAGGYLFLDEYAGCAPAPAPARIGDATTALSDFPRVEVAWCNYDGFLPRKRPRLETAAPAAGGGLLEDQRAGLPPAGTELLLPLPVAPFVDARSRRAVAASGTASTSGRVASGATVAASRGLLSSWTHRHGVEIDALVRLEAERMRAALEEARRRHARALLAAVGRAASGRLRASETDLERALRRGAELEEKARQAGAECQAWMGVARRHEAAAAGLRATLDQLLQPPCGAGGGREEGGEAXDAESCCFEDGGAACASRSKLACRSCGGGEASVLLLPCRHLCLCPACEAGVDACPVCAAAKNGSLHVLVS

SEQ ID NO: 1120 - DNA, 1328 bp, Zea mays
  misc_feature: Ceres CLONE ID no.1565409
  misc_feature: Encodes the peptide sequence at SEQ ID NO. 1121
gtcgtcccactgcactcccaccgcccaagctttactacgtgatcgatccgatccgccgcggcgcgtaggaaaccatcctccccccgcgcctcgtgccatggccgtgcacgcgcagtaccacgcccacgccttcccacatgacctccgcgccatccccagctgcccagcgctggacaacgccacgagcgcgtcggcgttcctcgtcgccgacgccgaccccgcacccgcggctggcgtcaacacggcgctcagcggcctcacccgcaacggcatcagccacggcagaggttgcctcggcggcgcaaggaagcgcgcgcgtgtgactatggacatgcaactgcaaggccagcgcgctctgctgcccccggtgccgcaggcgttggcgtccgcggggggcgtgcagagcagggcgctctgctctggctccgcgtccaccagccagcgaccggctagcgccgcgccagtgtcgcagggcctcctcccgcacatctaccgccacagcgtcgagatcgacctgcttctccgcgtcgagactgagcggctgcaggcagggctccaggacgcgcggcgccggcacgcccgcgccgtgctgtccgcggtgggacgcggcgcggcgcggcgcctgagggcggcggaggccgggctggagcgcgcgctggcgcgcaacgcggagctcgacgacaggctccggcagacggtggccgaggggcaggcgtggcagggcgtcgccaggagccacgaggccgtcgccgcggggctacgcgccacgctcgacagcctcacgcaggcgcaggcgccatgcgctggcgagggcgagggcgagggcgacgccgaggacgcgcagtcgtgctgcttcgacctggtggagcaggaacagggagccgacgaggcgtccggcgggcggacgagggcgtgcaggtcgtgcggcgacgcggaggcgtgcgtgctgctgctgccgtgccggcacctgtgcctctgccgcgggtgcgaggcggcggccggcgaggcgtgccccgtgtgcgcggccaccaagaacggctcgctccacgtcctcctctcctgattcattcatccacggcccgtgccaccgcgttcgcttcgaattgaaggaggcatcacgaaacgagaaccaagtggaagaggcggaggacattgagcccatccatggccccaatagaaatgacgcgcgaaaatcattctgcttacacttcacacacagttcacagacagagggggcttcatgaagagagccacgatgaggcgctcaagcagaccaggaagggcacatgaagcgcgcgcgcaatggatgtgagcttatctttacgagt

SEQ ID NO: 1121 - protein, 321 aa, Zea mays
  misc_feature: Ceres CLONE ID no.1565409
  misc_feature: Bit score of 277.5 for HMM based on sequences of FIGURE 13.
  misc_feature: Functional Homolog Of Ceres SEEDLINE ID no. ME17578 at SEQ ID NO. 1047
MAVHAQYHAHAFPHDLRAIPSCPALDNATSASAFLVADADPAPAAGVNTALSGLTRNGISHGRGCLGGARKRARVTMDMQLQGQRALLPPVPQALASAGGVQSRALCSGSASTSQRPASAAPVSQGLLPHIYRHSVEIDLLLRVETERLQAGLQDARRRHARAVLSAVGRGAARRLRAAEAGLERALARNAELDDRLRQTVAEGQAWQGVARSHEAVAAGLRATLDSLTQAQAPCAGEGEGEGDAEDAQSCCFDLVEQEQGADEASGGRTRACRSCGDAEACVLLLPCRHLCLCRGCEAAAGEACPVCAATKNGSLHVLLS

SEQ ID NO: 1122 - DNA, 1264 bp, Zea mays
  misc_feature: Ceres CLONE ID no.1060968
  misc_feature: Encodes the peptide sequence at SEQ ID NO. 1123
atcacccaaccaagccttcgtcctcctccctcactcacagtggtggacaccatggccgtacaagcgcaattcggcggcctcctgctcccaccctacgcggtcgaggaccagatgcgggcgctcaaggactacggcgtgctcctgtccgccgcgcagagcgagctgacgcgcaacgtcgtcgtcggcggcggcggggcggccgccatgcccctgccgtcgcgcaagcgccaccgcagggaggacgagcaccggcactacaacgtggacgtgcctctcccggggatggggtcgctggccgcagacccgacggcggcggcgtcgacgagcggccgggcgcccgccgacgccgaggtggacgcgctggtgcgggccgagtgcgaacagctgcgcgcggggctggaggcggcgcgggcgcggcagcgccgggcgctgctggcgcgcgcggccgcgtccgtccttgcgcggcgggcgcgggaggcggaggcccggctggaggccgcgcggcgacgcgccgcggagctcgacgagtgggtccgcctggccgccgcggaggcgcaggcgtggtgcggcgtcgcgcgggccaacgaggccgtcgccgcgggcatgcgcgccacgctcgacgcgctcttcctccgctcctcggccgccgccgccggccgcgagggcgagggcgactcgtccgagcccgggcccgaggacgcgcagtctcgctgctcctgctgctacgttgaggacgttgaggcgacgggcaccgctgccgccacgccctcgccattgtggaacggcaggtgggcgtgcagggcgtgcggcgagggcgaggcgtccgtgctgctgctgccgtgccggcacatgtgcctgtgcaaggcgtgcgagccccggacggacgcctgcccggtctgctccggcgccaagaacgcgtccatccacatcgcgcccagctgatgcccaccgcgccaagtcgtttgtttgcggggcctagcatggcgcgtcgattggattcaatttgctccgtagggttcgtcaagtaacctagatgagtagttaggagtttgatagattcgatgccgttgattttcttttatgcacgatgttaatggaaaatcagaaagaagaccgacttgtcatgtaaaccggcatgcttccttgctctgttttctcagcgtatttgttgctctagattttcgtttcttctgttttgacgccaagaaatatatataatgtagggcccgcttcctcatttaaaaaaaatacaattatgatccag

SEQ ID NO: 1123 - protein, 296 aa, Zea mays
  misc_feature: Ceres CLONE ID no.1060968
  misc_feature: Bit score of 143.9 for HMM based on sequences of FIGURE 13.
  misc_feature: Functional Homolog Of Ceres SEEDLINE ID no. ME17578 at SEQ ID NO. 1047
MAVQAQFGGLLLPPYAVEDQMRALKDYGVLLSAAQSELTRNVVVGGGGAAAMPLPSRKRHRREDEHRHYNVDVPLPGMGSLAADPTAAASTSGRAPADAEVDALVRAECEQLRAGLEAARARQRRALLARAAASVLARRAREAEARLEAARRRAAELDEWVRLAAAEAQAWCGVARANEAVAAGMRATLDALFLRSSAAAAGREGEGDSSEPGPEDAQSRCSCCYVEDVEATGTAAATPSPLWNGRWACRACGEGEASVLLLPCRHMCLCKACEPRTDACPVCSGAKNASIHIAPS

SEQ ID NO: 1124 - DNA, 1295 bp, Zea mays subsp. mays
  misc_feature: Ceres CLONE ID no.236111
  misc_feature: Encodes the peptide sequence at SEQ ID NO. 1125
aactcccgattcccgaaggcccatttcgtcgtctcttgctccctcggtccttccttcacccatctcacccgcgacccgcccctttcccctaagccatctccttcctcctcacctcgccatggcgttcttctctcatcaccatctccagcagccacacgcgcagcagccagtgctcccttccttcaggaacgcgctaccggtgcctgtggatggccagatcccagcgcccctcaccttcttcaacccgccgcctgccttcccggagcaacccgcgcaggcacctctggtggatgcggtgggcttgacggcagctgcggggcttgggtggaggcagccgagggagcaggaactgcttggggaaaactcccagatgtcgtccattgattttctgcagacgggctcggcagtgtcgacggggttggcgctgtctctggaggaccggcgccacggcggcggcggggctgggaactcctctggcgattcaccgctgctcctgctgcccatgctggacgatgacatctcacgcgaggtccagcggcttgacgctgatatggaccgctttattaaagctcagagtgaacggctgaggcaatctatactggaaaaagttcaggcaaagcaatttgaggcactggcctcagttgaggacaagatactcagaaaaataagggacaaagaggcggaagtggagaccataaacaaaaggaactctgaactagaggaccagattaagcatttgggagtggaagttggtgcttggcagcatagggccaagtacaatgaaagcatgatcaatgcactcaagtacaacttggaacaggtttgtgctcaccagagcaaggatttcaaggaaggctgcggcgatagcgaggtagatgacacggcgtcctgtcgcgatggtggtgctatcaattttcaactgactccgaaggagaacagacaaccgaaggatttgacggcttgcagggtctgcaaatcaagtgaggcatccatgctcttgctgccttgtcggcatctttgtctatgcaaggagtgcgagagcaagctgagcttctgccccctgtgccagtcctccaagatacttggcatggagatatattatgcgtagaatagaatttatgtatcacatgagtatcgtacgagatactgctatgttaatacgattaatctattgccaaactttagaacctatgtaccagtaccactatgacttgccactggatcaaaagacactgccgttgatggtagatttaccgcagcaaatttctgtgagaagcccatcgttgatttgtgct

SEQ ID NO: 1125 - protein, 329 aa, Zea mays subsp. mays
  misc_feature: Ceres CLONE ID no.236111
  misc_feature: Bit score of 293.1 for HMM based on sequences of FIGURE 13.
  misc_feature: Functional Homolog Of Ceres SEEDLINE ID no. ME17578 at SEQ ID NO. 1047
MAFFSHHHLQQPHAQQPVLPSFRNALPVPVDGQIPAPLTFFNPPPAFPEQPAQAPLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKILRKIRDKEAEVETINKRNSELEDQIKHLGVEVGAWQHRAKYNESMINALKYNLEQVCAHQSKDFKEGCGDSEVDDTASCRDGGAINFQLTPKENRQPKDLTACRVCKSSEASMLLLPCRHLCLCKECESKLSFCPLCQSSKILGMEIYYA

SEQ ID NO: 1126 - DNA, 1263 bp, Zea mays
  misc_feature: Ceres CLONE ID no.285598
  misc_feature: Encodes the peptide sequence at SEQ ID NO. 1127
gtctttcactccatcaccccctctcccccgtccctttcccctcagccctcagccctcagccatctccttccccctcacctcgccatggcgttcttctctcaccaccatctccagcagccacacccgcagcaggcaccgcccccgaatcagcagcagccggtgcttccttccttcaggaacgcgctaccggtgcctgtggatggccagatcccagcgcccctcaccttcttcaacccgccgcctgccttcccggagcagcccgcgcagacaacgctggtggatgcggtggggctgacggcagctgctgggcttgggtggaggcagccgagggagcaggaactgcttggagaaaactcccagatgtcgtccatcgattttctgcagacgggctcggcggtatcgacggggctggcgctgtctctggaggaccggcgccacggcggcggcggggctgggaactcctccggcgattcaccgctgctcctgctgcccatgctggacgatgacatttcacgcgaggtccagcggcttgacgctgatatggaccgcttcattaaagctcagagtgaacggctgaggcaatctatactggagaaagttcaggcaaagcaatttgaggcactggcctcagttgaggacaagatattcagaaaaatacgggataaagaggcggaagtggaaaccatcaacaaaaggaactctgaactagaggaccagattaagcatttgggagtggaagttggtgcttggcagcaaagggccaagtacaatgagagcctgatcaatgcactcaagtacaacttggaacaagtatgtgctcaccagagcaaggacttcaaggaaggctgcggtgatagcgaggtagatgacacggcgtcctgtccctatggtggtgctgtcaatttgcaactgatgccaaaggagaacagacaaccgaagaatttaacggcttgcagggtctgtaaatcaagtgaggcatgcatgctcttgttgccgtgtcggcatctttgtctatgcaaggagtgcgagagcaagctgagcatctgccccctgtgccagtcctccaagatacttggcatggagatatattatgcatagaatataatttatgtatcacattagtatcgtacgagatactgctatgttaatacgtcaatctattgccgaagttcagaacctatgtaccactattgacttgccactggatcaaaaaaagactgccgtttatggtagatttaacgcagcaaatttctttgcgaagct

SEQ ID NO: 1127 - protein, 337 aa, Zea mays
  misc_feature: Ceres CLONE ID no.285598
  misc_feature: Bit score of 292.5 for HMM based on sequences of FIGURE 13.
  misc_feature: Functional Homolog Of Ceres SEEDLINE ID no. ME17578 at SEQ ID NO. 1047
MAFFSHHHLQQPHPQQAPPPNQQQPVLPSFRNALPVPVDGQIPAPLTFFNPPPAFPEQPAQTTLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKIFRKIRDKEAEVETINKRNSELEDQIKHLGVEVGAWQQRAKYNESLINALKYNLEQVCAHQSKDFKEGCGDSEVDDTASCPYGGAVNLQLMPKENRQPKNLTACRVCKSSEACMLLLPCRHLCLCKECESKLSICPLCQSSKILGMEIYYA

SEQ ID NO: 1128 - DNA, 1293 bp, Zea mays
  misc_feature: Ceres CLONE ID no.225881
  misc_feature: Encodes the peptide sequence at SEQ ID NO. 1129
tttttttttttgccatttgccacccccaactcccgagggcccatttcgccgtctttcactccatcaccccctctcccccgtccctttcccctcagccctcagccctcagccatctccttccccctcacctcgccatggcgttcttctctcaccaccatctccagcagccacacccgcagcaggcaccgcccccgaatcagcagcagccggtgcttccttccttcaggaacgcgctaccggtgcctgtggatggccagatcccagcgcccctcaccttcttcaacccgccgcctgccttcccggagcagcccgcgcagacaacgctggtggatgcggtggggctgacggcagctgctgggcttgggtggaggcagccgagggagcaggaactgcttggagaaaactcccagatgtcgtccatcgattttctgcagacgggctcggcggtatcgacggggctggcgctgtctctggaggaccggcgccacggcggcggcggggctgggaactcctccggcgattcaccgctgctcctgctgcccatgctggacgatgacatttcacgcgaggtccagcggcttgacgctgatatggaccgcttcattaaagctcagagtgaacggctgaggcaatctatactggagaaagttcaggcaaagcaatttgaggcactggcctcagttgaggacaagatattcagaaaaatacgggataaagaggcggaagtggaaaccatcaacaaaaggaactctgaactagaggaccagattaagcatttgggagtggaagttggtgcttggcagcaaagggccaagtacaatgagagcctgatcaatgcactcaagtacaacttggaacaagtatgtgctcaccagagcaaggacttcaaggaaggctgcggtgatagcgaggtatatgacacggcgtcctgtccctatggtggtgctgtcaatttgcaactgatgccaaaggagaacagacaaccgaagaatttaacggcttgcagggtctgtaaatcaagtgaggcatgcatgctcttgttgccgtgtcggcatctttgtctatgcaaggagtgcgagagcaagctgagcatctgccccctgtgccagtcctccaagatacttggcatggagatatattatgcatagaatataatttatgtatcacattagtatcgtacgagatactgctatgttaatacgtcaatctattgccgaagttcagaacctatgtaccactattgacttgccactggatcaaaaaaagactgccgtttatggtagatttaacgct

SEQ ID NO: 1129 - protein, 337 aa, Zea mays
  misc_feature: Ceres CLONE ID no.225881
  misc_feature: Bit score of 286.6 for HMM based on sequences of FIGURE 13.
  misc_feature: Functional Homolog Of Ceres SEEDLINE ID no. ME17578 at SEQ ID NO. 1047
MAFFSHHHLQQPHPQQAPPPNQQQPVLPSFRNALPVPVDGQIPAPLTFFNPPPAFPEQPAQTTLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKIFRKIRDKEAEVETINKRNSELEDQIKHLGVEVGAWQQRAKYNESLINALKYNLEQVCAHQSKDFKEGCGDSEVYDTASCPYGGAVNLQLMPKENRQPKNLTACRVCKSSEACMLLLPCRHLCLCKECESKLSICPLCQSSKILGMEIYYA

SEQ ID NO: 1130 - DNA, 1373 bp, Panicum virgatum
  misc_feature: Ceres CLONE ID no.1806128
  misc_feature: Encodes the peptide sequence at SEQ ID NO. 1131
gaggttgaggacaggatagatatatatactcgctcctcgctctgtaaggaagacgaagaagggcggcggcggcgtcgatcgatcgtctgcgcacgccagccgtgccgatcggtcgccggccagccatggccgtcgaggcgcaccatctgctccacgcgggaggccagaggccgcagctgctggctccccacgaggggtgggcctgggcgggcgacgccgcgtgctgcgaggcgccggcggcgaccgccgcggggcaggggcagcggagactcgcgggcaagcagcagcagcagcagcactacaggttccagcagccgtgcgcggccaccccggccgcggcggcggggccgcggctcgtcgcgccgacggggcggtacgcgcccgggccgcagctgtgcgcggccgacgcgtcggagagcggcgtcacgttcggcggaggtggaggcggcgcgcagcagcaggcgatggcgcccaggaagcggaagcgcgccggcgaggggcagccggcgccggcgctcaggctcgcctccgccgacgtggcggcgcgcttccagcagcagctggtcgatgtcgaccgcctcgtgctccagcacacctcgaagatgtgggcggacctgagggagcaacgccggcggcacgccgggcaggtggtggccgccgtggaggccgcggcggcgaagcggctgcgcgccaaggacgaggagatcgagcacatcgggcgcctcaactgggcgctcgaggagcgggtcaggagcctctacgtggaggcgcaggtgtggcgcgacctggcgcagtccaacgaagccgccgccaacgcgctccgcggcgagctgcagcaggcgctcgacgcccagcaggcgcgctgcggcggcggcgttctcgccgacggcggcgccggcgacgccgagtcgtgctgctgcggggagaacgacgtcgccgccggcggcaccggggccggcgacgagggggaggacgaggcagggacgccggggacgaggaggatgtgcacggtgggcggcgagggcgcggccgaggtgctgatgctgccgtgccggcacctgtgcgcgtgcgcgccgtgcgcgggcgcggcgcgggcgtgcccggcgtgcgggtgcgccaagaacggcagcgtctgcgtcaacttttcgtgatccgtgtgaaatgaaagcaaatagtattagagtaggttctgttttcctcttcttcttttttggtgttttgttttttttgatggggcgatgataggtgctgcggtagtgatgtgtggatacgagaggggtgcatctttgtagctttttctcaagcggttggatggatctatattgatcaacaagaagaaaaaaaagaagagagaagaaaatcagaaaccttgc

SEQ ID NO: 1131 - protein, 341 aa, Panicum virgatum
  misc_feature: Ceres CLONE ID no.1806128
  misc_feature: Bit score of 587.9 for HMM based on sequences of FIGURE 13.
  misc_feature: Functional Homolog Of Ceres SEEDLINE ID no. ME17578 at SEQ ID NO. 1047
MAVEAHHLLHAGGQRPQLLAPHEGWAWAGDAACCEAPAATAAGQGQRRLAGKQQQQQHYRFQQPCAATPAAAAGPRLVAPTGRYAPGPQLCAADASESGVTFGGGGGGAQQQAMAPRKRKRAGEGQPAPALRLASADVAARFQQQLVDVDRLVLQHTSKMWADLREQRRRHAGQVVAAVEAAAAKRLRAKDEEIEHIGRLNWALEERVRSLYVEAQVWRDLAQSNEAAANALRGELQQALDAQQARCGGGVLADGGAGDAESCCCGENDVAAGGTGAGDEGEDEAGTPGTRRMCTVGGEGAAEVLMLPCRHLCACAPCAGAARACPACGCAKNGSVCVNFS

SEQ ID NO: 1132 - DNA, 1664 bp, Panicum virgatum
  misc_feature: Ceres CLONE ID no.1811383
  misc_feature: Encodes the peptide sequence at SEQ ID NO. 1133
acgcgacgccggaattaaaaaccggcaataaatcgcggaattcccaacgctctctctaccgcgctcgcgccgcggcggcggagtccccaatccaaatcccccaacccatccgcccgcgccgacaccgggcacatcggcggcgaatcggctccggtgcgtcgtctccttcccgtcttcccggacccaatcccgccgcctccgcccgcggcggccccaaatcgcattgcggattctcggctcctgttttttttttgtgcgcgttcttcgatcaggggatcgtcgcgatcggatcggcgagggttcggttccacttgagcggcgcggatttgcgcccaatcggaggtcggcggcggcgtctcgggaataatctgctgcgggctcctcctggagacgagcgtaatggacggggaggcgttccggttgggcgcccacctgggctcctcgcacccctctgccgccatggaggatccgattcagacccagaaccagagccagttcctgtttaatgccaagtccgcgcccctgcagctgcagctgtttggaagccccgcggtcactgcggtttgtccttccggttatattgattacactggaaacaactacctttgtgttatgaaccaagcaaggaacacaaacattgatacagggaatgagaaacagctgaagcttcagatgtccttgaacaactatcaccaacaggatgctgatcagttggcacgtgcaagtgctgtatcaaccggtttaaggctgtcctatgaggatgatgagcataattcgtctatcacatctggtagtggtagcatgtcctcgttgcctaccacgacatctcttgttgacgatcttatggctgaaattgacaaagaaaacaaagagattagctattacttaagacttcaggctgagcaaatcggcaggcagatgaaagaggtgaaccagcggcgaatgatatctttcctagcaaaccttgaacgagcggtaggaaagaagctgagggagaaggaactggaggcggaggccatgaacaggaagagcaaggaactgaacgagcagataaggcaagttgccctggaagtccagtcgtggcagtcagctgctctgtacaaccagtcggtcgccaacagcctcaagagcaggctgatggaagtggtggcgcaaaacaccaatctgacaagggaaggctctggcgacagtgaggaggacaatgcagcctccagccagaaccccaatgctggagcacccaggggcttcttccagtccagcctccttggaggccggagcacgacggcaaccgtcggcctgggggcctgcaggtggtgcggcgggaaggaggcatcagtgctggtgatgccgtgccgccacctctgcctgtgcgtagattgtgagagggtctccgatgtgtgccctgtctgccggttccctaagagcggcagtgttgagatcaacatgtcctaacaagaatcctatgtacgtcgaagggcactggacaagcatatacagtaactagatggtaagcctgttccaacagtggtgcacatgttagcatgttttttttttcttgagaagttctggactcggtccgggtgtaaggtcacctcacctgcttgggttttcagaaggtaaaaagggttcaggtttgcatcttgcaaaaaaaaaaaaaaaaaaaa

SEQ ID NO: 1133 - protein, 350 aa, Panicum virgatum
  misc_feature: Ceres CLONE ID no.1811383
  misc_feature: Bit score of 127.2 for HMM based on sequences of FIGURE 13.
  misc_feature: Functional Homolog Of Ceres SEEDLINE ID no. ME17578 at SEQ ID NO. 1047
MDGEAFRLGAHLGSSHPSAAMEDPIQTQNQSQFLFNAKSAPLQLQLFGSPAVTAVCPSGYIDYTGNNYLCVMNQARNTNIDTGNEKQLKLQMSLNNYHQQDADQLARASAVSTGLRLSYEDDEHNSSITSGSGSMSSLPTTTSLVDDLMAEIDKENKEISYYLRLQAEQIGRQMKEVNQRRMISFLANLERAVGKKLREKELEAEAMNRKSKELNEQIRQVALEVQSWQSAALYNQSVANSLKSRLMEVVAQNTNLTREGSGDSEEDNAASSQNPNAGAPRGFFQSSLLGGRSTTATVGLGACRWCGGKEASVLVMPCRHLCLCVDCERVSDVCPVCRFPKSGSVEINMS

SEQ ID NO: 1134 - protein, 347 aa, Oryza sativa subsp. japonica
  misc_feature: Public GI ID no.115458192
  misc_feature: Bit score of 546.3 for HMM based on sequences of FIGURE 13.
  misc_feature: Functional Homolog Of Ceres SEEDLINE ID no. ME17578 at SEQ ID NO. 1047
MAVQAQYLSHASFPHDLYGLRALEGATAAGSLFLDDHGGCAPATPAAAAAGIGHTVLSDLPRSELTCNDNNGAGYGFVPRKRARLDADESAGALMAAAAAQQQRMVLPPHGLVFPGDVQSRAVGCGAASTSGRAGNAAGLSQGLLSQLYHQGVEIDALVRLESERMRAGLEEARRRHVRAVVSTVERAAAGRLRAAEAELERARCRNMELEERLRQMTAEGQAWLSVAKSHEAVAAGLRATLDQLLQSPCAALAVAGAAGAGGAEGDAEDAQSCCYETPCGGDNAGADDAASKTPAAALCKACGAGEASMLLLPCRHLCLCRGCEAAVDACPVCAATKNASLHVLLS

SEQ ID NO: 1135 - protein, 401 aa, Oryza sativa subsp. japonica
  misc_feature: Public GI ID no.49388268
  misc_feature: Bit score of 271.7 for HMM based on sequences of FIGURE 13.
  misc_feature: Functional Homolog Of Ceres SEEDLINE ID no. ME17578 at SEQ ID NO. 1047
MAVQAQYVAHASRSSSSAAYAIRPALENAAPSSGASALFLDEAVSAALLQQQLVVAAAAVGGGGNNNNTAVFSDLRSELTCSQRRFDDFGGGFVPRKRARVGGEGEAAAGLLMSSSVMEGGGHRALLPPPPPQVTPQAFGDVHKSSSRVVGSGAASTSGRPVCGGGLLLSHLYRQSVEVDALVRFEVRATDRAFIYRHGRWSSVSFCLLSSLEWAFDSICTYLQNERLRAGLEEARRRHLRAVVSAVDRAAARRLHAAEAELERALGRNAELDERLRQMGAEGQAWLGIAKSHEAAAAGLRATLDQLLQSPCAAAAAAAEGEGDAEDAQSCCFVQAPDGGAAEVSGGGNGRRACRACGEADACVLLLPCRHLCLCRGCEAAADACPVCAATKNASLHVLLP

SEQ ID NO: 1136 - protein, 340 aa, Oryza sativa subsp. japonica
  misc_feature: Public GI ID no.125590268
  misc_feature: Bit score of 467.0 for HMM based on sequences of FIGURE 13.
  misc_feature: Functional Homolog Of Ceres SEEDLINE ID no. ME17578 at SEQ ID NO. 1047
MAVQAQYLSHASFPHDLYGLRALEGATAAGSLFLDDHGGCAPATPAAAAAGIGHTVLSDLPRSELTCNDNNGAGYGFVPRKRARLDADESAGALMAAAAAQQQRMVLPPHGLVFPGDVQSRAVGCGAASTSGRAGNAAGLSQGLLSQLYHQGVEIDALVRLESERMRAGLEEARRRHVRAVVSTVERAAAGRLRAAEAELERARCRNMELEERLRQMTAEGQAWLSVAKSHEAVAAGLRATLDQLLQSPCAALAVAGAAGAGGAEGDAEDAQSCCYETPCGGDNAGADDAASKTPAAALCKACGAGEASMLLLPCRHLCLCRGLRGRRRRMPGLPVNVIS

SEQ ID NO: 1137 - protein, 343 aa, Oryza sativa subsp. japonica
  misc_feature: Public GI ID no.115444009
  misc_feature: Bit score of 87.1 for HMM based on sequences of FIGURE 13.
  misc_feature: Functional Homolog Of Ceres SEEDLINE ID no. ME17578 at SEQ ID NO. 1047
MDGEMFGSGHWGGSFPYASIPKESQFVFDAKASPLQLQLFGSAAVPAVGSTGYYNYIANNHLSAMNQERNTNNDVGHEKQLNLQMSLNYFPVENLDRLARIGNPSAVSTGLRLSYENNEHTSITSGSGNMSSLPIMASFVDEVMAELDKENKEFNCYFGLQVEQLVKCMKDVKQRQMVEFLASLERGVGKKLKEKELEVEAMNRKSKELNEQIRQVALEVQSWQSVALHNQSVANSMKSKLMQMVAHSSNLTREGSGDSEVDNTASSQNVNAVPGVFFQSGLLGINSMADGGLGACRLCRMKEAAVLVMPCRHLCLCADCEKNADVCPVCRFPKSCSVEINMS

SEQ ID NO: 1138 - protein, 342 aa, Oryza sativa subsp. japonica
  misc_feature: Public GI ID no.115447993
  misc_feature: Bit score of 96.9 for HMM based on sequences of FIGURE 13.
  misc_feature: Functional Homolog Of Ceres SEEDLINE ID no. ME17578 at SEQ ID NO. 1047
MAVQAQYPSSLLFHDRGEPERTKEMDLPRPQMFAGVSPEVYFPSGGASGINRRNKRSREAIAMAPPPAKEELVNLFTLQPQQSTSFVNMAQLHNRVSASPSRAPAALVSTGLRLALDEQQQQQQQQQESKRLKALCYSSSPMPFVSFSDELAGQMKRQDEELDRFIKEQGEQLRRAMADRVRRHNRALLVAAERSAARRLREKALEAEREARRGAELEERLARLRSEAAAWQAKALSEQAAAVSLHAQLQQAAAAARASGDELRGGEAGPAESSSSAYVDPRRSGSDRACLTCRLRPATVVLLPCRHLSLCGDCFAAGDVDVAMACPVCHCVRTGGVEAILC

SEQ ID NO: 1139 - protein, 335 aa, Petunia integrifolia subsp. inflata
  misc_feature: Public GI ID no.82470795
  misc_feature: Bit score of 639.6 for HMM based on sequences of FIGURE 13.
  misc_feature: Functional Homolog Of Ceres SEEDLINE ID no. ME17578 at SEQ ID NO. 1047
MALPHHHLQLHIQQQPQQQSKSYRDIYNNMDGQISTPVAYFNGSNLPEQSQHPPYIPPFQVVGLAPGLVDDGGLDLQWNYGLEPKRKRPKEQDFLENNNSQISSIDFLQPRSVSTGLGLSLDNGRLASSGDSAFLGLVGDDIERELQRQDAEIDRYIKVQGDRLRQAILEKVQANQLQTVTYVEEKVIQKLREKETEVEDINKKNMELELRTEQLALEANAWQQRAKYNENLINTLKVNLQHVYAQSRDSKEGCGDSEVDDTASCCNGRATDLHLLCRDSNEMKELMTCKVCRVNEVSMLLLPCKHLCLCKECESKLSLCPLCQSTKYIGMEIYM

SEQ ID NO: 1140 - DNA, 1068 bp, Sorghum bicolor
  misc_feature: Ceres ANNOT ID no.6033842
  misc_feature: Encodes the peptide sequence at SEQ ID NO. 1141
atggccgtggaatcgcaccgcctcctcttagcgcaacaagggcaagggcagaagcaattcaccaacgcggcggcggcgggatggccttggacgagtaccggcgacgaagctagatgcgcgacggcggcagcgaggccgagccatcatcatcaacaacaggccgcggcggcggcgttccagttccagcagcaggccgcctcgtgcgtcggcgtgggcctgccggcgccgccgcctccggtctcgtcgtcggccgcgccgtacgctgctgctggtgggcaggtcctcgtgggcgacgcggcggagagcggcgtcacgttcggtggaggcgcgggtgcggcgcagcaccaggaggtggtggcgatggcgatggcggcggcgacggcgcccaggaagcggaagcgcgtcgtcgagcaggggcaggcgccgccggttcttgagatcggaggcgcggccgacgtggcggcgcactttcatcagcaactcgtcgacgtcgaccgcctcgtcctccaacacaccgggaagatgtgggcggagctgacggagcagcggcggcggcacgcgcggcaggtggtggccaccgtggaggccgcggcggcgaagcggctccgggccaaggaggaggagatccagcggatggggcgcctcaactgggcgctggaggagcgcgtcaagagcctctacgtggaggcgcaggtgtggcgcgacctggcgcagtccaacgaggccgccgccaacgcgctccgcggcgagctgcagcaggcgctcgacgcccagcaggcgcgcttgtgcggcggcggcggcgccgacgacgccgagtcgtgctgctgcggggagaacgacgtcgccgccggggccggagccggagcagcgggcgcggaggacggggagacgtcgtcgtcgccggcgtacgggaggaggacgtgcgcggtgtgcggcgagggcgcggccgaggtgctgctgctgccgtgccgccacctgtgcgcgtgcgcgccgtgcgcgggcgcggccagggcgtgcccggcgtgcgggtgcgccaagaatggcagcgtctgcgtcaacttttcgtga

SEQ ID NO: 1141 - protein, 355 aa, Sorghum bicolor
  misc_feature: Ceres ANNOT ID no.6033842
  misc_feature: Bit score of 436.7 for HMM based on sequences of FIGURE 13.
  misc_feature: Functional Homolog Of Ceres SEEDLINE ID no. ME17578 at SEQ ID NO. 1047
MAVESHRLLLAQQGQGQKQFTNAAAAGWPWTSTGDEARCATAAARPSHHHQQQAAAAAFQFQQQAASCVGVGLPAPPPPVSSSAAPYAAAGGQVLVGDAAESGVTFGGGAGAAQHQEVVAMAMAAATAPRKRKRVVEQGQAPPVLEIGGAADVAAHFHQQLVDVDRLVLQHTGKMWAELTEQRRRHARQVVATVEAAAAKRLRAKEEEIQRMGRLNWALEERVKSLYVEAQVWRDLAQSNEAAANALRGELQQALDAQQARLCGGGGADDAESCCCGENDVAAGAGAGAAGAEDGETSSSPAYGRRTCAVCGEGAAEVLLLPCRHLCACAPCAGAARACPACGCAKNGSVCVNFS

SEQ ID NO: 1142 - DNA, 882 bp, Sorghum bicolor
  misc_feature: Ceres ANNOT ID no.6029952
  misc_feature: Encodes the peptide sequence at SEQ ID NO. 1143
atggccatgcaagcgcggcaccactcccacgactacttcctatcgagggccggctccctgttcttggacgagtacgccgggtgcgtgcccctgccaacgtcgccggcggtggggatccgggacatgccgctgctcagcgactttgcaggcagcgagcttagctttggctacagtttcctgccgaggaagcgggcgcgcatggaggatcaccgcgttgttctgcccccggcggtgatgcaggggctggtgcaagtgcaagtgcaactgccgatgacatccagtaacgtgatgggttccggcgccgtgacgtccacaagtgggagggagatcgacgcgctgctaagagtggagagcgagaggatgcgcgcggcgctggaggcggcgtggcggaggcacgcgcgggcgctggcgtccgccgtgggtcgaacagcggcgggacggatgcgcgcggcggagtcggagctggacggcgcgctgcggcgcaacggggagctggaggagacggcgcggcagatggtcgcggagtgccaggcgtggatgggcgtcgcgaggagccacgaggccgtcgccgccggcctccgcgcctcactcgaccagctcctcctccagtcgcccccctgcgcggtggcgactggcggcgcttgcgagggtcatggggagaccgaggacgcgcggtcgtgctgcttcgagccaggctgctccggcggccgcggaccacagggggcggtggaggagtgcaggtcgtgcggcggcggcgaggcgtgcgtgctgctgctcccgtgccgccacctgtgcctgtgccgcgcgtgcgaggccgccgtcgacgcctgcctcgtctgcgccgcagccaagaacgcatcgctccttgtcctggtctcttga

SEQ ID NO: 1143 - protein, 293 aa, Sorghum bicolor
  misc_feature: Ceres ANNOT ID no.6029952
  misc_feature: Bit score of 216.7 for HMM based on sequences of FIGURE 13.
  misc_feature: Functional Homolog Of Ceres SEEDLINE ID no. ME17578 at SEQ ID NO. 1047
MAMQARHHSHDYFLSRAGSLFLDEYAGCVPLPTSPAVGIRDMPLLSDFAGSELSFGYSFLPRKRARMEDHRVVLPPAVMQGLVQVQVQLPMTSSNVMGSGAVTSTSGREIDALLRVESERMRAALEAAWRRHARALASAVGRTAAGRMRAAESELDGALRRNGELEETARQMVAECQAWMGVARSHEAVAAGLRASLDQLLLQSPPCAVATGGACEGHGETEDARSCCFEPGCSGGRGPQGAVEECRSCGGGEACVLLLPCRHLCLCRACEAAVDACLVCAAAKNASLLVLVS

SEQ ID NO: 1144 - DNA, 975 bp, Sorghum bicolor
  misc_feature: Ceres ANNOT ID no.6035837
  misc_feature: Encodes the peptide sequence at SEQ ID NO. 1145
atggccgtgcacgcgcagtaccacgccttcccacatgaccttgaccaccgcgccatcaccagctcgccagcgctggacaacgacgccacgaccgcatcggcgttcctcgtcgccgaccccgcaaccgcggctggcggccgcaacacggtgctcagcgacctcacctgcgacggcgacaacaacgacacaggctgcctccgcaagaggaagcgcgcgcgggtgaccatggacctgcaaggccagcgtgctcttctgcccccgacgccggtgccggtgccggggccgcaggcgttggcgctggcgcccacgggggatgtgcagagtagagcgctctgcggctctgccttcgcgtccaccagtggcgccgcgccagtgtcgcagggcctcctctcgcacctctaccgccacagcgtcgagatcgacctccttctccttctccgcatcgagactgagcggctgcgggcgaggctccaggacgcgcggcgccggcacgcccgcgccgtgctgtcggcggtggaacgcgccgcggcgcggcgcctgagggcggcggaggccgggctggagcgcgcgctggcgcgcaacgcagagcttgaccagaggctccggcagacggaagccgagggagcagcgtggcaggacctcgccaggagccacgagggcgtcgcggcaggcctacgcgccgcgctcgacagcctgtcgccacgcgacggctcgggcgccgtgggcgacgccgaggacgcgcagtcatgctgcttcgagtggaagcaggagcagggacacggcgaggacgccgaggcatccggcggcgggcggaaaagggcgtgcaggtggtgcggcgaggcggaggcgtgcgtgctgctgctgccgtgccggcacctgtgcctgtgccgccggtgcgagggcgaggcgggcgtcgaggcgtgccccgtgtgcgccgccaccaagaacgcctcgctccacgtcctcctctcctga

SEQ ID NO: 1145 - protein, 324 aa, Sorghum bicolor
  misc_feature: Ceres ANNOT ID no.6035837
  misc_feature: Bit score of 261.3 for HMM based on sequences of FIGURE 13.
  misc_feature: Functional Homolog Of Ceres SEEDLINE ID no. ME17578 at SEQ ID NO. 1047
MAVHAQYHAFPHDLDHRAITSSPALDNDATTASAFLVADPATAAGGRNTVLSDLTCDGDNNDTGCLRKRKRARVTMDLQGQRALLPPTPVPVPGPQALALAPTGDVQSRALCGSAFASTSGAAPVSQGLLSHLYRHSVEIDLLLLLRIETERLRARLQDARRRHARAVLSAVERAAARRLRAAEAGLERALARNAELDQRLRQTEAEGAAWQDLARSHEGVAAGLRAALDSLSPRDGSGAVGDAEDAQSCCFEWKQEQGHGEDAEASGGGRKRACRWCGEAEACVLLLPCRHLCLCRRCEGEAGVEACPVCAATKNASLHVLLS

SEQ ID NO: 1146 - DNA, 1020 bp, Sorghum bicolor
  misc_feature: Ceres ANNOT ID no.6035830
  misc_feature: Encodes the peptide sequence at SEQ ID NO. 1147
atggccgtgcacgcgcagtacttgtcccatgccttctcccatgaccaccgcgccatctgcagcccggcgctggataacgcaacgagcgcgtcgccgtcgtccctcggccatcccggcggcggccacccgcttcccgccgcggtgggcggcaacacagtgctcagcgacctcaccagcagcaacaacaacggttgcttcttgccgaggaagcgcgcgcgggttggggacgtgtccggcgccggcgcgggcttgatcatggacctgcaaggccaacgcgctctgctgccgccagtgccggtgccggtgccggtgctcgcgggagacgtccagaggaggctgctctgctctgccgccgcgtccaccactaccagtggccgcccgaccgccagcgtcgcgccggtgtcgcagtcgcagggcctcctgtcgcacctctaccaccacggcgtcgagattgacgcgctcgtccgcatcgagaacgagaggctgcgagcggggctgcgggaggcgcggcgccggcacgtccggacggtggtgtcggcggtggagcgcgcggcggcgcggcgcctgcgggcggccgaggccgaactggagcgcgccctggcgcgcaacgcggagctcgacgggaggctccggcagacggaagccgaggggcaggcgtggcaggacatcgccaggtgccacgagggcgtcgcggcgggcctacgcgccacgctcgacaacatcatgcagacgcagacgcagccgccatgcgccggcgcaggggatgatgcaggcgccgacggcgacgccgaggacgcgcagtcgtgctgcttcgagttggagcaggagcagggcgagggcggcgaggcgtccggcgggcggcggacgagggcgtgcaggtggtgcggcgcggcggaggcgtgcgtgctgatgctgccgtgccggcacctgtgcctgtgccgcgggtgcgaggcgggcgtccaggcgtgccccgtgtgcgcggccaccaagaacgcatcgctccacgtcctcctgcactga

SEQ ID NO: 1147 - protein, 339 aa, Sorghum bicolor
  misc_feature: Ceres ANNOT ID no.6035830
  misc_feature: Bit score of 302.9 for HMM based on sequences of FIGURE 13.
  misc_feature: Functional Homolog Of Ceres SEEDLINE ID no. ME17578 at SEQ ID NO. 1047
MAVHAQYLSHAFSHDHRAICSPALDNATSASPSSLGHPGGGHPLPAAVGGNTVLSDLTSSNNNGCFLPRKRARVGDVSGAGAGLIMDLQGQRALLPPVPVPVPVLAGDVQRRLLCSAAASTTTSGRPTASVAPVSQSQGLLSHLYHHGVEIDALVRIENERLRAGLREARRRHVRTVVSAVERAAARRLRAAEAELERALARNAELDGRLRQTEAEGQAWQDIARCHEGVAAGLRATLDNIMQTQTQPPCAGAGDDAGADGDAEDAQSCCFELEQEQGEGGEASGGRRTRACRWCGAAEACVLMLPCRHLCLCRGCEAGVQACPVCAATKNASLHVLLH

SEQ ID NO: 1148 - DNA, 1047 bp, Sorghum bicolor
  misc_feature: Ceres ANNOT ID no.6029981
  misc_feature: Encodes the peptide sequence at SEQ ID NO. 1149
atggccgtccaggcgcagcacctactcaaccccgccttcctcccccaccacgacctcgcccacgccttcagggcgctggaaggtgccgcggtcggtgccgccgtcggcggcaacttgttcttggacgagctcggcttcgtcgggtgcgcgccgccagcgccagcgcccatcggggacgccccgttcgtcgacgcccagccgcgcagcgagctcacctgcaacggcagcggcggcgacaacaacaacaacgtgttcctcccgaggaagcgggcacgcgttgcgccggggttcctggatgatggcagccaccagcagcaggggttggttctgcccctcccgctgccgccgcacgtccaggtgttcgccggcgacgtgcagacctgcagagccggagggtgcggcgcggcgtccaccagcggtcgggccgcggtggcgtccaatgccgtcctctcgcagctctaccaccagggcgtggagatcgacgcgctggtgcggctcgagaccgagaggatgcgcgcggggctccaggaggctcgccgtcggcacgcgcgcgcggtggtggcggccgtggaacgcgccgcgtccggtcggctccgcgcggcggaggccgacctgatgcgcgcccggtgccgcaacgcggagctggaggagaggcttcggcagctggcgtccgagggccaggcgtggctgggcgtggccaggagccacgaggccgtcgccgcgggcctccgcgccacgctggaccagctgctgctgcagcagcagcagcccgccgccggcgccgactgtggcggcggcgaggcggaggacgcgcagtcgtgctgcttcgagacgtccccgtcgggccttgtcgccgacgacgcggcgtccaggggtggtgcctcgtcgccgccgtcgccgtcgtgcaagtcctgcggcggcggcgacgcgtgcgtgctgctgctcccgtgccggcacctgtgcctgtgccgcgcgtgcgagcccgccgccgaggtgtgccccgtctgcgccgcggccaagaacgcctcgctccaggtcctgctgtga

SEQ ID NO: 1149 - protein, 348 aa, Sorghum bicolor
  misc_feature: Ceres ANNOT ID no.6029981
  misc_feature: Bit score of 357.8 for HMM based on sequences of FIGURE 13.
  misc_feature: Functional Homolog Of Ceres SEEDLINE ID no. ME17578 at SEQ ID NO. 1047
MAVQAQHLLNPAFLPHHDLAHAFRALEGAAVGAAVGGNLFLDELGFVGCAPPAPAPIGDAPFVDAQPRSELTCNGSGGDNNNNVFLPRKRARVAPGFLDDGSHQQQGLVLPLPLPPHVQVFAGDVQTCRAGGCGAASTSGRAAVASNAVLSQLYHQGVEIDALVRLETERMRAGLQEARRRHARAVVAAVERAASGRLRAAEADLMRARCRNAELEERLRQLASEGQAWLGVARSHEAVAAGLRATLDQLLLQQQQPAAGADCGGGEAEDAQSCCFETSPSGLVADDAASRGGASSPPSPSCKSCGGGDACVLLLPCRHLCLCRACEPAAEVCPVCAAAKNASLQVLL

SEQ ID NO: 1150 - DNA, 1206 bp, Arabidopsis thaliana
  misc_feature: Ceres SEEDLINE ID no.ME18158
  misc_feature: Inplanta Sequence
  misc_feature: Encodes the peptide sequence at SEQ ID NO. 1151
atggatctctccgacatccgaaacaacaacaacgacaccgccgccgtcgccaccggaggaggagcaagacagctagttgacgcatctctctcaatcgttcccagatctacacctcccgaagactcaacactcgcaacaacctcatctacggcaacggcgactacaacgaagcggtcgactaaagaccgtcacacgaaagtcgacggaagaggacgtcggattcgtatgccggcgctatgtgcagctagagtttttcagttaacgagagagttaggtcataaatccgatggtgaaactattgaatggcttcttcaacaagctgagccagctattgttgctgctacaggtacaggaactattccggcgaacttctctactttaagtgtttcgttacgaagtagtggatcgactctctctgctccgccgtcgaaatcggtgccgctttacggtgctcttggattgactcatcatcagtatgatgaacaaggaggcggcggtgtgtttgctgctcatacgtcgccgcttttagggtttcatcatcagcttcaacaccaccagaaccagaatcagaatcaagatccggtggaaactattcctgaaggtgagaatttctctaggaaacggtatagatcggttgatttgtctaaagaaaacgatgatcggaaacagaacgagaataaatctttgaaagaaagtgaaacgtcgggtcctacggcggcgccgatgtgggcggttgcgccgccgagtaggtctggtgctgggaacactttttggatgcttccggtaccgacaacggccggtaatcaaatggagagtagtagcaacaataacaccgccgcaggccaccgtgctcctcctatgtggccatttgtgaactctgctggaggaggagcgggaggtggaggcggagcagcgactcactttatggcgggaacggggtttagttttccgatggatcagtacagaggaagtccacttcagttaggttcttttttagctcagccgcagccgactcagaacttaggactaagtatgccggactcgaatctcgggatgttagccgctttgaactcggcttattcaagaggcggaaacgcaaacgcgaatgcggaacaagcgaacaatgcggtggagcatcaagagaagcagcaacagagtgatcatgatgatgatagtagagaggagaactcaaatagctctgagtga

SEQ ID NO: 1151 - protein, 401 aa, Arabidopsis thaliana
  misc_feature: Ceres SEEDLINE ID no.ME18158
  misc_feature: Bit score of 727.1 for HMM based on sequences of FIGURE 14.
  misc_feature (44)..(302): Pfam Name: TCP Pfam Description: TCP family transcription factor
MDLSDIRNNNNDTAAVATGGGARQLVDASLSIVPRSTPPEDSTLATTSSTATATTTKRSTKDRHTKVDGRGRRIRMPALCAARVFQLTRELGHKSDGETIEWLLQQAEPAIVAATGTGTIPANFSTLSVSLRSSGSTLSAPPSKSVPLYGALGLTHHQYDEQGGGGVFAAHTSPLLGFHHQLQHHQNQNQNQDPVETIPEGENFSRKRYRSVDLSKENDDRKQNENKSLKESETSGPTAAPMWAVAPPSRSGAGNTFWMLPVPTTAGNQMESSSNNNTAAGHRAPPMWPFVNSAGGGAGGGGGAATHFMAGTGFSFPMDQYRGSPLQLGSFLAQPQPTQNLGLSMPDSNLGMLAALNSAYSRGGNANANAEQANNAVEHQEKQQQSDHDDDSREENSNSSE

SEQ ID NO: 1152 - DNA, 1598 bp, Gossypium hirsutum
  misc_feature: Ceres CLONE ID no.1918070
  misc_feature: Encodes the peptide sequence at SEQ ID NO. 1153
tttttttttgagatggtttaatttggcagacaaagaaatccttggaaaccccatatgcagataatggagtcacagagcaataaaagcagcaatagcagtgagcatcatcatcatcaccatggccaaaaacaagaagcttcactgcaactagtctcccgtgatggtcaaccacaagctgctgctggtgccgcacatgggacctcctcccatcaggctcaggctcagactcaggcacagcctcaggccccaggtcatcatgtctcattcatgggctccatttccaaccaaattggggttccctcttcctcccctacttccacttcttccctcgctaagcctcctgctgccaaaagacccaccaaagaccgtcacaccaaggtcgatggccgcggccgtcgcatccgaatgcccgccgtttgcgccgccagggtcttccaactcacccgagaattgggtcataaatcagatggtgagaccatcgagtggctgcttcaacaagcggaacctgccatcatagctgcaacgggaaccggcactattccagccaatttctccactctcaacgtttcacttcgcagcagtggatcaaccatttcagctccttcatcaaaatccgcacctctctccttccacagcgctttaggtttttacaacagtaatggagatgaggccagaaggatcggcaacagtaccgccatgctagggtttcatcatcaactttaccctcagctccttcaccccgaaactcacatgagaagtggcagtaaccctaacgacaactacgctacaaagccattcagagatgaccttttcaaagaaacatctcagcacaatgctgaaacgggtgccatagacgcgaattctcctaaaccggagagaaccggaatgccagaacaagaacccggtttttttcaaacagccaacgtcatgccagctccagctatgtgggccgttgcaccggccaccaccaatggaggtaatgccttttggatgctgccggtaggcggtggcgccacagcatcttcagccacagtgccagaagcccagatgtggacattcccggctcattattcaggtggggctagagggaatccggttcagctgggctcaatgatattgcaacaacagcaggccgggggtcaacagcttggtttaggagtgacggagactaacatggggttacttggcagtagaatgaatgtttacagcaacaataatagagtgggtttaaaaatgaatttggaacagcagcatcatcatgaaaatcaaactcaaggcagtgacagtggagatgaaaatccagctacagattcccaatgatacaattctcaacttttttttttaaattttacctttttgtaaatgcacgtgttttgttactatttttggattgttgattgctagctattagctttgatcctctagtaggatgctgaactgttgtaattgatgtgcagttgggtgtcaaagattgcccattaaactagcacatcccatcatttccatttcccaactattagaagtgtgaaaatatggagaagaaaacgattataacaaaataaagaatattttcatgccaaaaaaaaaaaaaaaaaaaa

SEQ ID NO: 1153 - protein, 350 aa, Gossypium hirsutum
  misc_feature: Ceres CLONE ID no.1918070
  misc_feature: Bit score of 660.3 for HMM based on sequences of FIGURE 14.
  misc_feature (20)..(119): Pfam Name: TCP Pfam Description: TCP family transcription factor
  misc_feature: Functional Homolog Of Ceres SEEDLINE ID no. ME18158 at SEQ ID NO. 1151
MGSISNQIGVPSSSPTSTSSLAKPPAAKRPTKDRHTKVDGRGRRIRMPAVCAARVFQLTRELGHKSDGETIEWLLQQAEPAIIAATGTGTIPANFSTLNVSLRSSGSTISAPSSKSAPLSFHSALGFYNSNGDEARRIGNSTAMLGFHHQLYPQLLHPETHMRSGSNPNDNYATKPFRDDLFKETSQHNAETGAIDANSPKPERTGMPEQEPGFFQTANVMPAPAMWAVAPATTNGGNAFWMLPVGGGATASSATVPEAQMWTFPAHYSGGARGNPVQLGSMILQQQQAGGQQLGLGVTETNMGLLGSRMNVYSNNNRVGLKMNLEQQHHHENQTQGSDSGDENPATDSQ

SEQ ID NO: 1154 - DNA, 1617 bp, Gossypium hirsutum
  misc_feature: Ceres CLONE ID no.1851526
  misc_feature: Encodes the peptide sequence at SEQ ID NO. 1155
ttttttgagatggtttaatttggcagacaaagaaatccttggaaaccccatatgcagataatggagtcacagagcaataaaagcagcaatagcagtgagcatcatcatcatcaccatggccaaaaacaagaagcttcactgcaactagtctcccgtgatggtcaaccacaagctgctgctggtgccgcacatgggacctctcatcaggctcaggctcagactcagactcaggcacagccgcaggccccaggtcatcatgtctcattcatgggctccatttccaaccaaattggggttccctcttcctcccctacttccacttcttccctcgctaagcctcctgctgccaaaagacccaccaaagaccgtcacaccaaggtcgatggccgcggccgtcgcatccgaatgcccgccgtttgcgccgccagggtcttccaactcacccaagaattgggtcataaatcggatggtgagaccatcgagtggctgcttcaacaagcggaacctgccatcatagctgcaacaggaaccggcactattccagccaatttctccactctcaacgtttcacttcgcagcagtggatcaaccatttcagctcctccatcaaaatccgcacctctctctttccacagcgctttaggtttttacaacagtaatggagatgaggccagaaggatcggcaacagtaccgccatgctagggtttcatcatcaactttaccctcaactccttaaccctgaaactcacatcagaagtggcggtaaccctaacgacaactacgctacaaagccattcagagatgaccttttcaaagaaacatctcagcacaatactgaaacgggtgccatagacgcgaattctcctaaaccggagagaaccggaatgccagaacaagaacccggtttgtttcaaacaaccaacgtcatgccagctccagctatgtgggccgttgcaccggccaccaccaatggaggtaatgccttttggatgctgccggtaggcggtggcgccacagcagcttcagccacggtgccagaagcccagatgtggacattcccggctcattattcaggtgggggtagagggaatccggttcagctgggctcaatgatattgcaacaacagcaggccgggggtcaacagcttggtttaggagtgacagagactaacatggggttacttggcagtggaatgaatgtatacagcaacaataatagagtgggtttaaaaatgaatttggaacagcagcatcatcatgaaaatcaaactcaaggcagtgacagtggagatgaaaatccagctacagattctcaatgatacaattcccaaattcagctcacatatttctactttaattttttttttaacctttttgtaaatgcatgtgttttgttactatttttagattgttgattgctagctattagctttgatcctctagtaggatgctgaactgttgtaattgatgtgcagttgggtgtcaaagattgcccattaaactagcacatcccatcatttccatttcccaactattaaaagtgtgaaaatatggagaagaaaacgattataacaaaataaagaatattttcatgccaaaaaaaaaaaaaaaaaaaa

SEQ ID NO: 1155 - protein, 350 aa, Gossypium hirsutum
  misc_feature: Ceres CLONE ID no.1851526
  misc_feature: Bit score of 665.3 for HMM based on sequences of FIGURE 14.
  misc_feature (20)..(119): Pfam Name: TCP Pfam Description: TCP family transcription factor
  misc_feature: Functional Homolog Of Ceres SEEDLINE ID no. ME18158 at SEQ ID NO. 1151
MGSISNQIGVPSSSPTSTSSLAKPPAAKRPTKDRHTKVDGRGRRIRMPAVCAARVFQLTQELGHKSDGETIEWLLQQAEPAIIAATGTGTIPANFSTLNVSLRSSGSTISAPPSKSAPLSFHSALGFYNSNGDEARRIGNSTAMLGFHHQLYPQLLNPETHIRSGGNPNDNYATKPFRDDLFKETSQHNTETGAIDANSPKPERTGMPEQEPGLFQTTNVMPAPAMWAVAPATTNGGNAFWMLPVGGGATAASATVPEAQMWTFPAHYSGGGRGNPVQLGSMILQQQQAGGQQLGLGVTETNMGLLGSGMNVYSNNNRVGLKMNLEQQHHHENQTQGSDSGDENPATDSQ

SEQ ID NO: 1156 - DNA, 1630 bp, Gossypium hirsutum
  misc_feature: Ceres CLONE ID no.1948426
  misc_feature: Encodes the peptide sequence at SEQ ID NO. 1157
gctcttaaagcttgccctcttcccttatcctttctctctttatctgcgtcaaaacacatgaattctctacaggaattttccaggctaagcttttgatgggaaagcaaatacaaataaaacccaaattaattcataacactccctccctatcatcccctctacatcatttttactctttttcaaaaaacacaaagatccaaagacccaccaaacgaataagttactagattttccgatccattagagaaacgacctattactttcatgatatcatggaaggaggaggaagtgatgatcatcaactccaccaccaccaccaacaccgccctactttcccattccaattacttgagaagaaacaagatgatatccagccttgttcttcctcttcttcccctcctttcccttcccttctcccaccttcctcctcttcttcaccctctgctgatcaacccaacacgagtcgttccatttcaagcctccaaatctcgccggaaccttgtaaaaaaccaccccctaaacgtacttcaaccaaagatcgacataccaaggtcgatggacgtggccgtaggatccgaatgccagctctttgtgcagccagggtttttcaacttactcgtgaattaggccataaatctgatggtgaaaccattgaatggctactccaacaagctgaacctgctgtggtcgccgccactggtactggaaccatcccagcaaacttcacttccctcaacatctccctccgaagttcaggctcaaccatgtcggttccctctcacttacgatcctcaggtttcaactccaacttctctatgcaacaacgtagaagtctgttcccaggaattggattagaaacaaccccgacattccttaacttccaatcaagcagtaacttgaattccatgttccaagctaagcaagagttgcgtgatcataatagttcttcgttggaaatatcagcaaatgaagaaaatagtctaggaaggaagagaagacccgagcaagatttatcttcacaacatcaaatggggagttacttgttgcagtcaagcaccggcgtgattccagcagcaactcacggtcagattccggctaatttttggatggtaactaattctaataatcaagtaattagcggcgaccctatatggacgtttccttccgtgaatagcagtgctttgtataggggcactatgtctagtggattgcatttcatgaattttccagctccgatggctttattaccaggccaacaattgggttcgagcggtgttaccagtggcgctgctggtggtggtggtggaggaggaagtaccggcataagtgctgaaggacatttaaatatattagctggattgaatccttatcggcaagtatccgaatcacaagcgagcgggcctcattcaaacaacgacggcggaggaggaggagctgcaggtggtggtggaagcgccggaggcggcgataaccgacatgatgcaactagtcatcagtcgtagagttgatcaaataccaccatgcatcgatcatctctttgcttgtttcgatcagttgtgtagttcgatgtgtaacacacgtgaggtttgattgttctttcaaataacaacaaaaaaaaaaaaaaaaaaaa

SEQ ID NO: 1157 - protein, 409 aa, Gossypium hirsutum
  misc_feature: Ceres CLONE ID no.1948426
  misc_feature: Bit score of 624.9 for HMM based on sequences of FIGURE 14.
  misc_feature (71)..(236): Pfam Name: TCP Pfam Description: TCP family transcription factor
  misc_feature: Functional Homolog Of Ceres SEEDLINE ID no. ME18158 at SEQ ID NO. 1151
MEGGGSDDHQLHHHHQHRPTFPFQLLEKKQDDIQPCSSSSSPPFPSLLPPSSSSSPSADQPNTSRSISSLQISPEPCKKPPPKRTSTKDRHTKVDGRGRRIRMPALCAARVFQLTRELGHKSDGETIEWLLQQAEPAVVAATGTGTIPANFTSLNISLRSSGSTMSVPSHLRSSGFNSNFSMQQRRSLFPGIGLETTPTFLNFQSSSNLNSMFQAKQELRDHNSSSLEISANEENSLGRKRRPEQDLSSQHQMGSYLLQSSTGVIPAATHGQIPANFWMVTNSNNQVISGDPIWTFPSVNSSALYRGTMSSGLHFMNFPAPMALLPGQQLGSSGVTSGAAGGGGGGGSTGISAEGHLNILAGLNPYRQVSESQASGPHSNNDGGGGGAAGGGGSAGGGDNRHDATSHQS

SEQ ID NO: 1158 - DNA, 1385 bp, Gossypium hirsutum
  misc_feature: Ceres CLONE ID no.1937875
  misc_feature: Encodes the peptide sequence at SEQ ID NO. 1159
atcatggaaggaggaggaagtgatgatcatcaactccatcatcaccaccaccaccaccaccaccgacagcagcagcaacaccgccccactttcccattccaattacttgagaagaaagaagatgataaccagccttgttcttcctcttcttcccctcctttcccttcccttgtcccaccttcttcctcttcttcatcctctgctgatcaacccaacacgagtcgttccatttcaagcctccaaatctcgccagaaccttttaaaaaaccaccccctaaacgtacttcaaccaaagatcgacataccaaggtcgatggacgtggccgtaggatccgaatgccagctctttgtgcagccagggtttttcaactcactcgtgaattaggccataaatctgatggtgaaaccattgaatggctactccaacaagctgaaccagctgtgatcgccgccactggtactggaacaatcccagcaaacttcacttccctcaacatctccctccgcagttcaggctcaaccatgtcggttcccactcagttacgatcctcaggtttcaactccaacttctctatgcaacaacgtagaagtctgttcccaggaattggattagaaacaaccccgacattccttaacctccaatcaagcagtaacttgaattccatgttccaagctaagcaagagttgcgtgatcataatagttcttcgttggaaatatcagcaaacgaagaaaatagtctaggaaggaagagaagacccgagcaagatttatcttcacaacatcaaatggggagttacttgttgcagtcaagcactggcgtgattccagcagcaactcacggtcatattccggctaatttttggatggtaactaattctaataatcaagtaatgagcgacgaccctatatggacgtttccttccgtgaatagcagtgctttgtataggggcactatgtctagtggattgcatttcatgaattttccagctccgatggcgttattgccaggccaacaattgggttcaagcggtgttactagtggcgctgctgctgctgctggtggaggaggaagtaccggcataagtgctgaaggacatttaaatatattagctggattgaatccttatcggcaagtatccgaatcacaagcgagcgggtctcattcaaacaacgacagcggaggaggaggaggtgcaggtggtggtcgaagcgccggaggcggcgataaccgacatgatgcaactagtcatcagtcgtagagttgatcaaataccaccatgcatcgatcatctctttgcttgtttcgatcagttgtgtagtttgatgtgtaacacacgtgaggtttgattgttctttcaaataacaaaaaaaaaaaaaaaaaaaa

SEQ ID NO: 1159 - protein, 418 aa, Gossypium hirsutum
  misc_feature: Ceres CLONE ID no.1937875
  misc_feature: Bit score of 624.7 for HMM based on sequences of FIGURE 14.
  misc_feature (80)..(179): Pfam Name: TCP Pfam Description: TCP family transcription factor
  misc_feature: Functional Homolog Of Ceres SEEDLINE ID no. ME18158 at SEQ ID NO. 1151
MEGGGSDDHQLHHHHHHHHHRQQQQHRPTFPFQLLEKKEDDNQPCSSSSSPPFPSLVPPSSSSSSSADQPNTSRSISSLQISPEPFKKPPPKRTSTKDRHTKVDGRGRRIRMPALCAARVFQLTRELGHKSDGETIEWLLQQAEPAVIAATGTGTIPANFTSLNISLRSSGSTMSVPTQLRSSGFNSNFSMQQRRSLFPGIGLETTPTFLNLQSSSNLNSMFQAKQELRDHNSSSLEISANEENSLGRKRRPEQDLSSQHQMGSYLLQSSTGVIPAATHGHIPANFWMVTNSNNQVMSDDPIWTFPSVNSSALYRGTMSSGLHFMNFPAPMALLPGQQLGSSGVTSGAAAAAGGGGSTGISAEGHLNILAGLNPYRQVSESQASGSHSNNDSGGGGGAGGGRSAGGGDNRHDATSHQS

SEQ ID NO: 1160 - protein, 225 aa, Gossypium hirsutum
  misc_feature: Ceres CLONE ID no.100056542
  misc_feature: Bit score of 229.8 for HMM based on sequences of FIGURE 14.
  misc_feature (21)..(120): Pfam Name: TCP Pfam Description: TCP family transcription factor
  misc_feature: Functional Homolog Of Ceres SEEDLINE ID no. ME18158 at SEQ ID NO. 1151
MALSSSSADQTNTPTSISALQISPDPSKKPPPKRTSTKDRHTKVDGRGRRIRMPALCAARVFQLTRELGHKSDGETIEWLLQQAEPAVIAATGTGTIPANFTSLNISLRSSGPSMSVPSQLRSSGFNSNFSMQQRRSLFPGIGLETTPTFLNFQSNTSSNLNFMFQTKQELRDNDGTSLEISETERRCSRKEKKTRPRFIFTTSNGELLVAVKHWGNPGGKSRSD

SEQ ID NO: 1161 - protein, 314 aa, Gossypium hirsutum
  misc_feature: Public GI ID no.5731257
  misc_feature: Bit score of 351.8 for HMM based on sequences of FIGURE 14.
  misc_feature (82)..(181): Pfam Name: TCP Pfam Description: TCP family transcription factor
  misc_feature: Functional Homolog Of Ceres SEEDLINE ID no. ME18158 at SEQ ID NO. 1151
MEGGGSDDHHHHHHSHHHHHQQPLHHHHHHHHRPTFPFQLLEKKEEDNQPCSSSSSLPFPSLPVSSSSADQHTSTRSISTHQISPETSKTPPPKRTSTKDRHTKVDGRGRRIRMPALCAARVFQLTRELGHKYNGETIEWLLQQAEPAVIAATGTGTIPANFTSLNISLRSSGSSMSVPSQLRSSGFSSNFSMQQRRSLFPGIGLETTPTPTTFLNFQSSSTSLGISEEAEESSLGRKRRPEQDLSSQHHQNGELLVASSTVHSGESPRSSSGNFWMVTNSNNQAMSGGDPIWTFLQLITVVCIGELCLVGCIS

SEQ ID NO: 1162 - protein, 179 aa, Gossypium hirsutum
  misc_feature: Ceres CLONE ID no.100058043
  misc_feature: Bit score of 153.7 for HMM based on sequences of FIGURE 14.
  misc_feature (43)..(133): Pfam Name: TCP Pfam Description: TCP family transcription factor
  misc_feature: Functional Homolog Of Ceres SEEDLINE ID no. ME18158 at SEQ ID NO. 1151
MIMDENGIRRPNFPLQLLEKKEQPRSDPADVDTSSKPTLEPPSKKPPPKRTSTKDRHTKVEGRGRRIRMPATCAARVFQLTRELGHKSDGETIEWLLQQAEPAVFAATGTGTIPANFTSLNISLRSSGSSMSASYLRNTYFNPNFTTQKLRTGSEWDQRNVLDDSSQQQQQQRRGFISW

SEQ ID NO: 1163 - DNA, 1745 bp, Gossypium hirsutum
  misc_feature: Ceres CLONE ID no.1838288
  misc_feature: Encodes the peptide sequence at SEQ ID NO. 1164
gctgatcaccattctcttccctctctctctctctctcacagacacacaccctctttgtttgtaaaagaaattctaattccaattccttttctttctagattttttgtgggttgtgtccattaatcttctccagcaattaccccataacagctagacaaagcttttatagtctttgaagcgaaaactaaagctaaactacataaagggtaagagtgtggtagtcctgctcctgcccccacgatgtccaattcagagactgctgctactaacggatcgttaatggacccacagagacatcaggcgccggcagccaatggttcacttgccgttaaaaagcctcccaccaaagaccgtcacagcaaagttgatggtcgtgggagaaggatcaggatgcccatcatttgcgccgctcgtgttttccagttgacccgcgaattgggtcataagtccgatggtcagactatcgagtggctgttgcgtcaggctgagccttctattatagccgccactggtacagggacgactcctgctagtttttccaccgtgtcggtttccctccgcggagctaattctacttctttgtcgtcgaccacttcttcgtctttggatcataagcctcttttgggtcctaccccgtttatactggggaaacgcgtccggtccgacgacgataacgccggaaaggacgatttcggagggctcactgttggaccaggcgtgggttccattgtgggaccgaacgggacacatccgggtgggttctgggctcttccagcaaggccagactttggtcaattgtggagcttcgcggccccgcctccgccggatatggtagtacaggcggctgctcagcaacccgctgctgctgctgcgttgttcgttcaacaacagcaagcgatgggagaagcgtcggcggctagggtcggcaattatcttcctggtcacctaaacttgttagcctcgttgtcaggtgctccgggaggatcgggtcgaagagacgaggatccgcattaaaatttggtggaccattttacccttcctgttgttgggagtatatatagattctataaatatttgtgtatggttgttgcttttttgtgtgtgcgaggatgtggaagatgattgctagttggaattcttagggttagggaattagggttttgaggcagataatttggagtatggatgatgaatggattcagattagggtttttccgtagcacttctatttgatgattagttagggttttggagcaattgtttagggttttgagaatggagaggggagccgagtgctgaatttagggattggttgtgttgtttgtccccattgtggagctcatgatggcacccaaatagggttggatcgattgtgcttccgggcattaacccttattgccattggtgtctaagaatgactagtttctttgctgctatgcggcatagcttagcatcaaacactgcattatgctggttcttaagggcgtgggttgatctggctctctttttagctgctttcgttgtcgatcgggattactgctgtgtgaaagataaccggctccggctcctctctgtaagacctctgttttggaaaaaaaaatttagttgcattcttagcgatttcttagaattatcagcgtgcaaataatgtgatattttatgtaagtggattgttttcgggtgcctgttgtgtgaataataataccccatctgtttttcttctgcaaaaaaaaaaaaaaaaaaaa

SEQ ID NO: 1164 - protein, 257 aa, Gossypium hirsutum
  misc_feature: Ceres CLONE ID no.1838288
  misc_feature: Bit score of 250.8 for HMM based on sequences of FIGURE 14.
  misc_feature (19)..(121): Pfam Name: TCP Pfam Description: TCP family transcription factor
  misc_feature: Functional Homolog Of Ceres SEEDLINE ID no. ME18158 at SEQ ID NO. 1151
MSNSETAATNGSLMDPQRHQAPAANGSLAVKKPPTKDRHSKVDGRGRRIRMPIICAARVFQLTRELGHKSDGQTIEWLLRQAEPSIIAATGTGTTPASFSTVSVSLRGANSTSLSSTTSSSLDHKPLLGPTPFILGKRVRSDDDNAGKDDFGGLTVGPGVGSIVGPNGTHPGGFWALPARPDFGQLWSFAAPPPPDMVVQAAAQQPAAAAALFVQQQQAMGEASAARVGNYLPGHLNLLASLSGAPGGSGRRDEDPH

SEQ ID NO: 1165 - DNA, 1486 bp, Gossypium hirsutum
  misc_feature: Ceres CLONE ID no.1793597
  misc_feature: Encodes the peptide sequence at SEQ ID NO. 1166
aatttccatttccacttctttctaaatattcggttgcttcttttaatccccctttatcccccaaacagcaccccaaatctttttagtttcagtccacaactgaactagaagggctatacaaacaaacaaattctgggtaagagtgtgctactcctgctcccaccatgtctaattcggagggtggtgccaccaacggagctataatggaccctcagagacagcaagccacggttaatggttcccttgccataacaaaacctccttctaaagaccgtcacagcaaagtcgacggtcgtggccgaagaatcaggatgcctatcatttgtgccgctcgtgttttccagttgactcgtgagttgggtcacaaatccgatggtcagacaatcgagtggctcttacgccaggctgaaccttccatcattgccgccactggcaccgggaccactcccgccagcttctccaccatgtctgtttccgtccgtggcggagccaattctacttctctatcgtccaccactgcttctccgtctttggatcataagcctttgttgggtcccaccccatttatactcgggaaacgtgtcaggcccgacgatgataaccccggaaagtatgataccggaggagtcatggtaggaccaggagttgtggggcccgctggtggattctgggctcttccaggcagggcagactttggtcaattgtggagtttcccgcccccagcggagatggcggctcatcaacctgctgctgcgttgttcgttcagcaacagcaagcgatgggagaagcgtcggcggctagagttggtaattatcttcctggtcatctgaacttgttagcctcgttgtcgggtgctccaggaagttcgggtcggagaggcgaggatcctcgttgaatttggctggacaagtttacccctgttatcgggagtatatatatagcttggttttgatgtgtgtggatgtggaagagggtttttaggtgcaggcgtgcagctttagggtcagggaattaggggtaaattttggggacatttggttgatgattaattagggttgtagagccgtcacaaattgttcacgattgtgagagttcatgcgagggagaatttggggcttggagccacagacagggagagatcatggtacttggggatatatatggcatgttaagaatggtgttaaagctacttgttttcagacgatgaagctgcaaaactaatggtcgattcttcttgtttttacacatcattgggtgattgggagatttgccctggatcatactagcaattgactcaccttgtcttcgtaattatgattctgtttttgagaatcattagttagtttgctgcgtaccattgaatttatggctctcaaggtgttggatttatgtctctctctctctctctctttctgtttctgccttcggtgtcagtctttatgtcgatcacatgatcttaaagggtaaaaaaaaaaaaaaaaaaaa

SEQ ID NO: 1166 - protein, 243 aa, Gossypium hirsutum
  misc_feature: Ceres CLONE ID no.1793597
  misc_feature: Bit score of 257.8 for HMM based on sequences of FIGURE 14.
  misc_feature (18)..(107): Pfam Name: TCP Pfam Description: TCP family transcription factor
  misc_feature: Functional Homolog Of Ceres SEEDLINE ID no. ME18158 at SEQ ID NO. 1151
MSNSEGGATNGAIMDPQRQQATVNGSLAITKPPSKDRHSKVDGRGRRIRMPIICAARVFQLTRELGHKSDGQTIEWLLRQAEPSIIAATGTGTTPASFSTMSVSVRGGANSTSLSSTTASPSLDHKPLLGPTPFILGKRVRPDDDNPGKYDTGGVMVGPGVVGPAGGFWALPGRADFGQLWSFPPPAEMAAHQPAAALFVQQQQAMGEASAARVGNYLPGHLNLLASLSGAPGSSGRRGEDPR

SEQ ID NO: 1167 - DNA, 1413 bp, Populus balsamifera subsp. trichocarpa
  misc_feature: Ceres ANNOT ID no.1543031
  misc_feature: Encodes the peptide sequence at SEQ ID NO. 1168
atggaactctcaaattcgcaaagcaacaaagaaaataatacaactcaagagccccaccaatctcaccaccaccaccgtcaacacctccaacaacaactatcttttgatcatggcagatcatcatcatcaggaggaggaggaggaggaggaggaggaggaccatctcaaggtcctttcatgggctccatctccatccaagctggcctccaccatcaccataatctcggtgcatcgtcaactccaaccacagctaatactgggtctgtaccttcaccatcatcttcacctctatcttcttcctcctcctccacctccgcatccacctcatccacaaccccaccacgcctggtcgacgcctctctcgccatcgccaccaccacaacagcagcagtaacacccgcaaagcggtccacaaaggaccgacacacaaaagtagatggtcgagggaggagaattagaatgccagcaacgtgtgcagcaagggtttttcaattgacaagagaactgggtcacaaatctgatggagaaacaattgagtggttgttacagcaagcagaatcaacaattatagcagccactgggactggtactattccagcaaatttctcaacgctcaatgtttctttaaggagcagtggctccactctctcagctcctccgtctaaatctgctcctcattctttccatagcgctcttggtttgtctcatcatcctcattatgaagaagggtttgcgcacccagcctttttagggttccagcagcagcatcagcagcagcatcatctaatgacagcagatcaaatagcgcaactgccaaaaccacagcaacaagagacaggatcttcagggttgcttaggccatcaaatatcttgcctaccactgccatgtgggcaatggcaccagctccgccgagcagtggtgctggcaacacattttggatgctaccaatgactgctggtgccggtggcgagccccagatttggcctttcgctacagcaacaccagcaagtggaaacccattgcaagctccactacatttcgtgccaagatttaatctccccactactagtcttgaatttcaacgtggaagagggagtcctctacagttgggatctatgagtcctttacagttggggtctatgttaatgcagcagcagcaccaacaacagcaacagcaacagcaacagcaacatcaacagcaacaaccttctcagtatctggggttaggcatgccagagtctaatttgggaatgttggctgctctcaatgcatattcaagaggtgatttgaacatgaattcccagcaaaataatccattggatcaccaccaccaacaccaccaccaacaccaccaccaccagactcagggtactcctgatagtggagatgaagatccgaatacttctcagtga

SEQ ID NO: 1168 - protein, 411 aa, Populus balsamifera subsp. trichocarpa
  misc_feature: Ceres ANNOT ID no.1543031
  misc_feature: Bit score of 372.4 for HMM based on sequences of FIGURE 14.
  misc_feature (63)..(166): Pfam Name: TCP Pfam Description: TCP family transcription factor
  misc_feature: Functional Homolog Of Ceres SEEDLINE ID no. ME18158 at SEQ ID NO. 1151
MGSISIQAGLHHHHNLGASSTPTTANTGSVPSPSSSPLSSSSSSTSASTSSTTPPRLVDASLAIATTTTAAVTPAKRSTKDRHTKVDGRGRRIRMPATCAARVFQLTRELGHKSDGETIEWLLQQAESTIIAATGTGTIPANFSTLNVSLRSSGSTLSAPPSKSAPHSFHSALGLSHHPHYEEGFAHPAFLGFQQQHQQQHHLMTADQIAQLPKPQQQETGSSGLLRPSNILPTTAMWAMAPAPPSSGAGNTFWMLPMTAGAGGEPQIWPFATATPASGNPLQAPLHFVPRFNLPTTSLEFQRGRGSPLQLGSMSPLQLGSMLMQQQHQQQQQQQQQQHQQQQPSQYLGLGMPESNLGMLAALNAYSRGDLNMNSQQNNPLDHHHQHHHQHHHHQTQGTPDSGDEDPNTSQ

SEQ ID NO: 1169 - DNA, 1704 bp, Populus balsamifera subsp. trichocarpa
  misc_feature: Ceres ANNOT ID no.1489643
  misc_feature: Encodes the peptide sequence at SEQ ID NO. 1170
atggaactctcaaattcgcaaagcaacaaagaaaataatacaactcaagagccccaccaatctcaccaccaccaccgtcaacacctccaacaacaactatcttttgatcatggcagatcatcatcatcaggaggaggaggaggaggaggaggaggaggaccatctcaaggtcctttcatgggctccatctccatccaagctggcctccaccatcaccataatctcggtgcatcgtcaactccaaccacagctaatactgggtctgtaccttcaccatcatcttcacctctatcttcttcctcctcctccacctccgcatccacctcatccacaaccccaccacgcctggtcgacgcctctctcgccatcgccaccagttatgacccttctctcgtagactccacgaagaagaagcaacaaaatctatccattgctccagctgccacaaacagtactagtgcagccacaacagcagcagtaacacccgcaaagcggtccacaaaggaccgacacacaaaagtagatggtcgagggaggagaattagaatgccagcaacgtgtgcagcaagggtttttcaattgacaagagaactgggtcacaaatctgatggagaaacaattgagtggttgttacagcaagcagaatcaacaattatagcagccactgggactggtactattccagcaaatttctcaacgctcaatgtttctttaaggagcagtggctccactctctcagctcctccgtctaaatctgctcctcattctttccatagcgctcttggtttgtctcatcatcctcattatgaagaagggtttgcgcacccagcctttttagggttccagcagcagcatcagcagcagcatcatctaatgacagcagatcaaatagcgcaagcactgccaattggtgctgatggcggtggcggtggcggtgagagtcgtggtggtggagaagagaattatatgaggaaacgctttagagaagatttattcaaggaggataatccacaagaacaaggagaaagtggtggtggtcgcggtggtggtggtgatggaggagaagagcctcccattaaagcatttaaaagtgatttacagctgccaaaaccacagcaacaagagacaggatcttcagggttgcttaggccatcaaatatcttgcctaccactgccatgtgggcaatggcaccagctccgccgagcagtggtgctggcaacacattttggatgctaccaatgactgctggtgccggtggcgagccccagatttggcctttcgctacagcaacaccagcaagtggaaacccattgcaagctccactacatttcgtgccaagatttaatctccccactactagtcttgaatttcaacgtggaagagggagtcctctacagttgggatctatgagtcctttacagttggggtctatgttaatgcagcagcagcaccaacaacagcaacagcaacagcaacagcaacatcaacagcaacaaccttctcagtatctggggttaggcatgccagagtctaatttgggaatgttggctgctctcaatgcatattcaagaggtgatttgaacatgaattcccagcaaaataatccattggatcaccaccaccaacaccaccaccaacaccaccaccaccagactcagggtactcctgatagtggagatgaagatccgaatacttctcagtga

SEQ ID NO: 1170 - protein, 508 aa, Populus balsamifera subsp. trichocarpa
  misc_feature: Ceres ANNOT ID no.1489643
  misc_feature: Bit score of 353.8 for HMM based on sequences of FIGURE 14.
  misc_feature (92)..(195): Pfam Name: TCP Pfam Description: TCP family transcription factor
  misc_feature: Functional Homolog Of Ceres SEEDLINE ID no. ME18158 at SEQ ID NO. 1151
MGSISIQAGLHHHHNLGASSTPTTANTGSVPSPSSSPLSSSSSSTSASTSSTTPPRLVDASLAIATSYDPSLVDSTKKKQQNLSIAPAATNSTSAATTAAVTPAKRSTKDRHTKVDGRGRRIRMPATCAARVFQLTRELGHKSDGETIEWLLQQAESTIIAATGTGTIPANFSTLNVSLRSSGSTLSAPPSKSAPHSFHSALGLSHHPHYEEGFAHPAFLGFQQQHQQQHHLMTADQIAQALPIGADGGGGGGESRGGGEENYMRKRFREDLFKEDNPQEQGESGGGRGGGGDGGEEPPIKAFKSDLQLPKPQQQETGSSGLLRPSNILPTTAMWAMAPAPPSSGAGNTFWMLPMTAGAGGEPQIWPFATATPASGNPLQAPLHFVPRFNLPTTSLEFQRGRGSPLQLGSMSPLQLGSMLMQQQHQQQQQQQQQQHQQQQPSQYLGLGMPESNLGMLAALNAYSRGDLNMNSQQNNPLDHHHQHHHQHHHHQTQGTPDSGDEDPNTSQ

SEQ ID NO: 1171 - DNA, 1239 bp, Populus balsamifera subsp. trichocarpa
  misc_feature: Ceres ANNOT ID no.1486769
  misc_feature: Encodes the peptide sequence at SEQ ID NO. 1172
atggaatcacaaagaaatacagcaaaccaacaaagcaacagtagtggtaacaaagatcaccatggccaaaaacaagaatcagtagcagcttcactgcagttagtccctcttgaaagtcgaccatcacaacttcaacaacaacatgggtctactactactacacccactagtcagggcccatccatgggctccatatcttgccaaattggtacccatccttccacttcaacatccaattctgctgtcacaaagtccaccacaaaaaggccctcaaaggaccgccataccaaggtagatggccgcggccgacgcatccggatgccagccatgtgtgctgcacgagtgtttcagctcacaagagaattaggccataaatctgatggagaaactattgagtggttactacaacaagctgaaccggccataattgctactactggcaccggtacaattccggccaatttctctactttgaatgtttcattacgtagcagtggtgctactatttcagcacctgcatcaaaatcagctcctctttcttttcatggtggattagctttctatgatgccaataatgccagcgaaactcgaagagctatggcttctaaccctccgatgttaggattccaccatcagttgtatcctcaaaaccttgtttctgatgataattacatgaggaagacttttcgagaagatctttttaaggaaaccacacagcaacaaagcacggaaacaattgaagccagtaattctgctaaatcaagagctggagttcaagatcaagaaacagccggttctattaggccaacaacaaacatgttaccaactccaatgtgggcagttgcgccggcggcaaccacgaatggaggaaatacattctggatgttaccggttggaggtggtgccaccccaacatcttccgttcaagaaccccagatgtggacttttcctgcggcagcagccggagtgccatcaatgcaaagggtgaattttggcggcggcggcggccgcgtttcaagcccggttcaacttgggtccatgatagtacagcagcaagtgggggctaatcagcaacttggattaggaatatcagagagtaatatggggatgatattgggtggtgtgaatccttatagcagtagtagggttggtttgggcatgaatttagagcatcataatcaagacaatcaaccacaaggcagtgacagtggagatgaaaaccctaatgattctcaataa

SEQ ID NO: 1172 - protein, 412 aa, Populus balsamifera subsp. trichocarpa
  misc_feature: Ceres ANNOT ID no.1486769
  misc_feature: Bit score of 781.3 for HMM based on sequences of FIGURE 14.
  misc_feature (75)..(179): Pfam Name: TCP Pfam Description: TCP family transcription factor
  misc_feature: Functional Homolog Of Ceres SEEDLINE ID no. ME18158 at SEQ ID NO. 1151
MESQRNTANQQSNSSGNKDHHGQKQESVAASLQLVPLESRPSQLQQQHGSTTTTPTSQGPSMGSISCQIGTHPSTSTSNSAVTKSTTKRPSKDRHTKVDGRGRRIRMPAMCAARVFQLTRELGHKSDGETIEWLLQQAEPAIIATTGTGTIPANFSTLNVSLRSSGATISAPASKSAPLSFHGGLAFYDANNASETRRAMASNPPMLGFHHQLYPQNLVSDDNYMRKTFREDLFKETTQQQSTETIEASNSAKSRAGVQDQETAGSIRPTTNMLPTPMWAVAPAATTNGGNTFWMLPVGGGATPTSSVQEPQMWTFPAAAAGVPSMQRVNFGGGGGRVSSPVQLGSMIVQQQVGANQQLGLGISESNMGMILGGVNPYSSSRVGLGMNLEHHNQDNQPQGSDSGDENPNDSQ

SEQ ID NO: 1173 - DNA, 1245 bp, Populus balsamifera subsp. trichocarpa
  misc_feature: Ceres ANNOT ID no.1479721
  misc_feature: Encodes the peptide sequence at SEQ ID NO. 1174
atggagtcacaaagaaatactcgtaaccaacaaagaaacattggtgctgacgaagatcgccatggccaaaaagaggaatcagtagcagcttcactgcaattagtagtccctcttggaagtcaatcatcacagcttcaacaacaacatgggtctacttctactacaacaactagccagggcccatttatgggctccatatctagccaaattggtgtccatccttccacttcaacttccaattctaccattacaaaatccaccataaagaggccatcaaaagaccgccataccaaggtagatggccgcggccgacgcatccggatgccagccatgtgtgcggcacgtgtctttcagctcacaagagaattaggccataaatctgatggagaaaccatcgagtggttactacagcaagctgagccttccataattgctacaactggtactggtacaattcctgccaatttctccactttgaatgtttctttacgtagtagtggtgctactatttcagcacctgcatcaaaatcagctcctctttcttttcatagtggattagctttctatgatgctaatgatgccagcgaaactcgaagagctatggcatctaaccctcatatgttaggattccaccatcagttgtatcctcaaaatcttgtctcagatgataattacatgaggaagacttttcgagaagatctttttaaggaaaccacacagcaacaaagcacggaaacaattgaagctagtaattctgctaaatcaagaactggagttcaagatcaagaaacagccggttcttttaggccagcaacaaacattctgccaactccaatgtgggcagttgggccggccgcaaccacaaatggtggcaatacattttggatgttaccggtcggaggtggtgccacccaagcagctgccgttacagaaccccagatgtggacttttcctacagcaggagcagcagctggagtgacatcaatgcaaagagtgaattttggtggcagcggccgcgtttcgaacccagttcaacttggttccatgatagtgcagcagcaagtgggagctaatcagcagcttggattaggactgtcagagagtaatatggggatgatatttggtggtgtgaatgcttatagcagtagtagggttggtttgggcatggatctagagcaaaataatcaagaaaaacagccacaaggcagtgacagtggagatgaaaaccctaatgattctcaataa

SEQ ID NO: 1174 - protein, 414 aa, Populus balsamifera subsp. trichocarpa
  misc_feature: Ceres ANNOT ID no.1479721
  misc_feature: Bit score of 676.0 for HMM based on sequences of FIGURE 14.
  misc_feature (76)..(180): Pfam Name: TCP Pfam Description: TCP family transcription factor
  misc_feature: Functional Homolog Of Ceres SEEDLINE ID no. ME18158 at SEQ ID NO. 1151
MESQRNTRNQQRNIGADEDRHGQKEESVAASLQLVVPLGSQSSQLQQQHGSTSTTTTSQGPFMGSISSQIGVHPSTSTSNSTITKSTIKRPSKDRHTKVDGRGRRIRMPAMCAARVFQLTRELGHKSDGETIEWLLQQAEPSIIATTGTGTIPANFSTLNVSLRSSGATISAPASKSAPLSFHSGLAFYDANDASETRRAMASNPHMLGFHHQLYPQNLVSDDNYMRKTFREDLFKETTQQQSTETIEASNSAKSRTGVQDQETAGSFRPATNILPTPMWAVGPAATTNGGNTFWMLPVGGGATQAAAVTEPQMWTFPTAGAAAGVTSMQRVNFGGSGRVSNPVQLGSMIVQQQVGANQQLGLGLSESNMGMIFGGVNAYSSSRVGLGMDLEQNNQEKQPQGSDSGDENPNDSQ

SEQ ID NO: 1175 - DNA, 1188 bp, Populus balsamifera subsp. trichocarpa
  misc_feature: Ceres ANNOT ID no.1449170
  misc_feature: Encodes the peptide sequence at SEQ ID NO. 1176
atggaaggaggtgatgatcagctccaccactaccaccacaaacaccgcccaaacttcccattccaattactggaaaagaaagaagacgagccttgctcgtcctcttctccttacccttctcttcccatctccactaccgaaccagacaacgacaacaacagcaacaaaactaacacaaacctctctacctctaatctccaaattgtttctgcagaacaatcgaagaaaccccctccaaaacgaacatcaacaaaggacagacacaccaaggtggatggacgtggccgcagaattcgcatgccagctctctgcgctgctagggtttttcagctcactaaagaacttggccacaaatcagacggtgaaaccgtcgagtggttacttcaacaagcagaaccagctgtgatcgctgccacaggcaccggaacaatccctgctaatttcacttcccttaacatatccttgcgtagctcaggttcaagtatgtcaattccgtctcagctaagatcagggagttttagcccaaacttttcactgcaacaacgtagtcgcagtttgtttcctggaattgggctagagacctcacaaccaccgacatttttaagtttccaatctagtaacaatctgaacgcaatgatgcaagcaaagcaagaattgcgagacaattcttcactggagttatcaacggagacagaagagagtttcaacaggaaaagaaggcccgagcaagatttatcatcatcgcaacagcatcagatgggaagctacctgttgcaatccagtagtggggcagttccagctagtcatggacaaattccagcaaatttttggatgctggctaattccaataataatcaagtcatgagcggagatcctatatggacatttccttctgttaataacagtggtttgtacaggagcaccatgtctagtgggttacattttatgaattttcctgctcctgttaccttattgcctagccagcaactggggtctacaagtattggtgggtctagtgctggtaatagtgggatgagtgaattaggtcatttgaatatgctagctggattaaacccctaccgggcatccggcatatcggaatcacaggcgagcgggtctcactcacatcatggtggcggtggtggaggaagcgatgatcggcatgatacaacaagtcatcactcatag

SEQ ID NO: 1176 - protein, 395 aa, Populus balsamifera subsp. trichocarpa
  misc_feature: Ceres ANNOT ID no.1449170
  misc_feature: Bit score of 628.0 for HMM based on sequences of FIGURE 14.
  misc_feature (68)..(167): Pfam Name: TCP Pfam Description: TCP family transcription factor
  misc_feature: Functional Homolog Of Ceres SEEDLINE ID no. ME18158 at SEQ ID NO. 1151
MEGGDDQLHHYHHKHRPNFPFQLLEKKEDEPCSSSSPYPSLPISTTEPDNDNNSNKTNTNLSTSNLQIVSAEQSKKPPPKRTSTKDRHTKVDGRGRRIRMPALCAARVFQLTKELGHKSDGETVEWLLQQAEPAVIAATGTGTIPANFTSLNISLRSSGSSMSIPSQLRSGSFSPNFSLQQRSRSLFPGIGLETSQPPTFLSFQSSNNLNAMMQAKQELRDNSSLELSTETEESFNRKRRPEQDLSSSQQHQMGSYLLQSSSGAVPASHGQIPANFWMLANSNNNQVMSGDPIWTFPSVNNSGLYRSTMSSGLHFMNFPAPVTLLPSQQLGSTSIGGSSAGNSGMSELGHLNMLAGLNPYRASGISESQASGSHSHHGGGGGGSDDRHDTTSHHS

SEQ ID NO: 1177 - DNA, 1227 bp, Populus balsamifera subsp. trichocarpa
  misc_feature: Ceres ANNOT ID no.1493696
  misc_feature: Encodes the peptide sequence at SEQ ID NO. 1178
atggcaattggcatcatatgtgttgctgttaccattatagcatgcaagagaaataataaacaggaaaagagagagcaagaaagaaatggagaatccatccatggaatatgcaaatggatgttgtatttcttgcatgtgttgttgtttgtctctaatcgtgaaattggaatggctgttcaagttgtcatcatacctaagatcttagtcaaaacacaaccccccactgaccactacagtcaaaaaagaggcaagaaaagtaaacacatgcacccatgttttgtatcttacagagagacagggaagggctctaactcaaaaaacccacatgagttacccactttcttgacccacacccacccttctcctcctcatcctcctccacaacctcatcttcaacaaccacaacaactccatagccaaaaccaacaacaacccaacatgggagacaacaaaccagcagaaatcaaagactttcagattgtagtagctgacaaagaagagcaaaagaaacagttagcaccaaagagaagctcaaacaaagacagacacacaaaagttgaaggtagaggtagaaggataaggatgccagctctttgtgcagcgagaatctttcaattgacaagagaattgggtcacaaatctgatggagagacaatacagtggcttctacaacaagctgaaccatctataattgcagcaactgggactggtactatacctgcatcagctttagcagctgctggcggtgcaatttcacaacaaggagcttctctttctgctggtgggtccagtagtagtagggccagttgggcaatgttaggtggcaatttagggagaccccatcatgttactactgcaggattatggcccccagttggaggttatgggttccagtcatcatctaattccactggtccatcaacaacaaatatagggactgaagctgctgctgctggtggttctagttatttgcaaaaactcgggtttccagggtttgacttgccgggtaacaacatggggcctatgagttttacttcaattttaggtgggggtacccagcagttaccaggattggaacttgggttgtcacaggacgggcatattggggttttgagtccacaagctttgaatcagatttatcagcagatggggcatgctagagtgcaccagcagcagcatcagcaacaaaatccttctaaagatgattcacaaggatcaggccagtga

SEQ ID NO: 1178 - protein, 352 aa, Populus balsamifera subsp. trichocarpa
  misc_feature: Ceres ANNOT ID no.1493696
  misc_feature: Bit score of 119.4 for HMM based on sequences of FIGURE 14.
  misc_feature (107)..(194): Pfam Name: TCP Pfam Description: TCP family transcription factor
  misc_feature: Functional Homolog Of Ceres SEEDLINE ID no. ME18158 at SEQ ID NO. 1151
MAVQVVIIPKILVKTQPPTDHYSQKRGKKSKHMHPCFVSYRETGKGSNSKNPHELPTFLTHTHPSPPHPPPQPHLQQPQQLHSQNQQQPNMGDNKPAEIKDFQIVVADKEEQKKQLAPKRSSNKDRHTKVEGRGRRIRMPALCAARIFQLTRELGHKSDGETIQWLLQQAEPSIIAATGTGTIPASALAAAGGAISQQGASLSAGGSSSSRASWAMLGGNLGRPHHVTTAGLWPPVGGYGFQSSSNSTGPSTTNIGTEAAAAGGSSYLQKLGFPGFDLPGNNMGPMSFTSILGGGTQQLPGLELGLSQDGHIGVLSPQALNQIYQQMGHARVHQQQHQQQNPSKDDSQGSGQ

SEQ ID NO: 1179 - DNA, 939 bp, Populus balsamifera subsp. trichocarpa
  misc_feature: Ceres ANNOT ID no.1543534
  misc_feature: Encodes the peptide sequence at SEQ ID NO. 1180
atggatcccaagggctctaactcaaaaaacccacatgagctacccactttctttacccttacgcacacccacacttctccttctccttctcctcatactcctccacaaccccatcatcaacaaccgcaacacctccataaccaaaaccaactacaacccaacatgggtgagaataaagcagcagaaatcaaagactttcagattgtagtagctgacaaagaagagcaaaagaaacagttagctccaaaaagaagctcaaacaaagacagacacacaaaagttgaaggtagaggtagaaggataaggatgccagctctttgtgcagcaagaatctttcaattaacaagagaattgggtcacaaatctgatggtgagacaatacagtggcttctacaacaagctgaaccatctataattgcagcaactgggactggtacaatacctgcatcagctttggcagctgctggtggtgcaatttcacaacaaggagcttctctttcagctggtgagtccagtagtaggaggaccagttgggcaatgttaggtggcaatttagggagaccccatcaagttacaagtgcaggattatggcccccagttggaggttatgggttccagtcatcatctaataccactggtccatcaacaacaaatatagtaagtgaaggtggtggtggctcgagttatttgcaaaaaaatggattttcagggtttgacatgccaggaaacaatattgggcctatgagtcttacttcaattttaggtgtgggtagccagcagttaccaggattggagcttgggttgtcacaagatgggcatattggggttttgagcccacaagctttgagtcagatttatcagcagatggggcaggctagggtgcagcagcaccagcagcaaaacccttctaaagatgattcacaaggatcagggcagtaa

SEQ ID NO: 1180 - protein, 258 aa, Populus balsamifera subsp. trichocarpa
  misc_feature: Ceres ANNOT ID no.1543534
  misc_feature: Bit score of 120.1 for HMM based on sequences of FIGURE 14.
  misc_feature (17)..(104): Pfam Name: TCP Pfam Description: TCP family transcription factor
  misc_feature: Functional Homolog Of Ceres SEEDLINE ID no. ME18158 at SEQ ID NO. 1151
MGENKAAEIKDFQIVVADKEEQKKQLAPKRSSNKDRHTKVEGRGRRIRMPALCAARIFQLTRELGHKSDGETIQWLLQQAEPSIIAATGTGTIPASALAAAGGAISQQGASLSAGESSSRRTSWAMLGGNLGRPHQVTSAGLWPPVGGYGFQSSSNTTGPSTTNIVSEGGGGSSYLQKNGFSGFDMPGNNIGPMSLTSILGVGSQQLPGLELGLSQDGHIGVLSPQALSQIYQQMGQARVQQHQQQNPSKDDSQGSGQ

SEQ ID NO: 1181 - DNA, 1254 bp, Populus balsamifera subsp. trichocarpa
  misc_feature: Ceres ANNOT ID no.1440815
  misc_feature: Encodes the peptide sequence at SEQ ID NO. 1182
atggcaattggcatcatatgtgttgctgttaccattatagcatgcaagagaaataataaacaggaaaagagagagcaagaaagaaatggagaatccatccatggaatatgcaaatggatgttgtatttcttgcatgtgttgttgtttgtctctaatcgtgaaattggaatggctgttcaagttgtcatcatacctaagatcttagtcaaaacacaaccccccactgaccactacagtcaaaaaagaggcaagaaaagtaaacacatgcacccatgttttgtatcttacagagagacagggaagggctctaactcaaaaaacccacatgagttacccactttcttgacccacacccacccttctcctcctcatcctcctccacaacctcatcttcaacaaccacaacaactccatagccaaaaccaacaacaacccaacatgggagacaacaaaccagcagaaatcaaagactttcagattgtagtagctgacaaagaagagcaaaagaaacagttagcaccaaagagaagctcaaacaaagacagacacacaaaagttgaaggtagaggtagaaggataaggatgccagctctttgtgcagcgagaatctttcaattgacaagagaattgggtcacaaatctgatggagagacaatacagtggcttctacaacaagctgaaccatctataattgcagcaactgggactggtactatacctgcatcagctttagcagctgctggcggtgcaatttcacaacaaggagcttctctttctgctggtttgcatcaaaagattgatgatttaggtgggtccagtagtagtagggccagttgggcaatgttaggtggcaatttagggagaccccatcatgttactactgcaggattatggcccccagttggaggttatgggttccagtcatcatctaattccactggtccatcaacaacaaatatagggactgaagctgctgctgctggtggttctagttatttgcaaaaactcgggtttccagggtttgacttgccgggtaacaacatggggcctatgagttttacttcaattttaggtgggggtacccagcagttaccaggattggaacttgggttgtcacaggacgggcatattggggttttgagtccacaagctttgaatcagatttatcagcagatggggcatgctagagtgcaccagcagcagcatcagcaacaaaatccttctaaagatgattcacaaggatcaggccagtga

SEQ ID NO: 1182 - protein, 417 aa, Populus balsamifera subsp. trichocarpa
  misc_feature: Ceres ANNOT ID no.1440815
  misc_feature: Bit score of 124.1 for HMM based on sequences of FIGURE 14.
  misc_feature (163)..(250): Pfam Name: TCP Pfam Description: TCP family transcription factor
  misc_feature: Functional Homolog Of Ceres SEEDLINE ID no. ME18158 at SEQ ID NO. 1151
MAIGIICVAVTIIACKRNNKQEKREQERNGESIHGICKWMLYFLHVLLFVSNREIGMAVQVVIIPKILVKTQPPTDHYSQKRGKKSKHMHPCFVSYRETGKGSNSKNPHELPTFLTHTHPSPPHPPPQPHLQQPQQLHSQNQQQPNMGDNKPAEIKDFQIVVADKEEQKKQLAPKRSSNKDRHTKVEGRGRRIRMPALCAARIFQLTRELGHKSDGETIQWLLQQAEPSIIAATGTGTIPASALAAAGGAISQQGASLSAGLHQKIDDLGGSSSSRASWAMLGGNLGRPHHVTTAGLWPPVGGYGFQSSSNSTGPSTTNIGTEAAAAGGSSYLQKLGFPGFDLPGNNMGPMSFTSILGGGTQQLPGLELGLSQDGHIGVLSPQALNQIYQQMGHARVHQQQHQQQNPSKDDSQGSGQ

SEQ ID NO: 1183 - DNA, 966 bp, Populus balsamifera subsp. trichocarpa
  misc_feature: Ceres ANNOT ID no.1490137
  misc_feature: Encodes the peptide sequence at SEQ ID NO. 1184
atggatcccaagggctctaactcaaaaaacccacatgagctacccactttctttacccttacgcacacccacacttctccttctccttctcctcatactcctccacaaccccatcatcaacaaccgcaacacctccataaccaaaaccaactacaacccaacatgggtgagaataaagcagcagaaatcaaagactttcagattgtagtagctgacaaagaagagcaaaagaaacagttagctccaaaaagaagctcaaacaaagacagacacacaaaagttgaaggtagaggtagaaggataaggatgccagctctttgtgcagcaagaatctttcaattaacaagagaattgggtcacaaatctgatggtgagacaatacagtggcttctacaacaagctgaaccatctataattgcagcaactgggactggtacaatacctgcatcagctttggcagctgctggtggtgcaatttcacaacaaggagcttctctttcagctggtttgcatcaaaagattgatgatataggtgagtccagtagtaggaggaccagttgggcaatgttaggtggcaatttagggagaccccatcaagttacaagtgcaggattatggcccccagttggaggttatgggttccagtcatcatctaataccactggtccatcaacaacaaatatagtaagtgaaggtggtggtggctcgagttatttgcaaaaaaatggattttcagggtttgacatgccaggaaacaatattgggcctatgagtcttacttcaattttaggtgtgggtagccagcagttaccaggattggagcttgggttgtcacaagatgggcatattggggttttgagcccacaagctttgagtcagatttatcagcagatggggcaggctagggtgcagcagcaccagcagcaaaacccttctaaagatgattcacaaggatcagggcagtaa

SEQ ID NO: 1184 - protein, 267 aa, Populus balsamifera subsp. trichocarpa
  misc_feature: Ceres ANNOT ID no.1490137
  misc_feature: Bit score of 125.4 for HMM based on sequences of FIGURE 14.
  misc_feature (17)..(104): Pfam Name: TCP Pfam Description: TCP family transcription factor
  misc_feature: Functional Homolog Of Ceres SEEDLINE ID no. ME18158 at SEQ ID NO. 1151
MGENKAAEIKDFQIVVADKEEQKKQLAPKRSSNKDRHTKVEGRGRRIRMPALCAARIFQLTRELGHKSDGETIQWLLQQAEPSIIAATGTGTIPASALAAAGGAISQQGASLSAGLHQKIDDIGESSSRRTSWAMLGGNLGRPHQVTSAGLWPPVGGYGFQSSSNTTGPSTTNIVSEGGGGSSYLQKNGFSGFDMPGNNIGPMSLTSILGVGSQQLPGLELGLSQDGHIGVLSPQALSQIYQQMGQARVQQHQQQNPSKDDSQGSGQ

SEQ ID NO: 1185 - DNA, 819 bp, Populus balsamifera subsp. trichocarpa
  misc_feature: Ceres ANNOT ID no.1451054
  misc_feature: Encodes the peptide sequence at SEQ ID NO. 1186
atgtcagacaacagtggtgctgtcaataacggagctttgatagacccacaaagaaaccagccgccgggaggtggtggaggaggaggagctactaatggagctttagctgttaaaaaaccaccttctaaagaccgtcatagcaaggttgatggtcgtggaaggaggattcggatgccgatcatttgtgctgctagagtttttcagttgactcgtgaattgggtcacaagtctgatggacaaactatcgaatggcttcttcgtcaagctgagccttcgattattgctgctactgggaccggaactactcctgctagtttttctactgtttctgtttcggttcgtgctggtggtaattctaattcaatatcttcgctttccagcaataatgttcattcagctgcttctttggaccataagcctttgttaggccctgcgccctttatacttggaaaaaggatgcggccagaggaggatggaaatggtgggaaggatgatggtggggttcctgtgggccccactatcgggtctttaatggggcccacagcaacagccgcagcggggtctggcgggttctgggctttgcctgcaagggctgatttttgggggtttgctgctgcacctccggaaatggttgtgcagccaacggcggtgcagcagtcgtcgctgtttatgcaccagcagcatgctgccgccgctgctgccatgggagaagcgtcggcggctagattggggaattatcttcctggtcatttgaatttgttggcttcattgtcgggtgggtctgggagttcaggaaggagagaggaggatcagcgttga

SEQ ID NO: 1186 - protein, 272 aa, Populus balsamifera subsp. trichocarpa
  misc_feature: Ceres ANNOT ID no.1451054
  misc_feature: Bit score of 236.9 for HMM based on sequences of FIGURE 14.
  misc_feature (29)..(115): Pfam Name: TCP Pfam Description: TCP family transcription factor
  misc_feature: Functional Homolog Of Ceres SEEDLINE ID no. ME18158 at SEQ ID NO. 1151
MSDNSGAVNNGALIDPQRNQPPGGGGGGGATNGALAVKKPPSKDRHSKVDGRGRRIRMPIICAARVFQLTRELGHKSDGQTIEWLLRQAEPSIIAATGTGTTPASFSTVSVSVRAGGNSNSISSLSSNNVHSAASLDHKPLLGPAPFILGKRMRPEEDGNGGKDDGGVPVGPTIGSLMGPTATAAAGSGGFWALPARADFWGFAAAPPEMVVQPTAVQQSSLFMHQQHAAAAAAMGEASAARLGNYLPGHLNLLASLSGGSGSSGRREEDQR

SEQ ID NO: 1187 - DNA, 810 bp, Populus balsamifera subsp. trichocarpa
  misc_feature: Ceres ANNOT ID no.1456669
  misc_feature: Encodes the peptide sequence at SEQ ID NO. 1188
atgtcagacaacagtggcgctgtaaataacggatctttgatagacccacaaagaaaccagccacctggaggtggtggtggaggaggaggagttactaatggagctttagttgctaaaaaaccaccttctaaagaccgtcatagcaaagttgatggtcgtggaaggaggattcggatgccgatcatttgtgctgctagagtttttcagttgactcgtgaattgggtcataaatccgatggacaaactattgaatggctacttcgtcaagctgagccttcgattattgctgctactggtactggaactactcctgctagtttttctactgtttctgtttcggttcgtgctggtgggaattcaaattctatatcttctctttcgagcaataatattcatccggttggttctttggagcacaagcctttgttaggcccagcgccgtttatacttgggaaaaggatgcggccggaggaggatggtaatggtggtgggaaggacgatgatggggttcctgtgggccccacaattgggtcattaatgggccccacagcaacagccgggcctggtgggttctgggctttacctgccaggcccgatttttgggggtttgctgctgctgcaccgccggaaatggttgttcagccgactgcggtgcagcagtcttcactgtttatgcaccagcatgctgcggctatgggagaagcgtcggcggcaagagtggggaattatcttcctggtcatttgaatttgctggcttctttgtcgagtggacatggaagttcaggaaggagagaggatgatcaccgttga

SEQ ID NO: 1188 - protein, 269 aa, Populus balsamifera subsp. trichocarpa
  misc_feature: Ceres ANNOT ID no.1456669
  misc_feature: Bit score of 242.2 for HMM based on sequences of FIGURE 14.
  misc_feature (30)..(116): Pfam Name: TCP Pfam Description: TCP family transcription factor
  misc_feature: Functional Homolog Of Ceres SEEDLINE ID no. ME18158 at SEQ ID NO. 1151
MSDNSGAVNNGSLIDPQRNQPPGGGGGGGGVTNGALVAKKPPSKDRHSKVDGRGRRIRMPIICAARVFQLTRELGHKSDGQTIEWLLRQAEPSIIAATGTGTTPASFSTVSVSVRAGGNSNSISSLSSNNIHPVGSLEHKPLLGPAPFILGKRMRPEEDGNGGGKDDDGVPVGPTIGSLMGPTATAGPGGFWALPARPDFWGFAAAAPPEMVVQPTAVQQSSLFMHQHAAAMGEASAARVGNYLPGHLNLLASLSSGHGSSGRREDDHR

SEQ ID NO: 1189 - DNA, 723 bp, Populus balsamifera subsp. trichocarpa
  misc_feature: Ceres ANNOT ID no.1509865
  misc_feature: Encodes the peptide sequence at SEQ ID NO. 1190
atgtcagacaacagtggcgctgtaaataacggatctttgatagacccacaaagaaaccagccacctggaggtggtggtggaggaggaggagttactaatggagctttagttgctaaaaaaccaccttctaaagaccgtcatagcaaagttgatggtcgtggaaggaggattcggatgccgatcatttgtgctgctagagtttttcagttgactcgtgaattgggtcataaatccgatggacaaactattgaatggctacttcgtcaagctgagccttcgattattgctgctactggtactggaactactcctgctagtttttctactgtttctgtttcggttcgtgctgcgccgtttatacttgggaaaaggatgcggccggaggaggatggtaatggtggtgggaaggacgatgatggggttcctgtgggccccacaattgggtcattaatgggccccacagcaacagccgggcctggtgggttctgggctttacctgccaggcccgatttttgggggtttgctgctgctgcaccgccggaaatggttgttcagccgactgcggtgcagcagtcttcactgtttatgcaccagcatgctgcggctatgggagaagcgtcggcggcaagagtggggaattatcttcctggtcatttgaatttgctggcttctttgtcgagtggacatggaagttcaggaaggagagaggatgatcaccgttga

SEQ ID NO: 1190 - protein, 240 aa, Populus balsamifera subsp. trichocarpa
  misc_feature: Ceres ANNOT ID no.1509865
  misc_feature: Bit score of 209.1 for HMM based on sequences of FIGURE 14.
  misc_feature (30)..(118): Pfam Name: TCP Pfam Description: TCP family transcription factor
  misc_feature: Functional Homolog Of Ceres SEEDLINE ID no. ME18158 at SEQ ID NO. 1151
MSDNSGAVNNGSLIDPQRNQPPGGGGGGGGVTNGALVAKKPPSKDRHSKVDGRGRRIRMPIICAARVFQLTRELGHKSDGQTIEWLLRQAEPSIIAATGTGTTPASFSTVSVSVRAAPFILGKRMRPEEDGNGGGKDDDGVPVGPTIGSLMGPTATAGPGGFWALPARPDFWGFAAAAPPEMVVQPTAVQQSSLFMHQHAAAMGEASAARVGNYLPGHLNLLASLSSGHGSSGRREDDHR

SEQ ID NO: 1191 - DNA, 909 bp, Populus balsamifera subsp. trichocarpa
  misc_feature: Ceres ANNOT ID no.1447910
  misc_feature: Encodes the peptide sequence at SEQ ID NO. 1192
atggaacctaagagcccaaatcaatatcaaccacagatgccctctttcttgaatcctccacaagaagcaagcatgtcagagaacaacatcaacagcaataacaacaagcctgcagatatcgaagattttcaaaatatgatggcggacaaagatgatagcaagaagaaattagcaccaaagagaagctccaacaaagacaggcacaagaaagtggaaggtagaggaaggaggataaggattccagctctttgcgcggccaggatttttcaattgacaagagaattggagcataaatctgatggagaaacaattcagtggttgttgcaacaggcagaaccatcgattattgctgcgactggtactgggaccattcctgcatcagctcttgcagctgcaggagcctctgtttcagagcaggggggctctgtttcaactggattgcatgcaaaaatggaagggttgggaccaggagttactgggtccagagataggaatgattggaccctgtcgaatactaaattaggaatatctaatgtggcaactggggtctggccatctgttggtggaattgggttaggatttgttcccaattctggtcaatcaacatcgaattttggaaacgaaaactccagtactttaccgaaatatgggttccaaggggttgagtttccaaatattaacatgggcttaatgagtttttactccatgtttagtggcactaaccagcaacttcctggcttggagcttggactttcacaggatggccacagtgcgatgttaaatcctcaagctttgagtcccttttaccatcagatggtgcagggtcgtggtgtcttggattcgttgaatcaagaaaagcagcaagagcaacctcctgataaagatgattcccaaggatcaaggcagtag

SEQ ID NO: 1192 - protein, 302 aa, Populus balsamifera subsp. trichocarpa
  misc_feature: Ceres ANNOT ID no.1447910
  misc_feature: Bit score of 97.0 for HMM based on sequences of FIGURE 14.
  misc_feature (51)..(137): Pfam Name: TCP Pfam Description: TCP family transcription factor
  misc_feature: Functional Homolog Of Ceres SEEDLINE ID no. ME18158 at SEQ ID NO. 1151
MEPKSPNQYQPQMPSFLNPPQEASMSENNINSNNNKPADIEDFQNMMADKDDSKKKLAPKRSSNKDRHKKVEGRGRRIRIPALCAARIFQLTRELEHKSDGETIQWLLQQAEPSIIAATGTGTIPASALAAAGASVSEQGGSVSTGLHAKMEGLGPGVTGSRDRNDWTLSNTKLGISNVATGVWPSVGGIGLGFVPNSGQSTSNFGNENSSTLPKYGFQGVEFPNINMGLMSFYSMFSGTNQQLPGLELGLSQDGHSAMLNPQALSPFYHQMVQGRGVLDSLNQEKQQEQPPDKDDSQGSRQ

SEQ ID NO: 1193 - DNA, 1287 bp, Populus balsamifera subsp. trichocarpa
  misc_feature: Ceres ANNOT ID no.1471068
  misc_feature: Encodes the peptide sequence at SEQ ID NO. 1194
atgagggagcatagacgggcagaatccttcacttggattaaaaaggaaagatggaaacttgaaaccaattggaagatggcaccactaaagaaaattcaaaacacaaaaaaatcacatttataccgcaaaccaatttgtaaaccgataacatcacgatccttttataaatgggacctaccatatatcatcatctcctgtgtccaactctttttggtgattggcagcgacaggcctctccttgtggcacccgtacaaaagcaagaacttggagaagatgcgagcatgacaaccgctgatcttagaatcaacagcggagaattacgaaacattcgaggaggtcccacaaacaagaagaactacaacgacatgtcggcagcacccaaggaagagccatgcacagaggacagatcacctacaccaccattagcggtcgtgccgttcgcagcaatccccatgccactaaccacagtaaccccaccaaaacgagcatcaaccaaagaccgacacaccaaggtggagggtcgtggcagaaggatccgaatgcccgcaacatgtgctgcccggatctttcaactaaccagagaattaggccataaatcagacggtgaaacgatcaggtggttgcttgaacatgctgagcctgcgataattgcagctacaggaactggcactgtccctgctatcgccatgtctgttaatggaaccctcaaaatcccgacaacaactagctccagcgccgaacctgacgaaccgaacgctaaaaagaagcgcaaacgacccgctaatagcgagtacgttgatgtcaacgacagcgtatcggtatcagcttctctcgctcccataacgacgcgaccgcgacagccgccacagccgcaggcgcaacaaccagtcgcggcagtaccacagggtttggtgcccatgtgggccataccatcaaacactgtcgttccaggggcttttttcatggtaccgtccatgccaggacagtttaaccagccccagatatttacgttcccagctgcagctagccctctcataaatatttctcccaggccaatttcatctttcgtgtcttccatgcaatctaatatagctgtggctctgcccgtttctggttcaaaacctggtaagggtatttcaaggacggcaccaagttcaagctcagctcatactattcggactccaagtacaactactaatagcactcctcacatgcttagagacttctctttagagatttatgacaaacaagagttacagttcatgtctcggtcttcaaagcaatga

SEQ ID NO: 1194 - protein, 334 aa, Populus balsamifera subsp. trichocarpa
  misc_feature: Ceres ANNOT ID no.1471068
  misc_feature: Bit score of 113.9 for HMM based on sequences of FIGURE 14.
  misc_feature (60)..(249): Pfam Name: TCP Pfam Description: TCP family transcription factor
  misc_feature: Functional Homolog Of Ceres SEEDLINE ID no. ME18158 at SEQ ID NO. 1151
MTTADLRINSGELRNIRGGPTNKKNYNDMSAAPKEEPCTEDRSPTPPLAVVPFAAIPMPLTTVTPPKRASTKDRHTKVEGRGRRIRMPATCAARIFQLTRELGHKSDGETIRWLLEHAEPAIIAATGTGTVPAIAMSVNGTLKIPTTTSSSAEPDEPNAKKKRKRPANSEYVDVNDSVSVSASLAPITTRPRQPPQPQAQQPVAAVPQGLVPMWAIPSNTVVPGAFFMVPSMPGQFNQPQIFTFPAAASPLINISPRPISSFVSSMQSNIAVALPVSGSKPGKGISRTAPSSSSAHTIRTPSTTTNSTPHMLRDFSLEIYDKQELQFMSRSSKQ

SEQ ID NO: 1195 - DNA, 738 bp, Populus balsamifera subsp. trichocarpa
  misc_feature: Ceres ANNOT ID no.1504118
  misc_feature: Encodes the peptide sequence at SEQ ID NO. 1196
atgtcagacaacagtggtgctgtcaataacggagctttgatagacccacaaagaaaccagccgccgggaggtggtggaggaggaggagctactaatggagctttagctgttaaaaaaccaccttctaaagaccgtcatagcaaggttgatggtcgtggaaggaggattcggatgccgatcatttgtgctgctagagtttttcagttgactcgtgaattgggtcacaagtctgatggacaaactatcgaatggcttcttcgtcaagctgagccttcgattattgctgctactgggaccggaactactcctgctagtttttctactgtttctgtttcggttcgtgctggccctgcgccctttatacttggaaaaaggatgcggccagaggaggatggaaatggtgggaaggatgatggtggggttcctgtgggccccactatcgggtctttaatggggcccacagcaacagccgcagcggggtctggcgggttctgggctttgcctgcaagggctgatttttgggggtttgctgctgcacctccggaaatggttgtgcagccaacggcggtgcagcagtcgtcgctgtttatgcaccagcagcatgctgccgccgctgctgccatgggagaagcgtcggcggctagattggggaattatcttcctggtcatttgaatttgttggcttcattgtcgggtgggtctgggagttcaggaaggagagaggaggatcagcgttga

SEQ ID NO: 1196 - protein, 245 aa, Populus balsamifera subsp. trichocarpa
  misc_feature: Ceres ANNOT ID no.1504118
  misc_feature: Bit score of 199.2 for HMM based on sequences of FIGURE 14.
  misc_feature (29)..(117): Pfam Name: TCP Pfam Description: TCP family transcription factor
  misc_feature: Functional Homolog Of Ceres SEEDLINE ID no. ME18158 at SEQ ID NO. 1151
MSDNSGAVNNGALIDPQRNQPPGGGGGGGATNGALAVKKPPSKDRHSKVDGRGRRIRMPIICAARVFQLTRELGHKSDGQTIEWLLRQAEPSIIAATGTGTTPASFSTVSVSVRAGPAPFILGKRMRPEEDGNGGKDDGGVPVGPTIGSLMGPTATAAAGSGGFWALPARADFWGFAAAPPEMVVQPTAVQQSSLFMHQQHAAAAAAMGEASAARLGNYLPGHLNLLASLSGGSGSSGRREEDQR

SEQ ID NO: 1197 - DNA, 738 bp, Arabidopsis thaliana
  misc_feature: Ceres CLONE ID no.1343621
  misc_feature: Encodes the peptide sequence at SEQ ID NO. 1198
aaccccccctctcttctcgagacaaagaagaagacaagagtcaaacttgaaggcgacaatcggagcttccatggccgtttcttcctctttcaccaaaccctaatttcaatttcatcttcttttcccttctttctcaccggaaaatggatctctccgacatccgaaacaacaacaacgacaccgccgccgtcgccaccggaggaggagcaagacagctagttgacgcatctctctcaatcgttcccagatctacacctcccgaagactcaacactcgcaacaacctcatctacggcaacggcgactacaacgaagcggtcgactaaagaccgtcacacgaaagtcgacggaagaggacgtcggattcgtatgccggcgctatgtgcagctagagtttttcagttaacgagagagttaggtcataaatccgatggtgaaactattgaatggcttcttcaacaagctgagccagctattgttgctgctacaggtacaggaactattccggcgaacttctctactttaagtgtttcgttacgaagtagtggatcgactctctctgctccgccgtcgaaatcggtgccgctttacggtgctcttggattgactcatcatcagtatgatgaacaaggaggcggcggtgtgtttgctgctcatacgtcgccgcttttagggttcatcatcagcttcaacacaccagaaccagaatcagaatcagaatcagaaatcagatccggtg

SEQ ID NO: 1198 - protein, 198 aa, Arabidopsis thaliana
  misc_feature: Ceres CLONE ID no.1343621
  misc_feature: Bit score of 244.5 for HMM based on sequences of FIGURE 14.
  misc_feature (44)..(178): Pfam Name: TCP Pfam Description: TCP family transcription factor
  misc_feature: Functional Homolog Of Ceres SEEDLINE ID no. ME18158 at SEQ ID NO. 1151
MDLSDIRNNNNDTAAVATGGGARQLVDASLSIVPRSTPPEDSTLATTSSTATATTTKRSTKDRHTKVDGRGRRIRMPALCAARVFQLTRELGHKSDGETIEWLLQQAEPAIVAATGTGTIPANFSTLSVSLRSSGSTLSAPPSKSVPLYGALGLTHHQYDEQGGGGVFAAHTSPLLGFIISFNTPEPESESESEIRSG

SEQ ID NO: 1199 - protein, 375 aa, Arabidopsis thaliana
  misc_feature: Public GI ID no.15218305
  misc_feature: Bit score of 269.5 for HMM based on sequences of FIGURE 14.
  misc_feature (44)..(155): Pfam Name: TCP Pfam Description: TCP family transcription factor
  misc_feature: Functional Homolog Of Ceres SEEDLINE ID no. ME18158 at SEQ ID NO. 1151
MNQNSSVAEATLQLNSGEKPSPGSIPFISSGQHGNISTSATSSTSTSSGSALAVVKSAVKKPTKDRHTKVDGRGRRIRMPAMCAARVFQLTRELGHKSDGETIEWLLQQAEPAIIASTGTGTIPANFSTLNASLRSGGGSTLFSQASKSSSSPLSFHSTGMSLYEDNNGTNGSSVDPSRKLLNSAANAAVFGFHHQMYPPIMSTERNPNTLVKPYREDYFKEPSSAAEPSESSQKASQFQEQELAQGRGTANVVPQPMWAVAPGTTNGGSAFWMLPMSGSGGREQMQQQPGHQMWAFNPGNYPVGTGRVVTAPMGSMMLGGQQLGLGVAEGNMAAAMRGSRGDGLAMTLDQHQHQLQHQEPNQSQASENGGDDKK

SEQ ID NO: 1200 - protein, 341 aa, Arabidopsis thaliana
  misc_feature: Public GI ID no.15219640
  misc_feature: Bit score of 313.8 for HMM based on sequences of FIGURE 14.
  misc_feature (39)..(140): Pfam Name: TCP Pfam Description: TCP family transcription factor
  misc_feature: Functional Homolog Of Ceres SEEDLINE ID no. ME18158 at SEQ ID NO. 1151
MESHNNNQSNNNTTGSAHLVPSMGPISGSVSLTTTAPNSTTTTVTAAKTPAKRPSKDRHIKVDGRGRRIRMPAICAARVFQLTRELQHKSDGETIEWLLQQAEPAIIAATGTGTIPANISTLNISLRSSGSTLSAPLSKSFHMGRAAQNAAVFGFQQQLYHPHHITTDSSSSSLPKTFREEDLFKDPNFLDQEPGSRSPKPGSEAPDQDPGSTRSRTQNMIPPMWALAPTPASTNGGSAFWMLPVGGGGGPANVQDPSQHMWAFNPGHYPGRIGSVQLGSMLVGGQQLGLGVAENNNLGLFSGGGGDGGRVGLGMSLEQKPQHQVSDHATRDQNPTIDGSP

SEQ ID NO: 1201 - protein, 325 aa, Arabidopsis thaliana
  misc_feature: Public GI ID no.18409345
  misc_feature: Bit score of 367.0 for HMM based on sequences of FIGURE 14.
  misc_feature (41)..(132): Pfam Name: TCP Pfam Description: TCP family transcription factor
  misc_feature: Functional Homolog Of Ceres SEEDLINE ID no. ME18158 at SEQ ID NO. 1151
MDPDPDHNHRPNFPLQLLDSSTSSSSTSLAIISTTSEPNSEPKKPPPKRTSTKDRHTKVEGRGRRIRMPAMCAARVFQLTRELGHKSDGETIEWLLQQAEPAVIAATGTGTIPANFTSLNISLRSSRSSLSAAHLRTTPSSYYFHSPHQSMTHHLQHQHQVRPKNESHSSSSSSSQLLDHNQMGNYLVQSTAGSLPTSQSPATAPFWSSGDNTQNLWAFNINPHHSGVVAGDVYNPNSGGSGGGSGVHLMNFAAPIALFSGQPLASGYGGGGGGGGEHSHYGVLAALNAAYRPVAETGNHNNNQQNRDGDHHHNHQEDGSTSHHS

SEQ ID NO: 1202 - protein, 477 aa, Arabidopsis thaliana
  misc_feature: Public GI ID no.6522545
  misc_feature: Bit score of 377.4 for HMM based on sequences of FIGURE 14.
  misc_feature (89)..(187): Pfam Name: TCP Pfam Description: TCP family transcription factor
  misc_feature: Functional Homolog Of Ceres SEEDLINE ID no. ME18158 at SEQ ID NO. 1151
MDGGDSVGGGGGDDHHRHLHHHHRPTFPFQLLGKHDPDDNHQQQPSPSSSSSLFSLHQHQQLSQSQPQSQSQKSQPQTTQKELLQTQEESAVVAAKKPPLKRASTKDRHTKVDGRGRRIRMPALCAARVFQLTRELGHKSDGETIEWLLQQAEPSVIAATGTGTIPANFTSLNISLRSSGSSMSLPSHFRSAASTFSPNNIFSPAMLQQQQQQQRGGGVGFHHPHLQGRAPTSSLFPGIDNFTPTTSFLNFHNPTKQEGDQDSEELNSEKKRRIQTTSDLHQQQQQHQHDQIGGYTLQSSNSGSTATAAAAQQIPGNFWMVAAAAAAGGGGGNNNQTGGLMTASIGTGGGGGEPVWTFPSINTAAAALYRSGVSGVPSGAVSSGLHFMNFAAPMAFLTGQQQLATTSNHEINEDSNNNEGGRSDGGGDHHNTQRHHHHQQQHHHNILSGLNQYGRQVSGDSQASGSLGGGDEEDQQD

SEQ ID NO: 1203 - protein, 250 aa, Arabidopsis thaliana
  misc_feature: Public GI ID no.15237274
  misc_feature: Bit score of 274.5 for HMM based on sequences of FIGURE 14.
  misc_feature (29)..(112): Pfam Name: TCP Pfam Description: TCP family transcription factor
  misc_feature: Functional Homolog Of Ceres SEEDLINE ID no. ME18158 at SEQ ID NO. 1151
MSINNNNNNNNNNNDGLMISSNGALIEQQPSVVVKKPPAKDRHSKVDGRGRRIRMPIICAARVFQLTRELGHKSDGQTIEWLLRQAEPSIIAATGTGTTPASFSTASVSIRGATNSTSLDHKPTSLLGGTSPFILGKRVRADEDSNNSHNHSSVGKDETFTTTPAGFWAVPARPDFGQVWSFAGAPQEMFLQQQHHHQQPLFVHQQQQQQAAMGEASAARVGNYLPGHLNLLASLSGGSPGSDRREEDPR

SEQ ID NO: 1204 - protein, 250 aa, Arabidopsis thaliana
  misc_feature: Public GI ID no.26452377
  misc_feature: Bit score of 271.2 for HMM based on sequences of FIGURE 14.
  misc_feature (29)..(112): Pfam Name: TCP Pfam Description: TCP family transcription factor
  misc_feature: Functional Homolog Of Ceres SEEDLINE ID no. ME18158 at SEQ ID NO. 1151
MSINNNNNNNNNNNDGLMISSNGALIEQQPSVIVKKPPAKDRHSKVDGRGRRIRMPIICAARVFQLTRELGHKSDGQTIEWLLRQAEPSIIAATGTGTTPASFSTASVSIRGATNSTSLDHKPTSLLGGTSPFILGKRVRADEDSNNSHNHSSVGKDETFTTTPAGFWAVPARPDFGQVWSFAGAPQEMFLQQQHHHQQPLFVHQQQQQQAAMGEASAARVGNYLPGHLNLLASLSGGSPGSDRREEDPR

SEQ ID NO: 1205 - DNA, 1486 bp, Arabidopsis thaliana
  misc_feature: Ceres CLONE ID no.33629
  misc_feature: Encodes the peptide sequence at SEQ ID NO. 1206
acctccttcttcttcttcttcttcttcttctcctcgagagagagttagatagtgataacgaaatcctaattccatggccgacaacgacggagcagtgagtaacggcatcatagtcgagcagacgtcaaacaaaggacctcttaacgccgttaagaaaccaccgtctaaagatcgacacagcaaagttgacggaagaggaagaaggattcgtatgccaatcatttgcgcagctcgagtttttcaattgaccagagagttaggtcacaagtccgatggtcaaaccatagagtggcttctccgtcaagctgagccttctatcatagccgccactggaactggcactactccggcgagtttctccactgcttctctctccacttcttctccgtttactctcgggaaacgtgtcgtcagagcggaggaaggagaatccggcggcggaggaggaggagggttaacagtgggacacacaatggggacttcgttaatgggtggtggtggttctggtgggttttgggctgttccggcgaggccggatttcggacaagtctggagctttgcaaccggagctccaccggaaatggtttttgcgcagcagcagcaaccagctacactcttcgtccgccaccagcagcaacagcaagcttccgccgccgcagcagctgcaatgggtgaggcttcagcagctagagttgggaattatcttccgggtcatcatctcaatttgcttgcttctttgtctggtggagctaacgggtcgggtcggagggaagacgaccacgaaccacgttgagaaatggtctaagtaatcttgtgaagactcaatgacagagatatttagtgacaccgggttcagacagttaactcaaatgttcctggcgataatcttcttccacacatcggagtacattctcgccatagccattcacggagcatcgaaagtaactttaagctcactcttaatcagcaaacactatgctttagcaatgctaatatcagtcctcgagtacatagccgagattgttttcttcccggggctgaaacaacactggtggatcagcaatttcggtcttacaatgatcatacttggagaaatccttcgcaaaaccgcgataatcacagcaggtagatcgttcacacaccttataaaaattcgccgggaggagcatcataagcttgtgacagaaggagtgtatcaaatcatgaggcatccgagttactccgggtttctcatttggtctgtgggaacgcaagtaatgctctgtaatccaatttcagcgattgcgtttgcggttgtggtgtggcggttctttgcagagagaataccttatgaggagcattacttgaagcaattttttgggagacagtatgtggagtatgcgcagagagttccttctggtgttccttttgtaaactgatccttagatcaattgtgaacatatacgagcattgtttgattaccttttacatagaaaattatgaaagc

SEQ ID NO: 1206 - protein, 239 aa, Arabidopsis thaliana
  misc_feature: Ceres CLONE ID no.33629
  misc_feature: Bit score of 188.9 for HMM based on sequences of FIGURE 14.
  misc_feature (15)..(194): Pfam Name: TCP Pfam Description: TCP family transcription factor
  misc_feature: Functional Homolog Of Ceres SEEDLINE ID no. ME18158 at SEQ ID NO. 1151
MADNDGAVSNGIIVEQTSNKGPLNAVKKPPSKDRHSKVDGRGRRIRMPIICAARVFQLTRELGHKSDGQTIEWLLRQAEPSIIAATGTGTTPASFSTASLSTSSPFTLGKRVVRAEEGESGGGGGGGLTVGHTMGTSLMGGGGSGGFWAVPARPDFGQVWSFATGAPPEMVFAQQQQPATLFVRHQQQQQASAAAAAAMGEASAARVGNYLPGHHLNLLASLSGGANGSGRREDDHEPR

SEQ ID NO: 1207 - DNA, 806 bp, Brassica napus
  misc_feature: Ceres CLONE ID no.1064407
  misc_feature: Encodes the peptide sequence at SEQ ID NO. 1208
aatcattagcttccctctcctctgaatgtgtttcagtaataagagaatcaagaaccactattcctctttcaagaatctactcaactatgtctaacaacaacgacggagctcttgtcgtgaagaaacctccggcgaaagatagacacagcaaagtcgacggaagagggagaaggatacgtatgcctatcatctgcgcagctcgtgtcttccagctaacaagagagctcggccacaaatcagacggtcaaactatcgagtggctactacgtcaagctgagccttctatcatagccgcgacaggaaccggcacaactccggcgagtttctccaccgtgtcagcctcactccgaggaaactccaccaccacgagctgcaacttgtcctcgtctctagatcataaacctttgctaggggtatcaccgtttatactcggaaagcgcgtgagagccgacgaggatacaccgtctgggttctgggcggttccggcgaggcaggagttcggacaggtctggagctttgccgcaggagctacacaagagatgttgttacaacaacagcagcaacaagcagctgggctttttgtccaccagcagcagcaacagcaacaagctgcaatgggtgaagcttcggcggctagagttgggaactatcttccgggtcatcttaatctgcttgcttctttatctagtggagctcccgggtccggtcggggagaggatgatgaccagcgttgatgccttgatggtgaagttaaaccttattttagttttggtattattaatattaatctatgtttctctattgtc

SEQ ID NO: 1208 - protein, 215 aa, Brassica napus
  misc_feature: Ceres CLONE ID no.1064407
  misc_feature: Bit score of 233.1 for HMM based on sequences of FIGURE 14.
  misc_feature (2)..(95): Pfam Name: TCP Pfam Description: TCP family transcription factor
  misc_feature: Functional Homolog Of Ceres SEEDLINE ID no. ME18158 at SEQ ID NO. 1151
MSNNNDGALVVKKPPAKDRHSKVDGRGRRIRMPIICAARVFQLTRELGHKSDGQTIEWLLRQAEPSIIAATGTGTTPASFSTVSASLRGNSTTTSCNLSSSLDHKPLLGVSPFILGKRVRADEDTPSGFWAVPARQEFGQVWSFAAGATQEMLLQQQQQQAAGLFVHQQQQQQQAAMGEASAARVGNYLPGHLNLLASLSSGAPGSGRGEDDDQR

SEQ ID NO: 1209 - protein, 249 aa, Brassica rapa
  misc_feature: Public GI ID no.83032232
  misc_feature: Bit score of 366.0 for HMM based on sequences of FIGURE 14.
  misc_feature (25)..(123): Pfam Name: TCP Pfam Description: TCP family transcription factor
  misc_feature: Functional Homolog Of Ceres SEEDLINE ID no. ME18158 at SEQ ID NO. 1151
MSNNDGVMISNGSLIEHQRQQQQQNLKQSSDGALVVKKPPAKDRHSKVDGRGRRIRMPIICAARVFQLTRELGHKSDGQTIEWLLRQAEPSIIAATGTGTTPASFSTASVSVRGSSTTISTSTNCTLSSSLDHKPFILGKRLREDSGGGKDEMGSFATPAGFWAVPARPDFGQVWSFASHQEMFLQQQQQQQQQPAAAALFVHQQQQQQAAMGEASAARVGNYLPGHLNLLASLSGGAPGSGRREDDQR

SEQ ID NO: 1210 - DNA, 1763 bp, Glycine max
  misc_feature: Ceres CLONE ID no.1620420
  misc_feature: Encodes the peptide sequence at SEQ ID NO. 1211
attcactcattctctctctctctctctcaacacagagaaaacaacccagctgcaataatctcccatctgaaaggaattccatgctccacaaaacacacaaacagagaaaagagagacccactagcccactaagcgatagaaattgagggtcacctcatcacacctccttagctactacacacaaacacaacaacatacatagcaaaaaaatatatagaaaaagaaatctagtggcagtactactacttactacttccactatagctgctagctaccagataggaggaaaagaataacaagatcatggaattggaagctgatcatcaaaatgggattcgaagcagactcaatttccctctgcagctgttagagaaaaaggacattgatgacgtcacggaacaaccttgttccaccaccagcgtggtaactgctactactactgctattactactactactacttcagataacaacgacctccacttggcggagcagtccaagaagcctccgccgaaacggagttccaccaaggaccgccacacgaaggtcgatgggcgaggccgccggatccgcatgccggcggcctgcgctgccagagtgttccagctcacgcgtgagctgggacataagtctgacggcgagaccatcgagtggctcctccagcaggcggagcccgccgtcatcgccgccactgggacaggcaccattcccgccaacttcacctccctcaacatctccctccgcagctctggctccaccatgtcggccccgtcgcactacttccgcggaaactacttcaaccctagcacgttctccacgtccgccgccgcggcggcggcggctcagctgagaagccgcgcagagtgggaccggagcatgagcatggtgatggaggattctcgaaggagcatgctggagaacacttcttcaatctccgcaattttgaatttcaaccctatgggtaacgttaatgtaattcaacaagcgaaacaagagcttcgggaagaatccggcgggggcggcggtcttgaatcggtggcttctgattccgatggaagcttagggagaaagagaaggccagagcaagaactatcacaaatgggaagctatttgatacaatcaagcacagggtcgcttccggcgagccacgcttccaatacggcggcgttttggatggtggcgggtcacggcaaccaagccatgagtggtggtggcagcgtcggcggtggcaacaatggtagcagcgataataatcccatttgggcaattccctctgttgggaatagtggtgtgtatagaggagctatgtctgctccaggtggcattcatttcatgaatttcgcttctccgatgaaccttatgcccggaggtcaactaggttccggtatcgttggtggcggtggcggcggtggtggcaacggcggtgctcaacttctaagtgaaagtaacttaggcatgcttgcagcccttaatgcctacaggcagattccggcgaacggcgtctcggagcctccgggcagtgccgggcaacatcacggcggagacgatggacgtgattccaccagtcaacattcctgagggtcaaaataatcacaagtgtatgatctgatgctagcttcttaatttttcttttaattactatattattcctagtgctattattactactattagctctactactaattagtgatttgcataatatatattaaatacgtaattatatatgttatgtccatttgcaaaaaaaaaaaaaaaaaaaa

SEQ ID NO: 1211 - protein, 424 aa, Glycine max
  misc_feature: Ceres CLONE ID no.1620420
  misc_feature: Bit score of 820.0 for HMM based on sequences of FIGURE 14.
  misc_feature (63)..(157): Pfam Name: TCP Pfam Description: TCP family transcription factor
  misc_feature: Functional Homolog Of Ceres SEEDLINE ID no. ME18158 at SEQ ID NO. 1151
MELEADHQNGIRSRLNFPLQLLEKKDIDDVTEQPCSTTSVVTATTTAITTTTTSDNNDLHLAEQSKKPPPKRSSTKDRHTKVDGRGRRIRMPAACAARVFQLTRELGHKSDGETIEWLLQQAEPAVIAATGTGTIPANFTSLNISLRSSGSTMSAPSHYFRGNYFNPSTFSTSAAAAAAAQLRSRAEWDRSMSMVMEDSRRSMLENTSSISAILNFNPMGNVNVIQQAKQELREESGGGGGLESVASDSDGSLGRKRRPEQELSQMGSYLIQSSTGSLPASHASNTAAFWMVAGHGNQAMSGGGSVGGGNNGSSDNNPIWAIPSVGNSGVYRGAMSAPGGIHFMNFASPMNLMPGGQLGSGIVGGGGGGGGNGGAQLLSESNLGMLAALNAYRQIPANGVSEPPGSAGQHHGGDDGRDSTSQHS

SEQ ID NO: 1212 - DNA, 1530 bp, Glycine max
  misc_feature: Ceres CLONE ID no.1656310
  misc_feature: Encodes the peptide sequence at SEQ ID NO. 1213
gtcacgttctctctaagcctttttctatgtaaagcgaaacaactcaactgccacctccataccaaagcaaaatcgatgctccacaaaacccacagacccacagaattcatggtcacccactacacaaagacaaatctacatatcaacacagtatcactatcttttcataactctgtaacaatttttattattatttgtatatgatactgcttcgtcatggaagaagaatgtgttcatcaacaaaacgtggctggtaataagtccaatttcccgctacagctgctgaagaaaaaggatgagggaccaccaccatcaccaccgccgagcgccgccaaggccaagcgaccaccgacgaaggacagacacaccaaggtggaggggcgggggcggcggatccggatgccggcggcttgcgcggcgagggtgttccagctgacgcgcgagctcggccacaagtccgacggtgagaccatcgagtggctgctccgggaggccgagcccgctgtcatcgccgccaccggcaccggcaccatcccggcgaacttcacgtcgctgaacatctccctccgcagctccggctcctccctctcctccccctcccactacttcctcaaccgccggaacaatctttacaatcacaacaaccaccccttcgtcacaacaacacccatattttcttcttctgaatcgtgttttaaatcatacccaagttttagtttcgcggaagattctaaaaggtcctctttttccgactcctctttcgcgaataactattattcgcgaaagaggaggcacgaggtgatttcgcacgtgggaagttgttgttcgtctcagatgtgtacggactccgttcccgccatgatgggtggcgctgattcagtttgggccattccctctgtggcttcttcttctgcgagtggcattccttttatgaattttgcttcgctgttgaccggtcaacacgtgggtggtgcaacgctgagtagtgaaaccaacttcaatgtgcttgcaacgcttaatgcgtattccggccaacaacatcaacatcgccatgaaggagaagaaacacactactaatctatcaatcaaggttaaattctccctttagattcatttttctttaaacattcacagtagatcaaggggaaaagtgaaataaacattttttttataaactaaaattaacttatttatatctttgaaaagtttattttaattatgtataagttaattttaatctttaacaaaagtttatttcattttttttctttgttttcttctgtgataattgtttgtagaaaaaaatatccaaactgcaggattaattccctattgatcatggagcaagtgattaagtgtagggcttgatgcaacaacttgttatttcttttgttattactaattgttaattttccaattatgcatgtatgtgtcgatttccaacacatgcagggacgagtttgaatcctttggtgttgagttcgctagtcaattttggtgtggttttgctaaaaaaaaaaaaaaaaaaaa

SEQ ID NO: 1213 - protein, 286 aa, Glycine max
  misc_feature: Ceres CLONE ID no.1656310
  misc_feature: Bit score of 297.0 for HMM based on sequences of FIGURE 14.
  misc_feature (30)..(128): Pfam Name: TCP Pfam Description: TCP family transcription factor
  misc_feature: Functional Homolog Of Ceres SEEDLINE ID no. ME18158 at SEQ ID NO. 1151
MEEECVHQQNVAGNKSNFPLQLLKKKDEGPPPSPPPSAAKAKRPPTKDRHTKVEGRGRRIRMPAACAARVFQLTRELGHKSDGETIEWLLREAEPAVIAATGTGTIPANFTSLNISLRSSGSSLSSPSHYFLNRRNNLYNHNNHPFVTTTPIFSSSESCFKSYPSFSFAEDSKRSSFSDSSFANNYYSRKRRHEVISHVGSCCSSQMCTDSVPAMMGGADSVWAIPSVASSSASGIPFMNFASLLTGQHVGGATLSSETNFNVLATLNAYSGQQHQHRHEGEETHY

SEQ ID NO: 1214 - protein, 487 aa, Medicago truncatula
  misc_feature: Public GI ID no.92885257
  misc_feature: Bit score of 359.1 for HMM based on sequences of FIGURE 14.
  misc_feature (114)..(218): Pfam Name: TCP Pfam Description: TCP family transcription factor
  misc_feature: Functional Homolog Of Ceres SEEDLINE ID no. ME18158 at SEQ ID NO. 1151
MELSDLQNNKQKRGTTNIHPHHQQQESSSPSNSHHQQLVVPFDGRPSPFIMGSISNIQPSSNSSPSNSSSSSASASASASAPTQHLIDASLAIATRSEPPLPDVSNNQIQPFSSTSTTVTAVANPPKRSTKDRHTKVDGRGRRIRMPATCAARVFQLTRELGHKSDGETIEWLLQQAEPAIIAATGTGTIPANFSTLNVSLRSSGSTLSAPPSKSAPLSFHSALALAHHPYEEAAYQHAPLLGFHPHQHHQQQLMNADQIGEALSNENYMRKRYREDLFKEDNNNQNESGGDGDGSSSPKSFKTNHQQQDDMGEGDGGGGGASSSSSIGNSFSGLLRPSNMLPATAMWATAGSGSTIWMVPVSGGAATSNSETQTQNMWPFNPHVQSQNQGNAAVTPSQLHFMPRFNVPASGGVEFQGGRGGLQLGSAYQPSQHLGLAVSDSNMGMFAALNAYNRAAHFNVNNSSDHHQQQPQPNDESGEDAPNTSQ

SEQ ID NO: 1215 - protein, 437 aa, Medicago truncatula
  misc_feature: Public GI ID no.92892428
  misc_feature: Bit score of 897.3 for HMM based on sequences of FIGURE 14.
  misc_feature (81)..(180): Pfam Name: TCP Pfam Description: TCP family transcription factor
  misc_feature: Functional Homolog Of Ceres SEEDLINE ID no. ME18158 at SEQ ID NO. 1151
MDGGDDLHHHHHHQHHQHHHQHQQQQRQNFPFQLLEKKEDNQEAASCSTSSPYPSLAISPTEPSTSNSNRSNQLVPASTPTTSDPANKKPPPKRTSTKDRHTKVEGRGRRIRMPALCAARVFQLTRELGHKSDGETIEWLLQQAEPAVIAATGTGTIPANFTSLNISLRSSGSSMSVPSQLRSSYFNPNFSLQQRRTLFPGIGLSPSDNNSNNNTSMLLNFQSNNLTNMLQAKQEVRDGNTNSNANANAPSSSTTLDLSETSGEESMGGRKRRTSSGGSEQDLSSLQHQMGSYLMQSSAGSIPASHTQIPANIWMVANSNNQIMSGGDPIWTFPSVNNSAAALYRGAVSTSGLHFMNFPQPMALLPGQQLGNSSGGGGGGGNINMNMNMNEGHLSMLAGLSPYRPVSDHHQQHHQPSGSQSHHHRSGSHEHDDRHDN

SEQ ID NO: 1216 - protein, 257 aa, Medicago truncatula
  misc_feature: Public GI ID no.92868571
  misc_feature: Bit score of 258.7 for HMM based on sequences of FIGURE 14.
  misc_feature (17)..(118): Pfam Name: TCP Pfam Description: TCP family transcription factor
  misc_feature: Functional Homolog Of Ceres SEEDLINE ID no. ME18158 at SEQ ID NO. 1151
MSNPDGTTTTTTTTNGSIIDPNRQQLAVKKPPAKDRHSKVDGRGRRIRMPIICAARVFQLTRELGHKSDGQTIEWLLRQAEPSIIAATGTGTTPASFSSLSVSLRGSSNSLPSPSSTSLDHKPLLSPTPFILGKRIRTDDDSSSSSAKDDALSVGSLSTPAALWALPARPDFGQIWSFAAAAAGAPPPEMMVQSLSQQQHQVQANFFAHHHQQQQHQQAMGEASAARVGNYLPGHLNLLASLSGGHGNSGRRDDEHH

SEQ ID NO: 1217 - protein, 336 aa, Solanum tuberosum
  misc_feature: Public GI ID no.53689778
  misc_feature: Bit score of 433.7 for HMM based on sequences of FIGURE 14.
  misc_feature (73)..(169): Pfam Name: TCP Pfam Description: TCP family transcription factor
  misc_feature: Functional Homolog Of Ceres SEEDLINE ID no. ME18158 at SEQ ID NO. 1151
MENVHHHHDHDNIGNFIQRPNFPLQLLEKRDQVDHTTICSSQVHPYNSTSLHMMTTSSSDAPCVDHNQKSKNEDKKQQQPQAKKPTTTKDRHTKVDGRGRRIRMPATCAARVFQLTRELGHKSDGETIEWLLQQAEPAVIAATGTGTIPANFSSLNISLRSSRHHSSATNYLAHNNNFGHVYPDRNYFNGVGLFSSENNSFFPSGNLNMLQAKEELCDDDDNDNDNNNNNTGRIKRRSEDQDLLQNNYHMSNMLQSSPYGSIPASHQVGQIPATTLYMMTNNNNSSHHDPSNCSMWGSSSNNNNNIENSNIRFINQFWGHVAVAAAGRRRKGNGGC

SEQ ID NO: 1218 - DNA, 1894 bp, Triticum aestivum
  misc_feature: Ceres CLONE ID no.835598
  misc_feature: Encodes the peptide sequence at SEQ ID NO. 1219
atctctcccctccgtccccgctcccctgcgcctcctcccaaccccacccggccaccaccccgccccaccctgcgtgcccggcacgtgctcctctccctcttcaaccctaactccggtgactacccgaacgcgtgcgtgcggaccaccgggcaggccaaaggagccgccttttcatttcttccttctcgggaggaagggagggagggttcttggggacgcgcatggaccatggcggcggcagcggtgggggtggaagtggaggcgggggcgggggcggagcgccgtcgagcagcaacagcggcgggggaagcgccgggggcacgagcggaagccgtggcggcggcagcgaccaccatccgcaccacccattctactacgcaggcccagcggagcccaacaacgtgcagcagcagccgcagccgcagcagttcattgggtcgctcgccataacacccgtcgtcaccgaccaggccccggcttcctcggcggagaagaaggcggtcgcgccagtgactccatcggccggcgcactggcgaagcggccatccaaggaccggcacaccaaggtggatggccggggaaggaggatacggatgccggctctgtgcgcggcgcgggttttccagcttacgcgggagctcggccacaagtccgacggcgagaccatcgagtggctgctgcagcaggcggagccagctatcctcgccgccaccggcaccggcaccatcccggccaacttctcctccctcaacatcagtcgcgcggcctccggcaccagccgccccgcgccattccccgccctcgcgctccacccccaccacccccaccaccagtcgccgcacccgcagcacgacatgtccaccatgctgggttaccaccacctgctcccgccgccgcaggagccgccccaggacgcaaatagccccggttccttcatgaggaagcggtaccgagaggacctgttcaaggaggacgatgagcggcaagatcctaacgcgcccaaggcgcgcgagcagcaggcggcgccgcccgccgcaatgtgggccgtggcgccgaacagcgcggcccctggaggcgcgttctggatgttgcccgtgtccgcgagccaggctgccgcggttcggccgaccgagcagcctatgtggtctttcggcggcggcggggggagcagcaccgtgcaggcgccgctgcagttcatgtcaacaagggtgaactaccccggcagcgccggtgcgatgggcggcatgcccgacaccaacatcggcatgcttgctgggctcaatgcttacgaccgcggcggtgggggcggtggaggtacggaagaagagcagcagcagcagcagcagcagcaggagcaagaccagcaacaagaaatggagcagcagcgcgacggcagcggcgggggcaacgaaggcgaagaggacggcgacgacgacagcggcggagaagaggaaggccatcgcgacaacagctcacagtaagcaagctcgcatgatgaaaaactctgaatccaccatgttcatatcgcaatcgtgctagtggggtgggctagaatcgaatcctgggattggccgaggccatcattggactgctcactgctgggttaagaagaagattgcagaaatggatgatggaaaggaagaaagcaactgaatgcaagaacaagacttgttgctagtccttaggcctcgttatttttggtggtatttttttgtctgtttattttattttccttgttggatggattgatccgtgatgaatgattggcatgtttagatgggtgcgatgattggtagtgttagtgggtcccgactcaggagggtccaggaggaagaaaccagttttatttgtacagttgatcatcttgatttgtgctacaaaaaaaaaaaaaaaa

SEQ ID NO: 1219 - protein, 419 aa, Triticum aestivum
  misc_feature: Ceres CLONE ID no.835598
  misc_feature: Bit score of 315.0 for HMM based on sequences of FIGURE 14.
  misc_feature (98)..(184): Pfam Name: TCP Pfam Description: TCP family transcription factor
  misc_feature: Functional Homolog Of Ceres SEEDLINE ID no. ME18158 at SEQ ID NO. 1151
MDHGGGSGGGGSGGGGGGGAPSSSNSGGGSAGGTSGSRGGGSDHHPHHPFYYAGPAEPNNVQQQPQPQQFIGSLAITPVVTDQAPASSAEKKAVAPVTPSAGALAKRPSKDRHTKVDGRGRRIRMPALCAARVFQLTRELGHKSDGETIEWLLQQAEPAILAATGTGTIPANFSSLNISRAASGTSRPAPFPALALHPHHPHHQSPHPQHDMSTMLGYHHLLPPPQEPPQDANSPGSFMRKRYREDLFKEDDERQDPNAPKAREQQAAPPAAMWAVAPNSAAPGGAFWMLPVSASQAAAVRPTEQPMWSFGGGGGSSTVQAPLQFMSTRVNYPGSAGAMGGMPDTNIGMLAGLNAYDRGGGGGGGTEEEQQQQQQQQEQDQQQEMEQQRDGSGGGNEGEEDGDDDSGGEEEGHRDNSSQ

SEQ ID NO: 1220 - DNA, 1424 bp, Triticum aestivum
  misc_feature: Ceres CLONE ID no.575649
  misc_feature: Encodes the peptide sequence at SEQ ID NO. 1221
aacttcccccaaccaaaagacagcaccgtgtgttctcgtgtgtatatgtctatggcctaatcgagaccatggacgttaccggggacgccggtggaggtcgccgccccaacttccccctgcagctcctcgagaagaaggaggagcatccgtgctccatctccccggctgctgggctcgggacgaatgggtcggcgacgggggagctgcaggtgcggaaggcggcaccgcctaagcggaccacgagcaaggaccggcatacgaaggtggacgggcgcggccgccgcatccggatgccggcgatctgcgcggcgcgggtgttccagctgacgcgggaactggggcacaagacggacggcgagaccatcgagtggctcctgcagcaggcggagcccgctgtgattgcggccaccggcacaggcaccatcccggccaacttcacatctctcaacatctccctccgctcctccggctccatgctctccaccatacccgcccacctccgcgccgccggcctgccggggtctcgctttggaggtggcccatgggcggacgcgtgggaccgcttcgtcggtctcgggttcggcggtggcctcgagagcccggcctccaccaccacctcgtcgtcgtccccgctgctgctgagcttccactccggaagcgtcggcctcgacgtttcgccgtcgtcggcgacggctgcggccaacacggaactgtccaggaagcggcgttgggagcaagaaatgcagcagcagcagcaacaacatcatcaccaccaacagcaacagcagcaacagtaccagcaacagatggccgggtacacgcagagccaaatgccgggcactgtgtggatggtgccgacgagcaacgcccaggccgccggagcggcgcctgccggtggcggcgagtcgatctggacgttcccgcaacccggaagcggcggcggcggcggctcggcgaccgtgtaccgcggcgtgccgagcgggctacatttcatgaacatccccgcgccgatggcagtgcacgcgcagcagctgggactcggccaggccggcggcggcggatcagcagcagcgggcgaggggcacatggggatcctcgccgcgctcaacgcgtaccgtgggcagcatgcagcggcgtcggaggtcaccgtggcggggcacaatggagcagctgaagggactactcaccatcaacatcagaatcagcatcagcatctgcagcacgggggtggcgagccgaacgagagcatgagcggcagcgactcgtaggacttcgtgaccgctggtccgttcgacagctttggcttaccaattttcgtctttggatttgttcttctttggtttgtttctgttcttgactcgatcgcttgttatggctttgttccttctccaaattcttgcacggttcatacgattgcaacttgc

SEQ ID NO: 1221 - protein, 399 aa, Triticum aestivum
  misc_feature: Ceres CLONE ID no.575649
  misc_feature: Bit score of 543.9 for HMM based on sequences of FIGURE 14.
  misc_feature (49)..(138): Pfam Name: TCP Pfam Description: TCP family transcription factor
  misc_feature: Functional Homolog Of Ceres SEEDLINE ID no. ME18158 at SEQ ID NO. 1151
MDVTGDAGGGRRPNFPLQLLEKKEEHPCSISPAAGLGTNGSATGELQVRKAAPPKRTTSKDRHTKVDGRGRRIRMPAICAARVFQLTRELGHKTDGETIEWLLQQAEPAVIAATGTGTIPANFTSLNISLRSSGSMLSTIPAHLRAAGLPGSRFGGGPWADAWDRFVGLGFGGGLESPASTTTSSSSPLLLSFHSGSVGLDVSPSSATAAANTELSRKRRWEQEMQQQQQQHHHHQQQQQQQYQQQMAGYTQSQMPGTVWMVPTSNAQAAGAAPAGGGESIWTFPQPGSGGGGGSATVYRGVPSGLHFMNIPAPMAVHAQQLGLGQAGGGGSAAAGEGHMGILAALNAYRGQHAAASEVTVAGHNGAAEGTTHHQHQNQHQHLQHGGGEPNESMSGSDS

SEQ ID NO: 1222 - DNA, 1161 bp, Triticum aestivum
  misc_feature: Ceres CLONE ID no.884742
  misc_feature: Encodes the peptide sequence at SEQ ID NO. 1223
ccagacccccccccctccccctctccaccaccatgacgacgaggcccgacggcggcggcggcggcgtgggcggcgacggcgcggagggcaagcagctggtgcccgtggcggcggcggcgtcgaacggggcgaatggcgcgctggcggtgcgcaaggcgccgtccaaggaccggcacagcaaggtggacggccgggggcggcgcatccggatgcccatcatctgcgcggcgcgcgtgttccagctcacccgcgagctggggcacaagtccgacggccagaccatcgagtggctgctccgccaggccgagccctccatcatcgccgccaccggctccggcaccactccggcctccttctccacctcctcgccctcctccctccgcccccccggcgccccccacccgcagcacccccacgcgcacgcgcagccgctcgccgtctccccgcaccaccaccacctgccgcacgccgcgcccttcatcctcggcaagcgcgtccgcgacgacgacggcggcggcaacggcaacggcaacggccaggcggcggcggtgacggcggccatggccccggcgccggggttctgggcgctgcccgcgcggggcgacttcgggcagctgtggagcttcgcgccgccgccggagatgatggcggcggcgccggcgatggcgggcgaggcctccgccgcccgggtcggaaactacctgcccatggcgcaggccaacctgaacctgctcgcctccttctccggcggccccggcggcgccgggcaggccaccgggcgggccgaggaggagaccgcccactgatcccgcggctgtgcagggttttagtcagggctagggtttcttcttccccgtcggcgcggattgcttccttttggggtcaatttccatggttcctccggcaagaggaaaagattactgaaagtgttcatcagacaaggtggtgctggtggcgtcagtcaaaaattcagtgcgaattaagctatgctctctgctctctctctctctctctctagtcagttcagttgtttaggtcaggtcaggtcaattgggtctctaaatttctgccggtagcaacagcaattcttgctccttttttcatgtaaaaatcaatcatcatgggtccaggtcgtgtgggttcctaaaaaaaaaaaaaaaa

SEQ ID NO: 1223 - protein, 257 aa, Triticum aestivum
  misc_feature: Ceres CLONE ID no.884742
  misc_feature: Bit score of 382.2 for HMM based on sequences of FIGURE 14.
  misc_feature (28)..(119): Pfam Name: TCP Pfam Description: TCP family transcription factor
  misc_feature: Functional Homolog Of Ceres SEEDLINE ID no. ME18158 at SEQ ID NO. 1151
MTTRPDGGGGGVGGDGAEGKQLVPVAAAASNGANGALAVRKAPSKDRHSKVDGRGRRIRMPIICAARVFQLTRELGHKSDGQTIEWLLRQAEPSIIAATGSGTTPASFSTSSPSSLRPPGAPHPQHPHAHAQPLAVSPHHHHLPHAAPFILGKRVRDDDGGGNGNGNGQAAAVTAAMAPAPGFWALPARGDFGQLWSFAPPPEMMAAAPAMAGEASAARVGNYLPMAQANLNLLASFSGGPGGAGQATGRAEEETAH

SEQ ID NO: 1224 - DNA, 1713 bp, Zea mays
  misc_feature: Ceres CLONE ID no.376567
  misc_feature: Encodes the peptide sequence at SEQ ID NO. 1225
tagattttcttattcgccccttctctctccttctattttcagagagtcccctcgcctctgcctgcctgtcccatccccagtccaccaagcagcgcccgtcaccatctctccccatcccctttgccactctcggtcttctccctcctcagggcaggcaggggaagcagaagaaggaagcgagagcacggagcctgatttggtttgctttttgttgcccagactcggagggagttggtgtctctgtgtgtgtggagatggaccccaagttccccccacccccaccgctaaacaaaacggagcccaccaccgcgacgaccaccaccacctcgaccgcgcagcagcagcagcagctggatcctaaggactaccaccagcagcagccggcgcagcaccaggagcaccaccaccacctgcaaatccaaactcaccagccgccgcagcaggacgggggcggcggagggaaggagcagcagcagctgcaggtggtggcgcagcccggggagaggaggcagcasgcgctcgcgcccaagcggagctccaacaaggaccgacacaccaaggtcgacggcaggggccggcggatccggatgcccgcgctctgcgccgcgcggatcttccagctcacgcgggaactcggccacaagtccgacggcgagaccgtccagtggctgctgcagcaggccgagccggccatcgtcgccgccaccggcacgggcaccataccggcgtccgcgctcgcctccgtcgcgccctcgctcccgtcgcccacctccgggctcgccaggccgcaccaccacatgtgggcgccgtccgccggcttctcctcgccctccttcctgaactctgccgccgcgggcacgggcgatgccgccggtatcatgcagcggatggggatccccgcgggcttcgagctgccgggagcctccgccgccggagccaccctcggcgccggcggccacatcggttttgcgcccatgttcgctggacacgccgccgccatgccggggctcgagctcgggctatcgcaggacggccacatcggcgtgctcgccgcgcagtcgatcagccagttctaccaccaggtgggtgctgccgccgccggcggcggccagatgcagcacgcgcacgggcaccatcatcaccatcaccagcagcaggaggacggggaggacgaccgcgaggacggcgagtccgatgacgagtctgggcagtagtagtgtaaccgttcaaccttttgcgttgctgaatcttccctcaagttggaaggagagaaaagtgtatgcgtgcagccacgggatgcttctgctactcttggactgttgttggtcgagttctgatggatttttgtgtccatttttttctcgtgtggtatccaaactcaacggaggcctctcttgctgtgaagacttgcggattcgagatcatcctcagttcttcccacaatctcatggagtggatgatcgccacagccttctctccgacttccaggtgtatactagctgagaaaatgatggattggatcgatcacccttgagtgagtgccttatttgttattgcacagkgtgtagatattcaggtaattttgcagttagagaggtgttccttttattgtagtagtgatcaacgttttaaaacaatcaaggtattctcctccacaggctgtctatgcaacgcaagtatagtacaatttctagttcatgaccacgcataccg

SEQ ID NO: 1225 - protein, 319 aa, Zea mays
  misc_feature: Ceres CLONE ID no.376567
  misc_feature: Bit score of 131.6 for HMM based on sequences of FIGURE 14.
  misc_feature (80)..(183): Pfam Name: TCP Pfam Description: TCP family transcription factor
  misc_feature: Functional Homolog Of Ceres SEEDLINE ID no. ME18158 at SEQ ID NO. 1151
  misc_feature (87)..(87): Xaa is any aa, unknown, or other
MDPKFPPPPPLNKTEPTTATTTTTSTAQQQQQLDPKDYHQQQPAQHQEHHHHLQIQTHQPPQQDGGGGGKEQQQLQVVAQPGERRQXALAPKRSSNKDRHTKVDGRGRRIRMPALCAARIFQLTRELGHKSDGETVQWLLQQAEPAIVAATGTGTIPASALASVAPSLPSPTSGLARPHHHMWAPSAGFSSPSFLNSAAAGTGDAAGIMQRMGIPAGFELPGASAAGATLGAGGHIGFAPMFAGHAAAMPGLELGLSQDGHIGVLAAQSISQFYHQVGAAAAGGGQMQHAHGHHHHHHQQQEDGEDDREDGESDDESGQ

SEQ ID NO: 1226 - DNA, 1355 bp, Zea mays
  misc_feature: Ceres CLONE ID no.1284191
  misc_feature: Encodes the peptide sequence at SEQ ID NO. 1227
ctattctctttctctctcattcccccgccccctcgcctcccctctcccacctccaccaagcaccgccggtcactatccctccttggtcttctccctcctcagagcagggaggggaagcggaagagggaggcgagagcacgggaaacctgatctgatttgcttttggtcgccacaagagaagggagttggtgcagtttgtaggcgtgcctctgtgtctccgtgtgtgtggagatggaccccaagttccccacacccccaccgctaaacaaaacggagcccaccaccgcgacgaccaccaccacctcgaccgcgcagcatcatcagctggatcctaaggactaccagcagcagacggcgcagcaccaggagcagcagcagcaccaccatcacccccacctgcaaatccaaatccaccagccgccgccgccgccgccgccgcaggacgggggcggcggagtgaaggagcagcagcagctgctgcaggtggtggcgcagcccggggatcggaggcagcaggcgctcgcccccaagcggagctccaacaaggaccgccacaccaaggtcgacggcaggggccgccggatccggatgccggcgctctgcgccgcgcggatcttccagctcacgcgggagctcggccacaagtccgacggcgagactgtgcagtggctgctgcagcaggccgagccggccatcgtcgccgccaccggcacgggcaccataccggcgtccgcgctcgcctccgtcgcgccctcgctcccgtcgcctacctccgggctcgccaggccgcaccaccaccacccgcaccacatgtgggcgccgtccgccggcttctcctcgccctccttcctgaattccgcgggcgcgggcgacggcaccggtatcggcggcatcatgcagcggatggggatccccgcgggcctggagctgccgggaggcggcgccgccggcggcggccacatcggctttgcgcccatgttcgccggacacgccgcggccatgccggggctcgagctcggcctctcgcaggacggccacatcggcgtgctcgccgcgcagtcgatcagtcagttctaccaccaggtgggtgccgctgccggcggcagtggccagatgcagcacccgcacgggcaccagcatcaccatcatcagcagcaggaggacggggaggacgaccgcgaggacggcgagtctgatgacgagtctgggcagtagtgtagtcgttcaaccttgcgttttctgggtcttccctcaagtggaggaggagagaaaagtgtatgcgtgcagccacggaatgcttctgctactcctggattcttgttggtcgatggatttttaaaaaaaaaaaaaaaaaa

SEQ ID NO: 1227 - protein, 327 aa, Zea mays
  misc_feature: Ceres CLONE ID no.1284191
  misc_feature: Bit score of 125.6 for HMM based on sequences of FIGURE 14.
  misc_feature (88)..(179): Pfam Name: TCP Pfam Description: TCP family transcription factor
  misc_feature: Functional Homolog Of Ceres SEEDLINE ID no. ME18158 at SEQ ID NO. 1151
MDPKFPTPPPLNKTEPTTATTTTTSTAQHHQLDPKDYQQQTAQHQEQQQHHHHPHLQIQIHQPPPPPPPQDGGGGVKEQQQLLQVVAQPGDRRQQALAPKRSSNKDRHTKVDGRGRRIRMPALCAARIFQLTRELGHKSDGETVQWLLQQAEPAIVAATGTGTIPASALASVAPSLPSPTSGLARPHHHHPHHMWAPSAGFSSPSFLNSAGAGDGTGIGGIMQRMGIPAGLELPGGGAAGGGHIGFAPMFAGHAAAMPGLELGLSQDGHIGVLAAQSISQFYHQVGAAAGGSGQMQHPHGHQHHHHQQQEDGEDDREDGESDDESGQ

SEQ ID NO: 1228 - DNA, 1676 bp, Zea mays
  misc_feature: Ceres CLONE ID no.367175
  misc_feature: Encodes the peptide sequence at SEQ ID NO. 1229
attctctttctctctctccttcccccgccccctcgcctcccctctcccacccccaccaagcaccgccggtcactatccctccttggtcttctccctcctcagagcagggaggggaagcggaagagggaggcgagagcacgggaaacctgatctgatttgcttttggtcgccacaagagaagggagttggtgcagtttgtaggcgtgcctctgtgtctccgtgtgtgtggagatggaccccaagttccccacacccctagcgctaaacaaaacggagcccaccaccgcgacgaccaccaccacctcgaccgcgcagcatcatcagctggatcctaaggactaccagcagcagacggcgcagcaccaggagcagcagcagcaccaccatcacccccacctgcaaatccaaatccaccasccgccgccgccgccgcaggacgggggcggcggagtgaaggagcagcagcagctgctgcaggtggtggcgcagcccggggatcggaggcagcaggcgctcgcccccaagcggagctccaacaaggaccgycacaccaaggtcgacggcaggggccgccggatccggatgccggcgctctgcgccgcgcggatcttccagctcacgcgggagctcggccacaagtccgacggcgagactgtgcagtggctgctgcagcaggccgagccggccatcgtcgccgccaccggcacgggcaccataccggcgtccgcgctcgcctccgtcgcgccctcgctcccgtcgcctacctccgggctcgccaggccgcaccaccaccacccgcaccacatgtgggcgccgtccgccggcttctcctcgccctccttcctgaattccgcgggcgcgggcgacggcaccggtatcggcggcatcatgcagcggatggggatccccgcgggcctggagctgccgggaggcggcgccgccggyggccacatcggctttgcgcccatgttcgctggacacgccgcggccatgccggggctcgagctcggcctctcgcaggacggtcacatcggcgtgctcgccgcgcagtcgatcagccagttctaccaccaggtgggtgccgctgccggcggcagtggccagatgcagcacccgcacgggcaccagcatcaccatcatcagcagcaggaggacggggaggacgaccgcgaggacggcgagtctgatgacgagtctgggcagtagtgtagtcgttcaaccttgcgttttytgggtcttccctcaagtggaggaggagagaaaagtgtatgcgtgcagccacggaatgcttctgctactcctggattcttgttggtcgatggatttttatgktttttttttctctcgtgtggtatccaaactcggcggaggcctctcttgctgtgaagacttgcgggctcaagatcatcctcacttcttcstacaatctcatggggtggatgatctgccacagccttytctccgacttmcaggtgtataatagctgaaaacttgatggattggaccaatcacccttgagtgagtgccttatttgttatattgcaaagtgtgtagatattcaggtaattttgcagttagagaggtgttctttttattggagtaaacatccacgttttaaaacaatcaaggtattcgccggcaattcgaccatcctccacaggctgtctatgcatcat

SEQ ID NO: 1229 - protein, 324 aa, Zea mays
  misc_feature: Ceres CLONE ID no.367175
  misc_feature: Bit score of 115.6 for HMM based on sequences of FIGURE 14.
  misc_feature (86)..(177): Pfam Name: TCP Pfam Description: TCP family transcription factor
  misc_feature: Functional Homolog Of Ceres SEEDLINE ID no. ME18158 at SEQ ID NO. 1151
  misc_feature (62)..(62): Xaa is any aa, unknown, or other
  misc_feature (105)..(105): Xaa is any aa, unknown, or other
  misc_feature (238)..(238): Xaa is any aa, unknown, or other
MDPKFPTPLALNKTEPTTATTTTTSTAQHHQLDPKDYQQQTAQHQEQQQHHHHPHLQIQIHXPPPPPQDGGGGVKEQQQLLQVVAQPGDRRQQALAPKRSSNKDXHTKVDGRGRRIRMPALCAARIFQLTRELGHKSDGETVQWLLQQAEPAIVAATGTGTIPASALASVAPSLPSPTSGLARPHHHHPHHMWAPSAGFSSPSFLNSAGAGDGTGIGGIMQRMGIPAGLELPGGGAAXGHIGFAPMFAGHAAAMPGLELGLSQDGHIGVLAAQSISQFYHQVGAAAGGSGQMQHPHGHQHHHHQQQEDGEDDREDGESDDESGQ

SEQ ID NO: 1230 - protein, 364 aa, Zea mays
  misc_feature: Ceres CLONE ID no.100748296
  misc_feature: Bit score of 531.0 for HMM based on sequences of FIGURE 14.
  misc_feature (55)..(148): Pfam Name: TCP Pfam Description: TCP family transcription factor
  misc_feature: Functional Homolog Of Ceres SEEDLINE ID no. ME18158 at SEQ ID NO. 1151
MDVAGDGGGGGHRPNFPLQLLEKKEEQPCSSSAAVGTSAGGGNGNGSGAGGEAAQVRKAAPKRSSTKDRHTKVEGRGRRIRMPALCAARVFQLTRELGHKTDGETIEWLLQQAEPAVIAATGTGTIPANFTSLNISLRSSGSSFSAPPHLRGAPLLPSPTSAAARFGGRADAWDRVVGLGFPPEGPASSSSSPSPLLLNFSGSVGLDVQPSPSAAAAAAAADMSRKRRWEQEMQQQQQQYQQQMAGYTQSQMPGTVWMVPSNNAPQGGAASSGGSGESIWTFPQMGSAAAAAAAVYRGSVPSGLHFMNFPAPVALLPGQQLGLGPVGGGGGGGGGGGEGHMGILAALNAYRTQAATDPAASQGG

SEQ ID NO: 1231 - DNA, 1919 bp, Zea mays
  misc_feature: Ceres CLONE ID no.1597176
  misc_feature: Encodes the peptide sequence at SEQ ID NO. 1232
aaagtacaccatcgtctcctctctcgctcccccaccgtcctagtcctatcatatgctcctatcttctccttcccccggcaatcgtcctcgctgcaacgcactagatctgtcgacaaacccaaccagaactccataaaatagtgtcgatcaccacaagaaaacctccctccccgtttctctctctttcactctttctctttctctccaaaaaagaattgcctccaacgccaagcaccacaagcacaagcccttgcttccttgatgccaccctttcgctctcgctagctctaacgccacctctgacggcgctgccgagcctccagtccaccgcccaacgtcatacaccaagtcaggtcagcagccccacaagaacacttcgtaggtcagcaaatccattattattaccgatatttctccaggtccctgaagagaaagcatcgtcttgtgtatttatatataccatggcctgatcggctatggacgtcaccggagatgccggcggaggtcgccgccccaacttccctttgcagctgctggaaaagaaagaggaacagccttgctctacgtccccagcggttgctgtgggtgctggggctaatgggtcgggagagatgcagatgaagaaggtggcgccgccgaagcgcacatcctccaaggacaggcacacgaaggtggacgggcgcggaaggcgcatccggatgcctgcaatttgcgcggctcgggtgttccagctgacaagggagctggggcacaagacggacggcgagacgatcgagtggctgctgcagcaggcggagcccacggtggtggcggccacgggcacgggcaccatcccggccaacttcacctcgctcaacatctccctccgctcctcgggctcttccttctccatcccagcgcacctccgtgcgggtgcggccggcccacgcttcggcggcgcgcgggggggacccgtgggagcgcgtcgtgggagtgggactcgggttcggcgccgccgccgaggaccctccgtccgctacgtcctcggcgtcgtctcctctgctgctgagtttccactccggcagcgtcggccttgacgcgtcgccgtcgccgtcgtctgccgccgccggctccgacctgtcgaagaaacggaggtgggagcaggaaatgcagcagcagcatcagcagcaataccaccagcagcagcagatggccgggtacacgacgcagagccaaatgccaggcgccgtgtggatggtgccgagcgcgagcagcaacgctcaagctgccgcagcggctggcggtggcggtggcggcagcaacgccaacgagtcgatctggacgttcccgcagccagcaagcggcggcggcggcgcggcgaccgtgtaccgcggcgtgccgagtgggctacatttcatgaacttccccgcggcgcccatggcgctggttcccggtggtgggcagcagctcgggctcggcggccccgtgcccgtgggcggcgccggcaacgacagtagtggcagtgccagcggcggcggcggcggcgccggcgagggccacatggggatcctcgccgcgctgaacgcgtaccgggcacataatgccgtctcggacgctgcgccggagcagaacggagcggaaggcggctctcgtcagcgccagcagcacggcggcggcggtgagcgacaggagagcgtgagtcctcccagcgacggctcatagcgtctttggagttcggaggcgtgtcagcgtgtgcgtgcactggtctgctatggcgtctctctctttctctctctctctctcctgtgttaattagtctgtgcttctcgacttatcgtttgcggtttttgttaattggttgcactgttgtggcctcctctggctccttcacattcttgcaaggatcatacagagtttcgttccaaaaaaaaaaaaaaaaa

SEQ ID NO: 1232 - protein, 199 aa, Zea mays
  misc_feature: Ceres CLONE ID no.1597176
  misc_feature: Bit score of 176.7 for HMM based on sequences of FIGURE 14.
  misc_feature (46)..(135): Pfam Name: TCP Pfam Description: TCP family transcription factor
  misc_feature: Functional Homolog Of Ceres SEEDLINE ID no. ME18158 at SEQ ID NO. 1151
MDVTGDAGGGRRPNFPLQLLEKKEEQPCSTSPAVAVGAGANGSGEMQMKKVAPPKRTSSKDRHTKVDGRGRRIRMPAICAARVFQLTRELGHKTDGETIEWLLQQAEPTVVAATGTGTIPANFTSLNISLRSSGSSFSIPAHLRAGAAGPRFGGARGGPVGARRGSGTRVRRRRRGPSVRYVLGVVSSAAEFPLRQRRP

SEQ ID NO: 1233 - DNA, 1041 bp, Zea mays
  misc_feature: Ceres CLONE ID no.375636
  misc_feature: Encodes the peptide sequence at SEQ ID NO. 1234
accgcctccattcctctctgctctgttctgctccaccaccctgatgacgacgaggccagacggcagcgcctccacgcccgcggacaagcagctcgtggcggcctccaacggcaacggcaacggcaacccgctggccgtccgcaaggcgccctccaaggaccggcacagcaaggtggacgggcgaggccggcgcatccgcatgcccatcatctgcgccgctcgcgtgttccagctcacgagggagctcgggcacaagtccgacggacagaccatcgagtggctgctcaggcaggccgagccctccatcatcgccgccaccggcaccggcaccacgccggcctccttctccacctcgtccccgtcatcgctccgctcctcctcgtcctccacagccggcgtccacccgcacgccgccccggcccaggggttctgggcgctgccggcgcgggccgacttcggacagctctggagcttcgcggccgcgccggagatgatggtcgccgcggctgcagcagcagcgccgggcatggccggggaggcgtccgccgccagggtcggcaactacctccccgtcgcgcagggcaacctcaacctgctggcctccttctccggcgggcctgctcccacagcggccgccggacgggccgaggaggagaccgcccgctaagggtcgtcaattcccagtctctctgtgtgtggctcaatccgggatagacagtgtcactctcacccaactctccatttctttttttggggttcagttcagatcagtgttggccacccgaattgggtggccttccactccatcccagtgagcaatcaagcaaggaggagctgcatcagctctccctcccgtcctatctatctatatgattttttttctttctttttgagcattggattagtgctctcaactacccacaagtgtttattagtcagccagctccttcagtgctactagcagctcagttcagtccatggtatgtgtccggattgtttgctgatgtgcttgttgatcaattaatggacataatggttgcg

SEQ ID NO: 1234 - protein, 207 aa, Zea mays
  misc_feature: Ceres CLONE ID no.375636
  misc_feature: Bit score of 249.3 for HMM based on sequences of FIGURE 14.
  misc_feature (21)..(117): Pfam Name: TCP Pfam Description: TCP family transcription factor
  misc_feature: Functional Homolog Of Ceres SEEDLINE ID no. ME18158 at SEQ ID NO. 1151
MTTRPDGSASTPADKQLVAASNGNGNGNPLAVRKAPSKDRHSKVDGRGRRIRMPIICAARVFQLTRELGHKSDGQTIEWLLRQAEPSIIAATGTGTTPASFSTSSPSSLRSSSSSTAGVHPHAAPAQGFWALPARADFGQLWSFAAAPEMMVAAAAAAAPGMAGEASAARVGNYLPVAQGNLNLLASFSGGPAPTAAAGRAEEETAR

SEQ ID NO: 1235 - DNA, 1466 bp, Zea mays
  misc_feature: Ceres CLONE ID no.288123
  misc_feature: Encodes the peptide sequence at SEQ ID NO. 1236
  misc_feature (1191)..(1191): n is a, c, t, g, unknown, or other
  misc_feature (1373)..(1373): n is a, c, t, g, unknown, or other
  misc_feature (1394)..(1394): n is a, c, t, g, unknown, or other
atgtaaaaccgtccgacgcgagccccacctccgcgctcgcacgcggaaggagagggacgagcgagccaccgtcaccgagcgcggttacaagaaaatccaatctctcccccacgctcgtttcgactcgcgccatggaggcgcaggcgcaggacaatagggcggaggatggggacggcgcgcggcaacacgtagccggcggcgtcgcggcgacggggatggctatgggcgcgatccccatgcacgggttcatggtcccgaagccagagccggtggagttcttcggcgggatggccgtggtgcggagcaagccgccgccgcggaaccgcgaccggcacaccaaggtggaggggcgggggcggcggatccgcatgcccgcggcgtgcgcggccaggatcttccagctgacgcgggagctagggcacaagtccgacggcgagaccatccggtggctgctgcagcagtcggagcccgccatcatcgccgccaccggcaccggcacggtcccggcgatcgcgaccacggtcgacggcgtgctccgcatccccacgcagtcctcgtcgtcctccagcccctcgtccctcaccaccgtggtcgacggcgacgaggcgtccgccaagcgccgccgcaagctgcagccgacgcgagcggccgccggcgcgtccccgctcgccaccgccgcgcccgcggcgtactacccggtcctcgccgacccgctcctgcagggcaccggtggagcggccatctcggtgccgagcggcctcgcccccatcgccgcgtcgggcgcccctcaagggctcgtcccggtcttcgcggtccctgcggccggcagccccggcggcggcaaccgcatgattccgcaggccaccgccgtgtggatggtgccccagcctggcgccgcggccgcccagcccacgcaattctgggccatccagcccgcgccgcagctcatcaacctcggcggcgcgcaggccgccgtgttccccgcggcggtgaacgtcgccgacttccagggccagcagcccatctctagcttgtctcacaacagcaactcggagcatctgcacctggggtccgggtcccacgagcagcagcgcggcggtcgcagcgacgtcaaccatccggaggaggaagaagacgacgacgacgacgacgagccggtgtccgactccagcccagaagagtaacgcaccnccgtacccccagaaagtccaaccccaaagcttaggttccttttgctctaatttaatcgccccccctcgttttcccccttttcgcaatcctccttatgatgaactacatgatgctttctgtcgtagctcacgttcagttcagtgacccccagtgttagtggtagagagaagaagatgatgatnaaagaggtagtggaactgtanaagcagcgtgtaatgcaaatcaaaacgagcagctgatttgttattgagttaattaattgacgaccttttgcc

SEQ ID NO: 1236 - protein, 346 aa, Zea mays
  misc_feature: Ceres CLONE ID no.288123
  misc_feature: Bit score of 108.9 for HMM based on sequences of FIGURE 14.
  misc_feature (62)..(165): Pfam Name: TCP Pfam Description: TCP family transcription factor
  misc_feature: Functional Homolog Of Ceres SEEDLINE ID no. ME18158 at SEQ ID NO. 1151
MEAQAQDNRAEDGDGARQHVAGGVAATGMAMGAIPMHGFMVPKPEPVEFFGGMAVVRSKPPPRNRDRHTKVEGRGRRIRMPAACAARIFQLTRELGHKSDGETIRWLLQQSEPAIIAATGTGTVPAIATTVDGVLRIPTQSSSSSSPSSLTTVVDGDEASAKRRRKLQPTRAAAGASPLATAAPAAYYPVLADPLLQGTGGAAISVPSGLAPIAASGAPQGLVPVFAVPAAGSPGGGNRMIPQATAVWMVPQPGAAAAQPTQFWAIQPAPQLINLGGAQAAVFPAAVNVADFQGQQPISSLSHNSNSEHLHLGSGSHEQQRGGRSDVNHPEEEEDDDDDDEPVSDS

SEQ ID NO: 1237 - DNA, 975 bp, Zea mays
  misc_feature: Ceres CLONE ID no.303582
  misc_feature: Encodes the peptide sequence at SEQ ID NO. 1238
gccagccacctctccctcgctctcactcaggtcccccgcaacacgacgagaggcagcaggaccggaaggcgccatggccaccacccgcgacgtctccgccgcctccgcggccgccatgttccacgtgtaccagcccatgccgatgccatccacggcggcggcccccgcgaaggcgggcaagaaggagggcggcaaggaccggcacagcaaggtgaacgggcgcgggcggcgcgtgcggatgccgatcgtgtgcgcggcgcgcgtgttccagctgacccgcgagctggggctcaagtcggacgggcagaccatcgagtggctgctccgccaggccgagccctccatcgtggccgccacgggctccggcaccaccccggccgtcttcgtctcctcctccgcgccgtccacgtcctcctcctcccactcccactcccactcccactaccagcaccagcagcagcagcaggccaccgtcgtcgtcctgggcaagcgcccgcgcgaggaaggcggcgacgccgcggcggcgtccgtgccggcgttctgggcggcggcgccgcggacgacggcggcagcggacgccagctggggcttctcgccgctggaggcccagcaggcggcggcggggtacgtgcccatggcacaggcgcagcagcagcagcagcaccaccaccacctcaacctgctcgccgcgctctccggtgccgcgaggcgcgccgaggcggcggaggagacccgatgactgctagcctagtagctacatgcatccgccactcgcgcgcatgcattggtcctttgttgtccgtgtgctcgctcttggcagcgtaaacgttcttgatttttgtttgtgtgtgtgcccttgtgatcttggctcgttagctagagtaatccagacttgttttgacacacgggtgatgataatgcatgcgcaaggatcgatccatggcatctgagaaattaacgttcagatgtgcaatc

SEQ ID NO: 1238 - protein, 221 aa, Zea mays
  misc_feature: Ceres CLONE ID no.303582
  misc_feature: Bit score of 101.7 for HMM based on sequences of FIGURE 14.
  misc_feature (24)..(131): Pfam Name: TCP Pfam Description: TCP family transcription factor
  misc_feature: Functional Homolog Of Ceres SEEDLINE ID no. ME18158 at SEQ ID NO. 1151
MATTRDVSAASAAAMFHVYQPMPMPSTAAAPAKAGKKEGGKDRHSKVNGRGRRVRMPIVCAARVFQLTRELGLKSDGQTIEWLLRQAEPSIVAATGSGTTPAVFVSSSAPSTSSSSHSHSHSHYQHQQQQQATVVVLGKRPREEGGDAAAASVPAFWAAAPRTTAAADASWGFSPLEAQQAAAGYVPMAQAQQQQQHHHHLNLLAALSGAARRAEAAEETR

SEQ ID NO: 1239 - DNA, 678 bp, Parthenium argentatum
  misc_feature: Ceres CLONE ID no.1604759
  misc_feature: Encodes the peptide sequence at SEQ ID NO. 1240
gacccctgttctcctctcctctcctccctccctctccctccttcaccagttcattccattcacttacccccctaaaccctatctcctctcctccactcacccttacaccatgtcatcatccgaagcccccactaacgccgttcctaactcagctaacgccgtcaccaataacagtaacggcgttttatccgttaaaaaacctccagctaaagaccgtcacagcaaggtcgacggacgtggccgtcgtatacgcatgccgatcatctgtgccgctagggtttttcagctcactcgtgagctaggtcacaagtccgacggtcaaactatcgagtggctcctccgtcaagctgagccgtcgattatcgccgccactggtaccggaactactccggctagcttctccactgtttcagttgtacggaattcgaactcgtctctctctgtagcgcttgaccagaaatcaccgtcgcatcaccaccacttaatctctccggctccgtttatcctcgggaaacgtctccggcctgaagacgacggtctcgacggaggagcaaaagacgataataatcataacagtcataacatgtcttcggctgttaacggcggaggaggaggaggaggaggattttgggcggtacaagggagaccggatttcggacaggtgtggagctttgcagc

SEQ ID NO: 1240 - protein, 189 aa, Parthenium argentatum
  misc_feature: Ceres CLONE ID no.1604759
  misc_feature: Bit score of 134.6 for HMM based on sequences of FIGURE 14.
  misc_feature (17)..(120): Pfam Name: TCP Pfam Description: TCP family transcription factor
  misc_feature: Functional Homolog Of Ceres SEEDLINE ID no. ME18158 at SEQ ID NO. 1151
MSSSEAPTNAVPNSANAVTNNSNGVLSVKKPPAKDRHSKVDGRGRRIRMPIICAARVFQLTRELGHKSDGQTIEWLLRQAEPSIIAATGTGTTPASFSTVSVVRNSNSSLSVALDQKSPSHHHHLISPAPFILGKRLRPEDDGLDGGAKDDNNHNSHNMSSAVNGGGGGGGGFWAVQGRPDFGQVWSFA

SEQ ID NO: 1241 - DNA, 1898 bp, Panicum virgatum
  misc_feature: Ceres CLONE ID no.1955192
  misc_feature: Encodes the peptide sequence at SEQ ID NO. 1242
aaaacaagctcgccaccctcctccggtcctcccccatccatcagccatcttctctctcatcatatcatatgaggaaggattctttccaacctacaatcttctttccttgatagctagccagctctttcttggactgtcgtctcttctctccctagccaccaccacacctaaccttctcgagcttgacccacagcaagagaggagaggctgctgaagacatcaaatccattccgctctcttccaaaccactaaccactccatttacccgcccaaacaatagacacgccaagatatatacttctatctgtgtatatataccatggcctaattcaccatggacgtcgccggtgacggcggaggcggccgccgccccaacttccctctgcagctcctcgagaagaaggaggagcagccgtgctccagctcggctgccgtgggcagttcggcgggcggcaacgccaggaatggatcgggggccgccggaggcgaggtgcaggtgcggaaggcggcgcccaagcgcagctcgaccaaggaccggcacaccaaggtggaaggcagagggcgtcgcatccggatgccggcgctgtgcgcggcgcgggtgttccagctgacgcgggagctgggccacaagacggacggcgagaccattgagtggctgctgcagcaggccgagccggcggtgatcgcggccaccggcacaggcaccatcccggccaacttcacatccctcaacatctccctccgctcctcgggctcgtccttctccgccccggctcacctccgcacggccttgcctagccccgccaccgccgctcggttcggccgcgctgacgcgtgggaccgggttgtcggcctgggcttcccttcggaaggcccggcctcgtcgtcatcgtcgccgtccccgttgttgctcaacttccactcgggcagcgtcggccttgacgtgcaaccgtcgccgtctgccgccgccgcagccgccgacatctcaaggaagaggcggtgggaacaagaaatgcagcaggcgcagcagcagcagcagcagcagcaggcgcagcaatatcagcagcagatcgcgggctacacgcagagccaaatgccgggaaccgtgtggatggtgccgagcagcaacagcacgcagggtggggcgccttccggtggcggcggcggcggcagcggtggaggaggcagtggcgagtccatctggacgttcccgcagatgagcagcgccgcggccgcggccgccgtgtaccgagggggcgtgccgagcgggctacatttcatgaacttccctgcaccggtggcgctgcttcccgggcagcagctggggctcggcaccgtggggagcggcggcggcggcggaggcggtggcgagggccacatggggatcctggccgccctcaatgcgtaccggacacaggccgcgacggatcccgcggcaggccagggcggcggaggaagtaccggaggaggagggtccggccagcagcaacacggtggcggccgcggcgagcggcatgagagcatgagcaccagcgactcgtagccgacgggggtctccgaggatcgcatgcatcgcacggctggtgtggctttgatctgttctttgtcttggtttcatttttttcctttcttttttgtggtttccttcctcctcctcctcctcctagctagacaccccttgcgtgcgaggattacgctcagctccattccatggcatgcgataggatcgtccaccatcctaacgcgggctgtgcctgtgacctgtgtgagtgagagagcgaggtgtgccatgggagaggaagaggagggaaacgcagcagcagcagagagattgttcattttgtcctttagttttagggtttgcattgatcaagtgcgagcagaagagatttttatcg

SEQ ID NO: 1242 - protein, 402 aa, Panicum virgatum
  misc_feature: Ceres CLONE ID no.1955192
  misc_feature: Bit score of 545.8 for HMM based on sequences of FIGURE 14.
  misc_feature (54)..(156): Pfam Name: TCP Pfam Description: TCP family transcription factor
  misc_feature: Functional Homolog Of Ceres SEEDLINE ID no. ME18158 at SEQ ID NO. 1151
MDVAGDGGGGRRPNFPLQLLEKKEEQPCSSSAAVGSSAGGNARNGSGAAGGEVQVRKAAPKRSSTKDRHTKVEGRGRRIRMPALCAARVFQLTRELGHKTDGETIEWLLQQAEPAVIAATGTGTIPANFTSLNISLRSSGSSFSAPAHLRTALPSPATAARFGRADAWDRVVGLGFPSEGPASSSSSPSPLLLNFHSGSVGLDVQPSPSAAAAAADISRKRRWEQEMQQAQQQQQQQQAQQYQQQIAGYTQSQMPGTVWMVPSSNSTQGGAPSGGGGGGSGGGGSGESIWTFPQMSSAAAAAAVYRGGVPSGLHFMNFPAPVALLPGQQLGLGTVGSGGGGGGGGEGHMGILAALNAYRTQAATDPAAGQGGGGSTGGGGSGQQQHGGGRGERHESMSTSDS

SEQ ID NO: 1243 - DNA, 1387 bp, Panicum virgatum
  misc_feature: Ceres CLONE ID no.2008687
  misc_feature: Encodes the peptide sequence at SEQ ID NO. 1244
gcggtttctttctccagcttctctctcggagcaccagaaggaatccatttaatccgtccatctctctcctcaagccctacaaagtacaccatcctcttccggcggccgccttcctccccctcctctcccctggcctcctcctagctagggtcatcagctcccacccctgaaatcacagatgaaccacaccaaaagtccataaaatagtgcttgtgatctcccacacgcacacacaaacacaagctcgccaccctcctcccatccatctatcagccatcttctctctcatcatatcatatgagcaaggattctttccaacctacaatcttctttccctgatagctagccagctctttcttggactctctcttctctccctaccaccacacctaaccttctcgagcttgacccacagcaaggggggagaggctgctggagacatcaaatccgttccgctttcttccaaaccactaaccactccatttaccccgctaaaaaccatacacgccaagatatatacttgtgtctgtgtatatataccatggcctaattcaccatggacgtcgccggtgatggcggaggcggccgccgccccaacttccctctgcagctcctcgagaagaaggaggagcagccgtgctccagctcggctgccgtgggcggcaacgccgggaatggatcgggggccaccggaggcgaggtgcaggtgcgcaaggcggcgcccaagcgcagctcgaccaaggaccggcacaccaaggtggaaggtagagggcgtcgcattcggatgccggctctgtgcgcggcgcgggtgttccagctgacgcgggagctgggccacaagacggacggcgagaccatcgagtggctgctgcagcaggccgagccggcggtgatcgcggccaccggcaccggcaccatcccggccaacttcacctccctcaacatctccctccgctcctcgggctcgtccttctccgccccggctcacctccgcacggccttgcctagccccgccaccgccgcccggttcggccgcgctgacgcgtgggaccgggttgtcggcctgggcttcccttcggagggcccggcctcgtcgtcatcgtcgccgtccccgttgttgctcaacttccactcgggcagcgtcggccttgacgtgcagccgtcgccgtctgccgccgccgcagccgccgacatctcaaggaagaggcggtgggaacaagaaatgcagcaggcccagcagcagcagcagcaggcgcagcaatatcagcagcagatggcggggtacacgcagagccaaatgccgggaaccgtgtggatggtaccgagcagcaacaacacgccgggtggggcgccttccggcggcggcggccgcgtcggttggaggaag

SEQ ID NO: 1244 - protein, 277 aa, Panicum virgatum
  misc_feature: Ceres CLONE ID no.2008687
  misc_feature: Bit score of 340.7 for HMM based on sequences of FIGURE 14.
  misc_feature (50)..(152): Pfam Name: TCP Pfam Description: TCP family transcription factor
  misc_feature: Functional Homolog Of Ceres SEEDLINE ID no. ME18158 at SEQ ID NO. 1151
MDVAGDGGGGRRPNFPLQLLEKKEEQPCSSSAAVGGNAGNGSGATGGEVQVRKAAPKRSSTKDRHTKVEGRGRRIRMPALCAARVFQLTRELGHKTDGETIEWLLQQAEPAVIAATGTGTIPANFTSLNISLRSSGSSFSAPAHLRTALPSPATAARFGRADAWDRVVGLGFPSEGPASSSSSPSPLLLNFHSGSVGLDVQPSPSAAAAAADISRKRRWEQEMQQAQQQQQQAQQYQQQMAGYTQSQMPGTVWMVPSSNNTPGGAPSGGGGRVGWRK

SEQ ID NO: 1245 - DNA, 1840 bp, Panicum virgatum
  misc_feature: Ceres CLONE ID no.1821559
  misc_feature: Encodes the peptide sequence at SEQ ID NO. 1246
agccagccagtcccaccacaccactggcacccacccagcaccaaattagctacgtagtagggatgaccaccaggcctgcagcagaggggggcgccgccgccgccgccgccgctgccgacaataagcagctcgtccccacctccaacggcaccgtccgcaaggccccctccaaggaccgccacagcaaggtcgacggccggggccgccgcatccgcatgcccatcatctgcgccgctcgcgtcttccagctcacccgcgagctcggccacaagtctgacggccagaccatcgagtggctgctccgccaggccgagccctccatcatcgccgccaccggcaccggcaccaccccggcctccttctccacctcctcgccatcctccctccgctcctcctcccagaccacgccaaccgccgccgcgcccttcatcctcggcaagcgcgcccgcgacgacgccggcgccgacgccgagcccacggtcgccgcccccgccccgggattctgggcgctgccggggcgggcagacttgggccagctctggagcttcgccgcagcgccggagatgatggtggccgcggccgccacgccggccatggcgggggaggcgtccgcagcccgggtcgggaactacctacccatggcgcagggcaacctcaacctgctcgcctacttctccggcgggccagctccaacggccacagccggacgggcggaggaggagagcgcacgctgaacgttgccttgtttcataggctccgccatcggctcaccacatctatctagggttttccaccttttatttatcaggtttttcttccttgagacttgttgctcctcctccccctcggtttgctttccttcattccttccttggcgtcgctgctcatctctcattccttgtgtgtgtgtgtgtgtgcaagtgtcactcggctcagctcatttctggtttcctctctggagtaccaggagctcacttctggtttcctctctagagtaccaggaggctgcagaattgggtggccttgagcaagagcacctgcaaaattgctccacctacctcactcgagtcctcagctcacccaccccatgacctggttttattcgtgtaggaagaaggtatagccgcttgctcagtgccgtaggtcgtctcttgttttgtgtcactacacccctggttgcagtgcagcatccacagctcagggtgatcgggagcaggcaaatgttgtcctgggagattgggaggtgtgcgcgtgggataaaattctagtcagtcagtgtgctgttgctgtcaaaactcctttcctggggggtgggctgttccaacaagaagaaaagaaaacttcctctctgttctgttggacaagcaagggaaatggcgtcaaattgtcgtccatctctgcagcaggcagcaggcagcaggcagcaggtgtatcwgctcagctcagctccctccctcccatgtgcctcacaaagcagagaggggaagaagaggaaggaaggaaaaagaccttttcttaccacaaacaaacaaacaaacaaacaaaggaggcttgggcctggctgtaagttgtccacttggtctgctgatctgctctgtctgcttgcttgctgtcattttgattgttgccttttgtgctcttatctggattcgattagtagtcataatactgcttctgcacctgcttgctggggatattgagagcaataactagtctgctagtcctcaattgttggtagctcagttcagctcttatgtatatatatgtatgcatgtatatgtatctatgtacggattgtttgttgatcaggtcaagaattaatggacgaaaataaggacgg

SEQ ID NO: 1246 - protein, 223 aa, Panicum virgatum
  misc_feature: Ceres CLONE ID no.1821559
  misc_feature: Bit score of 316.4 for HMM based on sequences of FIGURE 14.
  misc_feature (20)..(115): Pfam Name: TCP Pfam Description: TCP family transcription factor
  misc_feature: Functional Homolog Of Ceres SEEDLINE ID no. ME18158 at SEQ ID NO. 1151
MTTRPAAEGGAAAAAAAADNKQLVPTSNGTVRKAPSKDRHSKVDGRGRRIRMPIICAARVFQLTRELGHKSDGQTIEWLLRQAEPSIIAATGTGTTPASFSTSSPSSLRSSSQTTPTAAAPFILGKRARDDAGADAEPTVAAPAPGFWALPGRADLGQLWSFAAAPEMMVAAAATPAMAGEASAARVGNYLPMAQGNLNLLAYFSGGPAPTATAGRAEEESAR

SEQ ID NO: 1247 - DNA, 569 bp, Panicum virgatum
  misc_feature: Ceres CLONE ID no.1995843
  misc_feature: Encodes the peptide sequence at SEQ ID NO. 1248
tcccgccacaccactggcacccaccccccacccagcaccaaattaggggccggatgaccaccaggcctgcagacgggggcgccgccgccgccgccgccgctgccgacaagcagctcgtccccgcctccaacggcaacgctctcgccgtccgcaaggccccctccaaggaccgccacagcaaggttgacggccggggccgccgcatccgcatgcccatcatctgcgccgcccgcgtcttccagctcacccgcgagctcggccacaagtccgacggccagaccatcgagtggctgctccgccaggccgagccctccatcatcgccgccaccggcaccggcaccaccccggcctccttctccacctcctcgccatcctccctccgctccacctcctcgcagaccacgcccttcgtcctcggcaagcgcgtccgcaacgacgccgacgccgagcccacagtcgccgcccccgcccctggattctgggcgctgccggcgcgggcagacttcggccagctctggagcttcgcggcagcgccggagatgatggtggccgccgccgccgccgcggct

SEQ ID NO: 1248 - protein, 172 aa, Panicum virgatum
  misc_feature: Ceres CLONE ID no.1995843
  misc_feature: Bit score of 169.1 for HMM based on sequences of FIGURE 14.
  misc_feature (21)..(112): Pfam Name: TCP Pfam Description: TCP family transcription factor
  misc_feature: Functional Homolog Of Ceres SEEDLINE ID no. ME18158 at SEQ ID NO. 1151
MTTRPADGGAAAAAAAADKQLVPASNGNALAVRKAPSKDRHSKVDGRGRRIRMPIICAARVFQLTRELGHKSDGQTIEWLLRQAEPSIIAATGTGTTPASFSTSSPSSLRSTSSQTTPFVLGKRVRNDADAEPTVAAPAPGFWALPARADFGQLWSFAAAPEMMVAAAAAAA

SEQ ID NO: 1249 - DNA, 1973 bp, Panicum virgatum
  misc_feature: Ceres CLONE ID no.2008591
  misc_feature: Encodes the peptide sequence at SEQ ID NO. 1250
tcctctccctcctcctcaatcattgcccagagagagaacacggaagcggagggagctcttcttccacctctaccaccaccagccagccagccagtcccgccacagtacaccactggcacccaccccccacccagcaccaaattaggggccggatgaccaccaggcctgcagacgggggcgccgccgccgccgctgccgacaagcagctcgtccccgcctccaacggcaacgctctcgccgtccgcaaggccccctccaaggaccgccacagcaaggttgacggccggggccgccgcatccgcatgcccatcatctgcgccgcccgcgtcttccagctcacccgcgagctcggccacaagtccgacggccagaccatcgagtggctgctccgccaggccgagccctccatcatcgccgccaccggcaccggcaccaccccggcctccttctccacctcctcgccatcctccctccgctccacctcctcgcagaccacgcccttcgtcctcggcaagcgcgtccgcaacgacgccgacgccgagcccacagtcgccgcccccgcccctggattctgggcgctgccggcgcgggcagacttcggccagctctggagcttcgcggcagcgccggagatgatggcaggggaggcgtccgcagcccgggtcggaaactacctgcccatggcgcagggcaacctcaacctgctcgcctccttctccggcgggccagctccaacggccacagccggacggcccgaggaggagagcgcacgctgaacattcatacccccatcggcgttttatgcatctccacatctagggttttatttatttattactctaggttttcttccttgaatccttagcttgagacttgttgctcggtttgctttccttgctgctcaactctgcctgcgtgtctctactctctactctctactcagctcagctcgcttctggtttccttcctctctagtctctactagacctgggcaaacgtcgcgtcgggtcaaggtcgggtcacgggtcacataggacgacccgcgcccgacccgtacctatcaccgggtcgggtcgggttggcccgtgcaccctgcgcgggcgtgtcgggtcgggttttttcgggttgagtcgggttttttggcgtttgggtcggattttgggtcaaaaatcacggcccgtgcccagcccggtgattgttgcgggtcaaaaaatacggcccgcgtccacccaccacgtagctcgggtcgggtcgggtcgggtttttttcgggcgggttgggtcgggttgttcgggtcgggtgacccatgcccaggtagtctctaccaggctagcttggttgccgatcgaattgggtaaaaaattgctcgcacctgcaaaattgctccactcactcgtgtccactgctcagctcacccgccccatgagtgaccccattcctcgtcagtagtagtagatctcttgtttgttttgtgtcactacacccctggttgcttagcaaggagcaaatgttgtcctggtagtcatagagattgggaggtgtgcgcgtgtgtgctgttgctgtcaaaactcaaatgtactactaatctcctcctttccggggtgggctgttccaagaagaagagaagaaaacttcctctttgttggacaagcaagggaaatggcgtcaaattgtcgtccatctctgcagcaggcagctggtgcatcagttcagctcagctccctccctcccaagcagagagggggaagaagaggaaggaaggaaaaagaccttttcttaccacaaacaaacaaacaaacaaaggatgctgggcctggctgtaagttgtccacttggtctgctcatccgctctgtctgcttgctgtcattttgattgttgccttttgtgctcttatcttgattccattagtcatactgcttctgcacctgaatgttgagggagattgagagcaataactagtgtgctagtcctc

SEQ ID NO: 1250 - protein, 207 aa, Panicum virgatum
  misc_feature: Ceres CLONE ID no.2008591
  misc_feature: Bit score of 273.8 for HMM based on sequences of FIGURE 14.
  misc_feature (19)..(110): Pfam Name: TCP Pfam Description: TCP family transcription factor
  misc_feature: Functional Homolog Of Ceres SEEDLINE ID no. ME18158 at SEQ ID NO. 1151
MTTRPADGGAAAAAADKQLVPASNGNALAVRKAPSKDRHSKVDGRGRRIRMPIICAARVFQLTRELGHKSDGQTIEWLLRQAEPSIIAATGTGTTPASFSTSSPSSLRSTSSQTTPFVLGKRVRNDADAEPTVAAPAPGFWALPARADFGQLWSFAAAPEMMAGEASAARVGNYLPMAQGNLNLLASFSGGPAPTATAGRPEEESAR

SEQ ID NO: 1251 - DNA, 676 bp, Panicum virgatum
  misc_feature: Ceres CLONE ID no.2046826
  misc_feature: Encodes the peptide sequence at SEQ ID NO. 1252
gagaagcggggggaggagctctgctcttcttccacccacccaccacctctagggcagcacagcagggctggctctaccacgtccacgaccacgagtcagtcagtcagtcgccaccaccaccaccaccacccgcatccagtcggtcagccagccagtcccaccacaccactggcacccacccagcaccaaattagctacgtagtagggaggatagagagagaggggggatgaccaccaggcctgcagcagaggggggcgccgccgccgccgccgccgacaataagcagctcgtccccgcctccagcggcaccgtccgcaaggccccctccaaggaccgccacagcaaggtcgacggccggggccgccgcatccgcatgcccatcatctgcgccgctcgcgtcttccagctcacccgcgagctcggccacaagtctgacggccagaccatcgagtggctgctccgccaggccgagccctccatcatcgccgccaccggcaccggcaccaccccggcctccttctccacctcctcgccatcctccctcccctcctcctcccagaccacgccaaccgccgccgcgcccttcatcctcggcaagcgcgcccgcgacgacgccggcgccgacgccgagcccacggtcgccgcccccgccccgggattctgggcgctgccggg

SEQ ID NO: 1252 - protein, 149 aa, Panicum virgatum
  misc_feature: Ceres CLONE ID no.2046826
  misc_feature: Bit score of 108.3 for HMM based on sequences of FIGURE 14.
  misc_feature (22)..(108): Pfam Name: TCP Pfam Description: TCP family transcription factor
  misc_feature: Functional Homolog Of Ceres SEEDLINE ID no. ME18158 at SEQ ID NO. 1151
MTTRPAAEGGAAAAAADNKQLVPASSGTVRKAPSKDRHSKVDGRGRRIRMPIICAARVFQLTRELGHKSDGQTIEWLLRQAEPSIIAATGTGTTPASFSTSSPSSLPSSSQTTPTAAAPFILGKRARDDAGADAEPTVAAPAPGFWALP

SEQ ID NO: 1253 - DNA, 554 bp, Panicum virgatum
  misc_feature: Ceres CLONE ID no.1985573
  misc_feature: Encodes the peptide sequence at SEQ ID NO. 1254
agccggatgaccaccaggcctgcaaacaggggcgccgccgccgccgctgccaacaagcagctcgtccccgcctccaacggcaacgctctcgccgtccgcaaggccccctccaaggaccgccacagcaaggttgacggccggggccgccgcatccgcatgcccatcatctgcgccgcccgcgtcttccagctcacccgcaagctcggccacaagtccaacggccaaaccatcaagtggttgctccgccaggccaagccctccatcatcgccgccaccggcaccggcaccaccccggcctccttctccacctcctcgccatcctccctccgctccacctcctcgcaaaccacgcccttcgtcctcggcaagcgcgtccgcaacaacgccaacgccaagcccacagtcgccgcccccgcccctgaattctgggcgctgccggcgcgggcaaacttcggccagctctggagcttcgcggcagcgccggaaatgatggtggccgccgccgccgccgcggcgcccgccatggcaggggaggcgtccgcagcccgggtcgg

SEQ ID NO: 1254 - protein, 182 aa, Panicum virgatum
  misc_feature: Ceres CLONE ID no.1985573
  misc_feature: Bit score of 152.6 for HMM based on sequences of FIGURE 14.
  misc_feature (19)..(110): Pfam Name: TCP Pfam Description: TCP family transcription factor
  misc_feature: Functional Homolog Of Ceres SEEDLINE ID no. ME18158 at SEQ ID NO. 1151
MTTRPANRGAAAAAANKQLVPASNGNALAVRKAPSKDRHSKVDGRGRRIRMPIICAARVFQLTRKLGHKSNGQTIKWLLRQAKPSIIAATGTGTTPASFSTSSPSSLRSTSSQTTPFVLGKRVRNNANAKPTVAAPAPEFWALPARANFGQLWSFAAAPEMMVAAAAAAAPAMAGEASAARV

SEQ ID NO: 1255 - protein, 285 aa, Oryza sativa subsp. indica
  misc_feature: Public GI ID no.125541129
  misc_feature: Bit score of 347.1 for HMM based on sequences of FIGURE 14.
  misc_feature (60)..(152): Pfam Name: TCP Pfam Description: TCP family transcription factor
  misc_feature: Functional Homolog Of Ceres SEEDLINE ID no. ME18158 at SEQ ID NO. 1151
MDVAGDAGGGRRPNFPLQLLEKKEEQPCSSSAAGGGTGPSSAGGNGNNGSGPGGAGGEMQLRKAAPKRSSTKDRHTKVEGRGRRIRMPALCAARVFQLTRELGHKTDGETIEWLLQQAEPAVIAATGTGTIPANFTSLNISLRSSGSSLSAPAHLRALPSPAADDRFGSRADAWDRVMSSAAAAAAVYRGSVPSGLHFMNFPAPMALLPGQQLGLGPVGGGGGGGGGGEGHMGILAALNAYRTQAATDAAGQQGGGGGGGGSSQQQHGGGGGGGERHQSISTSDS

SEQ ID NO: 1256 - protein, 337 aa, Oryza sativa subsp. indica
  misc_feature: Public GI ID no.125528922
  misc_feature: Bit score of 87.5 for HMM based on sequences of FIGURE 14.
  misc_feature (77)..(163): Pfam Name: TCP Pfam Description: TCP family transcription factor
  misc_feature: Functional Homolog Of Ceres SEEDLINE ID no. ME18158 at SEQ ID NO. 1151
MDPKFPPPPPLNKTEPTTTTTNQQHHHDEQQQQHRLQIQVHPQQQEQQDGGGGGGKDQQQQQQMQVVVAAAAGERRMQGLGPKRSSNKDRHTKVDGRGRRIRMPALCAARIFQLTRELGHKSDGETVQWLLQQAEPAIVAATGTGTIPASALASVAPSLPSPNSALSRSHHHHHHMWAAAPPTASAGFAGAGFSGADSGVIGGIMQRMGIPAGIELQGGGAGGLGGGGGGGGGHIGFAPMFAGHAAAAAAMPGLELGLSQDGHIGVLAAQSLSQFYHQVYNSRELDGLDHRCRVSALFVIAGRCVDIQVSSHYWYINRSCEEMPVKCSVRENLYHLI

SEQ ID NO: 1257 - protein, 506 aa, Oryza sativa subsp. japonica
  misc_feature: Public GI ID no.115487590
  misc_feature: Bit score of 328.5 for HMM based on sequences of FIGURE 14.
  misc_feature (99)..(182): Pfam Name: TCP Pfam Description: TCP family transcription factor
  misc_feature: Functional Homolog Of Ceres SEEDLINE ID no. ME18158 at SEQ ID NO. 1151
MDHGGGGGGGGAAPSSSNIGGGSGGGGGGGGRENHPHHPFYYSGPAAAAAAAAAAQQQQQTFMGALAITPVVAEQPQGSSGGGEKKVVAPTTPAAAGAAATTTLAKRPSKDRHTKVDGRGRRIRMPALCAARVFQLTRELGHKSDGETIEWLLQQAEPAIIAATGTGTIPANFSSLNISIRSGAASASSASNPNRASPFPALALHPHHQQHDVSAMLGYHHHLLPPPQQQQESPQDPGGAGAFMRKRYREDLFKEDDDRQDPSAPKAREQQPTTPQAAAAAAAAAAMWAVAPNTAAPGGAFWMLPVSASSAAAARPTEQPMWSFAGGGGGAATVQAPLQFMSTRVNYPGSAGAGMSDTNLGMLAALNAYNRGGAGDQQPQQQPEMDQQGRNDDDDDDGDDSGDEDNGGANNNNNNSSQHMYNLIMLVSVSDYVHVSDPVAPNKKRAKTRCRLMAMALPEGAQQLPQACAGAEPLAVPVPVLEVAPAQCFSSTLKRLLGARCPPMLF

SEQ ID NO: 1258 - protein, 387 aa, Oryza sativa subsp. japonica
  misc_feature: Public GI ID no.51535021
  misc_feature: Bit score of 723.9 for HMM based on sequences of FIGURE 14.
  misc_feature (48)..(141): Pfam Name: TCP Pfam Description: TCP family transcription factor
  misc_feature: Functional Homolog Of Ceres SEEDLINE ID no. ME18158 at SEQ ID NO. 1151
MDVTGDGGGGGQRPNFPLQLLGKKEEQTCSTSQTAGAGGGGVVGANGSAAAAPPKRTSTKDRHTKVDGRGRRIRMPAICAARVFQLTRELGHKTDGETIEWLLQQAEPAVIAATGTGTIPANFTSLNISLRSSGSSLSIPSHLRLAGLAGPRFGGGARAADAWDRVVGLGFGGAADAPSSATSSSSSPLLLSFHSGSVGLDVSPPSASTSPAAADLSRKRRWEQEMQQQQQYQQQMAGYTQSQIPAGTVWMVPSSNAQAAGGGAPPGGGGESIWTFPQSGSGGGGGAATVYRGVPSGLHFMNFPATPMALLPGGQQLGLAGAGGGGEGHPGILAALNAYRAQAAQPDAGAAAQNGAQGSSQHRQHQHHGGGGGGGDERHESMSASDS

SEQ ID NO: 1259 - protein, 410 aa, Oryza sativa subsp. japonica
  misc_feature: Public GI ID no.115448671
  misc_feature: Bit score of 548.6 for HMM based on sequences of FIGURE 14.
  misc_feature (62)..(154): Pfam Name: TCP Pfam Description: TCP family transcription factor
  misc_feature: Functional Homolog Of Ceres SEEDLINE ID no. ME18158 at SEQ ID NO. 1151
MTMDVAGDAGGGRRPNFPLQLLEKKEEQPCSSSAAGGGTGPSSAGGNGNNGSGPGGAGGEMQLRKAAPKRSSTKDRHTKVEGRGRRIRMPALCAARVFQLTRELGHKTDGETIEWLLQQAEPAVIAATGTGTIPANFTSLNISLRSSGSSLSAPAHLRALPSPAAAARFGSRADAWDRVVSLGFPSEGPASSSSSPSPLLLNFHSGSVGLDVQPSPSAAAAAADLSRKRRWEQEMQQQQQQQQQQQQQQQQQYQQQMAGYTQSQMPGTVWMVPSNSTQGGGPSGGGGGGGGGSGESIWTFPQMSSAAAAAAVYRGSVPSGLHFMNFPAPMALLPGQQLGLGPVGGGGGGGGGGEGHMGILAALNAYRTQAATDAAGQQGGGGGGGGSSQQQHGGGGGGGERHQSISTSDS

SEQ ID NO: 1260 - protein, 379 aa, Oryza sativa subsp. japonica
  misc_feature: Public GI ID no.125596564
  misc_feature: Bit score of 595.3 for HMM based on sequences of FIGURE 14.
  misc_feature (48)..(141): Pfam Name: TCP Pfam Description: TCP family transcription factor
  misc_feature: Functional Homolog Of Ceres SEEDLINE ID no. ME18158 at SEQ ID NO. 1151
MDVTGDGGGGGQRPNFPLQLLGKKEEQTCSTSQTAGAGGGGVVGANGSAAAAPPKRTSTKDRHTKVDGRGRRIRMPAICAARVFQLTRELGHKTDGETIEWLLQQAEPAVIAATGTGTIPANFTSLNISLRSSGSSLSIPSHLRLAGLAGPRFGGGARAADAWDRVVGLGFGGAADAPSSATSSSSSPLLLSFHSGSVGLDVSPPSASTSPAAADLSRKRRWEQEMQQQQQYQQQMAGYTQSQIPAGTVWMVPSSNAQAAGGGAPPGGGGESIWTFPQSGSGGGGGAATVYRGVPSGLHFMNFPATPMALLPGRAAARPRRRRRGWRGAPGDPRRAQCLPRTGRAAGRRRGGAEWSARLKSASSASASRRRRRRRRRAA

SEQ ID NO: 1261 - protein, 337 aa, Oryza sativa subsp. japonica
  misc_feature: Public GI ID no.125573161
  misc_feature: Bit score of 103.2 for HMM based on sequences of FIGURE 14.
  misc_feature (77)..(163): Pfam Name: TCP Pfam Description: TCP family transcription factor
  misc_feature: Functional Homolog Of Ceres SEEDLINE ID no. ME18158 at SEQ ID NO. 1151
MDPKFPPPPPLNKTEPTTTTTNQQHHHDEQQQQHRLQIQVHPQQQEQQDGGGGGGKDQQQQQQMQVVVAAAAGERRMQGLGPKRSSNKDRHTKVDGRGRRIRMPALCAARIFQLTRELGHKSDGETVQWLLQQAEPAIVAATGTGTIPASALASVAPSLPSPNSALSRSHHHHHHMWAAAPPTASAGFAGAGFSGADSGVIGGIMQRMGIPAGIELQGGGAGGLGGGGGGGGGHIGFAPMFASHAAAAAAMPGLELGLSQDGHIGVLAAQSLSQFYHQVYNSRELDGLDHRCRVSALFVIAGRCVDIQVSSHYWYINRSCEEMPVKCSVRENLYHLI

SEQ ID NO: 1262 - protein, 236 aa, Oryza sativa subsp. japonica
  misc_feature: Public GI ID no.48716463
  misc_feature: Bit score of 293.4 for HMM based on sequences of FIGURE 14.
  misc_feature (21)..(120): Pfam Name: TCP Pfam Description: TCP family transcription factor
  misc_feature: Functional Homolog Of Ceres SEEDLINE ID no. ME18158 at SEQ ID NO. 1151
MTTRPDGGGGGGGAPDKQLVPASNANGTALAVRKPPSKDRHSKVDGRGRRIRMPIICAARVFQLTRELGHKSDGQTIEWLLRQAEPSIIAATGTGTTPASFSTSSPSSLRSNSTSNSNDLLLPRAAPFILGKRLRAADDHTTSPAPAPDATAPTQAFWALPARADFGQLWSFAAAPEMMVAAAAAPAMPGEASAARVGNYLPMAQGNLNLLASFSGGPGGAGATAATGRPEEESAR

SEQ ID NO: 1263 - protein, 319 aa, Solanum demissum
  misc_feature: Public GI ID no.113205304
  misc_feature: Bit score of 590.5 for HMM based on sequences of FIGURE 14.
  misc_feature (16)..(106): Pfam Name: TCP Pfam Description: TCP family transcription factor
  misc_feature: Functional Homolog Of Ceres SEEDLINE ID no. ME18158 at SEQ ID NO. 1151
MTTSSSDAPCVDHNQKSKNQDKKQQAKKPTTTKDRHTKVDGRGRRIRMPATCAARVFQLTRELGHKSDGETIEWLLQQAEPAVIAATGTGTIPANYSSLNISLRSSRHHSASNYLAHNNINNFGHVYHDRNYFNGVGLFSSENNSFFPSGNLNMLQAKEELCDDDDNDNDNNNNTGRIKRRSEDKDLQHNNYHMSNMLQSSTYGSIPASHQIGHIPATTLYMMTNNNNNTSHHDPNNCSMWASPSNSNIENSNIRGGLLNFMNFHQPILGTRGGGGGGTAAEGQWGMLTAAMNSYRQSGGHASGSSNQHNGGDDHQHHS

SEQ ID NO: 1264 - protein, 398 aa, Antirrhinum majus subsp. majus
  misc_feature: Public GI ID no.37719051
  misc_feature: Bit score of 796.8 for HMM based on sequences of FIGURE 14.
  misc_feature (64)..(159): Pfam Name: TCP Pfam Description: TCP family transcription factor
  misc_feature: Functional Homolog Of Ceres SEEDLINE ID no. ME18158 at SEQ ID NO. 1151
  misc_feature (323)..(323): Xaa is any aa, unknown, or other
MEGGDDHHHHHHHHNQSRPNFPFQLLEKKTTNNPPSSALAISADIASNPSTTTSTTTLTAASAETSKKPPPKRTSTKDRHTKVDGRGRRIRMPALCAARVFQLTRELGHKSDGETIEWLLQQAEPSVIAATGTGTIPANFTSLNISLRSSGSSMSVPSQLRSSYFNPSNYTMMSQPRRGFSFPGIGLSSSESSSSGTLLNFQQAAANLNPSLMHQAKQEMRENSNNNNNSLESEEENMGRKRRAEQELQQHQHHQIGNYLVQSSTGPMAASHASIPANFWTLANSSNNNNNNNNNNNNQGMGSDPIWTFPSVNINNSAAAAAXLYRGTVSSGLHFMNFPAPVALLPSQQIGGNVLGEGQLGNFMNPYRNIGGGGGASESQASGSHGGDDRHDSTSHHS

SEQ ID NO: 1265 - DNA, 1494 bp, Sorghum bicolor
  misc_feature: Ceres ANNOT ID no.6054246
  misc_feature: Encodes the peptide sequence at SEQ ID NO. 1266
atggacgcgccgtcgagcagcacgagcacgagcaccaacagcagccggagcgcctccgagcagcaccaccagcagcagcagcagaaccgccaccaccaccaccagcagcagcagcaggcggtggcgcaccacccgttctactacgccgcagcagcaaacgcggccgggatggcgccgttcatggggtcgctggccatcgcgcccgccgccgccgggggcggcgcgggggaggtgcagcagctggcgcagcagtcggcggcggcgcctgcagcaggatcgtccggcggcggtggcgctgctgctgccgcggcggacaagaagaacaaggcggccgtggccgtggtgcctgcggcgggggccgggagcggcagcaagcggcccaccaaggaccggcacaccaaggtggagggccgcgggcggcggatacggatgccggcgctgtgcgcggcgcgggtgttccagctcacgcgggagctgggccacaagacggacggcgagaccatcgagtggctgctgcagcaggcggagcccgccatcgtggccgccacggggaccggcaccatcccggccaacttctcctcgctcgccgtctccctccgctccggagcctcgcacccgtcctccgcgtcccgcgccgccgccgccgcggccttccaccacctcccgccggcgcaggcgcagcacgaggtcgccgccatgctcggcgcctggaaccaccatcaccagcagcagcagcagcttctctcaccgcctccgcaccaccaccaccagcaggcgccgcaagatcccggcgctggggagttcatgaggaagcgctacagggatggcgccgacgacctgttcaaggaccccgcggcgcgccagcagcagcagcatcatcccgacgacggcggcggcggcggcgagggggacgccgaggaccacaaggcccgcgtgacgccagccactgcaatgtgggctctggcgcccaacagcgccggtggcggcgccttctggatgcagcccacgtgggcgttcggtggcggcggcggcggcggcgggagcacggtgcaggcgccgctccagttcatgtcaacaagcagaagcggcaacaacttccccgccgggacgaccatggacgccaacatcggcatgctcgccgcgctcaacaacgccagcagcggcggcgtccagcaccagcagccggacgaggggcagcagccgccggagatgccccagcgccaccgcggcgcgaacggcggcgacgccgggcgtggcgccgcgattttcttgtcttttttttttcttttttctttttctttttcttgctatatttttttctttaatttcttttcttttttctttctctttttttattttatattccgtttggttcttttttatcttttctgtgctttatttttattttccttttttgttttatattattctttgttttgtatctttatttctttatcttattcttattatttttctttgatgtttacgtgctga

SEQ ID NO: 1266 - protein, 497 aa, Sorghum bicolor
  misc_feature: Ceres ANNOT ID no.6054246
  misc_feature: Bit score of 218.5 for HMM based on sequences of FIGURE 14.
  misc_feature (125)..(210): Pfam Name: TCP Pfam Description: TCP family transcription factor
  misc_feature: Functional Homolog Of Ceres SEEDLINE ID no. ME18158 at SEQ ID NO. 1151
MDAPSSSTSTSTNSSRSASEQHHQQQQQNRHHHHQQQQQAVAHHPFYYAAAANAAGMAPFMGSLAIAPAAAGGGAGEVQQLAQQSAAAPAAGSSGGGGAAAAAADKKNKAAVAVVPAAGAGSGSKRPTKDRHTKVEGRGRRIRMPALCAARVFQLTRELGHKTDGETIEWLLQQAEPAIVAATGTGTIPANFSSLAVSLRSGASHPSSASRAAAAAAFHHLPPAQAQHEVAAMLGAWNHHHQQQQQLLSPPPHHHHQQAPQDPGAGEFMRKRYRDGADDLFKDPAARQQQQHHPDDGGGGGEGDAEDHKARVTPATAMWALAPNSAGGGAFWMQPTWAFGGGGGGGGSTVQAPLQFMSTSRSGNNFPAGTTMDANIGMLAALNNASSGGVQHQQPDEGQQPPEMPQRHRGANGGDAGRGAAIFLSFFFLFSFSFSCYIFFFNFFSFFFLFFYFIFRLVLFYLFCALFLFSFFVLYYSLFCIFISLSYSYYFSLMFTC

SEQ ID NO: 1267 - DNA, 1197 bp, Sorghum bicolor
  misc_feature: Ceres ANNOT ID no.6086570
  misc_feature: Encodes the peptide sequence at SEQ ID NO. 1268
atggacgtcgccggtgacggcggaggcggccgccgccccaactttcccctgcagctccttgagaagaaagaggagcagccgtgctccagctcggctgcggtgggcacgtcggcgggaggcaacgggaatggatcgggggccggaggagagatgcaggtgcggaaggcggcgcccaagcggagctccaccaaggaccggcacaccaaggtggaaggcagggggcgccgcatccggatgccagcgctgtgtgcggcccgggtgttccagctgacgcgagagctcgggcacaagacggacggcgagaccatcgagtggctgctgcagcaggccgagccggcggtgatcgcggccacaggcaccggtaccatcccggccaacttcacctccctcaacatctccctccgctcctcgggctcctcgttctcggcgccggcccacctccgcgccgccttgcctagccccgccgccgccgcacggttcggccgtgctgacgcgtgggaccgggttgtcggccttggcttcccttcggaaggcccggcctcgtcgtcgtcgtcgccgtcccccttgttgcttaacttccactccggcagcgtcggccttgacgtgcagccgtcgccgtctgccgccaccgcagccgccgatatgtctaggaagaggcggtgggaacaagaaatgcagcaacagcagcagcaacaacaacagcagcaggcgcagcaatatcagcagcagatggcggggtacacgcagagccaaatgccgggcaccgtgtggatggtgccgagcaacaacacgcagggcggtggtgcaccttccagcggtggcagtggcggaggcagcggcgagtctatctggacgttcccgcagatgggcagcgccgccgccgcggctgccgtgtaccggggcagcgtgccgagcgggctacatttcatgaacttccctgcaccggtggcgctgcttccagggcagcaactggggctcggccccaccgtgggaggcagcggcggcggaggaggcggcgccgaggggcacatggggatcctcgccgccctcaatgcgtaccggacacaggcggcaacggatcccgcggccagccagggcggaggaggaggtgcaggaggcgggtctggccagcagcagcagcagcacggtggcggccgcggcgaccggcatgagagcatgagcaccagcgactcgtag

SEQ ID NO: 1268 - protein, 398 aa, Sorghum bicolor
  misc_feature: Ceres ANNOT ID no.6086570
  misc_feature: Bit score of 569.0 for HMM based on sequences of FIGURE 14.
  misc_feature (52)..(154): Pfam Name: TCP Pfam Description: TCP family transcription factor
  misc_feature: Functional Homolog Of Ceres SEEDLINE ID no. ME18158 at SEQ ID NO. 1151
MDVAGDGGGGRRPNFPLQLLEKKEEQPCSSSAAVGTSAGGNGNGSGAGGEMQVRKAAPKRSSTKDRHTKVEGRGRRIRMPALCAARVFQLTRELGHKTDGETIEWLLQQAEPAVIAATGTGTIPANFTSLNISLRSSGSSFSAPAHLRAALPSPAAAARFGRADAWDRVVGLGFPSEGPASSSSSPSPLLLNFHSGSVGLDVQPSPSAATAAADMSRKRRWEQEMQQQQQQQQQQQAQQYQQQMAGYTQSQMPGTVWMVPSNNTQGGGAPSSGGSGGGSGESIWTFPQMGSAAAAAAVYRGSVPSGLHFMNFPAPVALLPGQQLGLGPTVGGSGGGGGGAEGHMGILAALNAYRTQAATDPAASQGGGGGAGGGSGQQQQQHGGGRGDRHESMSTSDS

SEQ ID NO: 1269 - DNA, 1185 bp, Sorghum bicolor
  misc_feature: Ceres ANNOT ID no.6024957
  misc_feature: Encodes the peptide sequence at SEQ ID NO. 1270
atggacgtcaccggagatgccagcggaggtcgccgccccaacttccctttgcagcttctggagaagaagaaggaggaacagccttgctccacgtccccagcagctgttgtgggtgctggggctaatgggtcggcggggtcgggagagatgctgcagatgaagaaggtggcgccgccaaagcgcacatcgaccaaggaccggcacacgaaggtggacgggcgcgggcggcgcatccggatgccggcgatttgcgcagctcgggtgttccagctgacgagggagttggggcacaagacggacggcgagacgatcgagtggctgctgcagcaggcggagcccgcggtgatcgcggccacgggcaccggcaccatcccggccaacttcacctcgctcaacatctctctccgctcctcgggctcttccttctccatcccagcgcacctccgtgctgccggcttgcccggcccacgcttcggcggcgcgcggggagacccgtgggagcgcgtcgtaggcctcgggttcggcggcgccgagggtcctccatccgctacgtcgtcggcgtcgtctccgctgctgctgagcttccactccggcagcgtcggtcttgacgtgtcaccatcgtcgtcgtctgctgccgccagctccgacctgtccaagaaacggcggtgggagcaagaaatgcagcagcagcagcagcaataccagcagcagatggccgggtacacgcagagccaaatgccaggcaccgtgtggatggtgccgagcagcaacgcccaggccgccgcagttgctggcggaggcggcagcaacgagtcgatctggacgttcccgcagacaggaagcggcggcggcggcgcggcgaccgtgtaccgcggcgtgcctagtgggctacatttcatgaacttccccgcgccgatggcgctgctccccggtgcgcagcagcagctcgggctcggcggccccgtgggcggcaacgaaaatggcagcgccagcggcggcggaggcggagccgagggccacatggggatcctcgccgcgctcaacgcgtaccgggcacatgctgtctcggacgctacgccggcggcgcagaacggtgcaggaggaggcggctctagtcagcatcagcagcatggccatggcggcggcgagcgacaggagagcatgagccccagcgacgactcgtag

SEQ ID NO: 1270 - protein, 394 aa, Sorghum bicolor
  misc_feature: Ceres ANNOT ID no.6024957
  misc_feature: Bit score of 578.8 for HMM based on sequences of FIGURE 14.
  misc_feature (48)..(140): Pfam Name: TCP Pfam Description: TCP family transcription factor
  misc_feature: Functional Homolog Of Ceres SEEDLINE ID no. ME18158 at SEQ ID NO. 1151
MDVTGDASGGRRPNFPLQLLEKKKEEQPCSTSPAAVVGAGANGSAGSGEMLQMKKVAPPKRTSTKDRHTKVDGRGRRIRMPAICAARVFQLTRELGHKTDGETIEWLLQQAEPAVIAATGTGTIPANFTSLNISLRSSGSSFSIPAHLRAAGLPGPRFGGARGDPWERVVGLGFGGAEGPPSATSSASSPLLLSFHSGSVGLDVSPSSSSAAASSDLSKKRRWEQEMQQQQQQYQQQMAGYTQSQMPGTVWMVPSSNAQAAAVAGGGGSNESIWTFPQTGSGGGGAATVYRGVPSGLHFMNFPAPMALLPGAQQQLGLGGPVGGNENGSASGGGGGAEGHMGILAALNAYRAHAVSDATPAAQNGAGGGGSSQHQQHGHGGGERQESMSPSDDS

SEQ ID NO: 1271 - DNA, 978 bp, Sorghum bicolor
  misc_feature: Ceres ANNOT ID no.6016867
  misc_feature: Encodes the peptide sequence at SEQ ID NO. 1272
atggaccccaagttccccacacccccaccgctaaacaaaacggagcccaccaccgcgacgaccaccaccacctcgaccgcgcagcagcagcagcagcagctggatcctaaggactaccagcagccggcgcagcagcaccacctgcaaatccaaatccaccagccgccgccgcagcagcagcagcagcaggacggaggcaaggagcagcagctgcaggtggtggcgcagcccggggagcggaggcagcaggcgctcgcgcccaagcggagctccaacaaggaccgccacaccaaggtcgacggcaggggccgccggatccggatgcccgcgctgtgcgccgcgcggatcttccagctcacgcgggaactcggccacaagtccgacggcgagaccgtgcagtggctgctgcagcaggccgagccggccatcgtcgccgccaccggcaccggcaccataccggcgtccgcgctcgcatccgtcgcgccctcgctcccgtcgcccacctccgggctcgccaggccgcaccaccaccaccacccgcaccacatgtgggcgccgtccgccgcgtccgcgggtttctcctcgccctccttcctcaattccgccgccgcgggcacgggagacgccgctggtatcggcggactcatgcagcggatggggatccccgcgggtctcgagctgccgggaggcggcgccgctggaggcaccctcggcgctggcggccacatcggctttgcgcccatgttcgctggacacgccgcggccatgccggggctcgagctcggcctctcgcaggacggccacatcggcgtgctcgcagcgcagtcgatcagccagttctaccaccaagtgggtgctgctggcggcagcggccagatgcagcacccgcacggccaccagcatcaccatcatcagcagcaggaggacggggaggacgaccgcgaggacggcgagtccgatgacgagtctgggcagtag

SEQ ID NO: 1272 - protein, 325 aa, Sorghum bicolor
  misc_feature: Ceres ANNOT ID no.6016867
  misc_feature: Bit score of 127.9 for HMM based on sequences of FIGURE 14.
  misc_feature (76)..(167): Pfam Name: TCP Pfam Description: TCP family transcription factor
  misc_feature: Functional Homolog Of Ceres SEEDLINE ID no. ME18158 at SEQ ID NO. 1151
MDPKFPTPPPLNKTEPTTATTTTTSTAQQQQQQLDPKDYQQPAQQHHLQIQIHQPPPQQQQQQDGGKEQQLQVVAQPGERRQQALAPKRSSNKDRHTKVDGRGRRIRMPALCAARIFQLTRELGHKSDGETVQWLLQQAEPAIVAATGTGTIPASALASVAPSLPSPTSGLARPHHHHHPHHMWAPSAASAGFSSPSFLNSAAAGTGDAAGIGGLMQRMGIPAGLELPGGGAAGGTLGAGGHIGFAPMFAGHAAAMPGLELGLSQDGHIGVLAAQSISQFYHQVGAAGGSGQMQHPHGHQHHHHQQQEDGEDDREDGESDDESGQ

SEQ ID NO: 1273 - DNA, 732 bp, Sorghum bicolor
  misc_feature: Ceres ANNOT ID no.6091369
  misc_feature: Encodes the peptide sequence at SEQ ID NO. 1274
atgacgacgaggccagacggcagcggcagcgccgcgcccgcagacaagcagctcgtgccggtctccaacggcaacggcaactccggcgcgctggccgtccgcaaggcgccctccaaggaccgtcacagcaaggtggacggccgtgggcgccgcatccgcatgcccatcatctgcgcggcccgcgtgttccagctcacgcgggagctcggccacaagtccgacggccagaccatagagtggctgctccgccaggccgagccctccatcatcgccgccaccggcaccggcaccacgccggcgtccttctccacctcctccccgtcctcgctccgctccacctcctccaccagcccgcacccgctgtccgcctcccccaccgccggcctcccgcacgccgccgcgcccttcatcctcggcaagcgcgtccgcggggacggcgccgacgccgagcccaccgtcgctgccccggccccggggttctgggcgctgccggcgcgggccgacttcggccagctctggagcttcgcggccgcgccggagatgatggtagccgcggccgccgccgccgccgccgcaccagccatggccggggaggcgtccgccgccagggtcggcaactacctccccgttgcgcagggcaacctcaacctgctcgcctccttctctggcgggcccgctcccacagcagctgccgccaccgccggccgggccgaggaggagaccgcccgctga

SEQ ID NO: 1274 - protein, 243 aa, Sorghum bicolor
  misc_feature: Ceres ANNOT ID no.6091369
  misc_feature: Bit score of 322.5 for HMM based on sequences of FIGURE 14.
  misc_feature (22)..(120): Pfam Name: TCP Pfam Description: TCP family transcription factor
  misc_feature: Functional Homolog Of Ceres SEEDLINE ID no. ME18158 at SEQ ID NO. 1151
MTTRPDGSGSAAPADKQLVPVSNGNGNSGALAVRKAPSKDRHSKVDGRGRRIRMPIICAARVFQLTRELGHKSDGQTIEWLLRQAEPSIIAATGTGTTPASFSTSSPSSLRSTSSTSPHPLSASPTAGLPHAAAPFILGKRVRGDGADAEPTVAAPAPGFWALPARADFGQLWSFAAAPEMMVAAAAAAAAAPAMAGEASAARVGNYLPVAQGNLNLLASFSGGPAPTAAAATAGRAEEETAR

SEQ ID NO: 1275 - DNA, 1200 bp, Arabidopsis thaliana
  misc_feature: Ceres SEEDLINE ID no.ME18314
  misc_feature: Inplanta Sequence
  misc_feature: Encodes the peptide sequence at SEQ ID NO. 1277
atggccgtaattatccctcgttcagatccaccgtcacgaatccatccggaaccaccacaaaccctagaaatcgaccatttcgatcatcttcctgactcaatcctcctcctcgttttcaacaaaatcggcgacgtcaaagctctcggaagatgctgcgtcgtttccagaagattccattctctcgttcctcaagtcgataacgtcgttgttcgtgtcgattgcgtaatctccgacgacgattcgtcatctttgtcatctatcaaatctcgctccggttcttccgctggttcgttctcggctatatttcgtcttgttgttggtggcattgttaagccgttacaagctttaggtcaattccttggtacgaagagatcatcatcatcatgtggtggttctggatcttcttcttcttcgttgtctattagtggagatgatgatggtggagagatcgaacaaggcggtgttacgcatcattcacctactcaggttttgaaaaacttcgatgagattcgttacttaagaattgagcttcctagtggtgaattagggattgatgatggagttttgttgaaatggagagctgaatttggttctactcttgataattgtgtgattctcggtgcttcttcagtgattccaccaaatccaatgagagtttctcaagcttgtgatactactacagtcgttgaagctcccggttctggctccgatgataatgggagtataccggaatcgttttacacaaacggaggtttgaaattgcgtgttgtatggacgattagctctttgattgctgcatcagcacgacattacttgttacaaccgataatcgcggagcataagacgcttgatagtttagtgctcactgattcagatgggcaaggtgtgctctgtatgaacagagatcagctagaagagcttagggtgaaaccattagcagcttcatcggcttcgaagaggacacttgtgcctgctctgaatatgagactatggtatgctccaaccttggaattgcctgatggaactgtgttaaaaggtgcgactttggttgcgataagaccgagtgaatcgaaaaaggaagtgtctgatatctcttgggtgtcttcggcttttgaggagccttatgagacggctgctaagatgctggttaaaagaaggacttactgtcttgaaatgaactcgttctagcttgaatggttt

SEQ ID NO: 1276 - DNA, 1980 bp, Arabidopsis thaliana
  misc_feature: Ceres SEEDLINE ID no.ME18314
  misc_feature: Genomic Sequence
  misc_feature: Expected Sequence
  misc_feature: Encodes the peptide sequence at SEQ ID NO. 1277
gatttcttcctctcttctctctagaaacatctttcatgcgttatcttctccaaaagctctgattctgattctgaatcatcctgaaaaaaacctagaaaaattctatcccacaaaatcttcaaagatccatggccgtaattatccctcgttcagatccaccgtcacgaatccatccggaaccaccacaaaccctagaaatcgaccatttcgatcatcttcctgactcaatcctcctcctcgttttcaacaaaatcggcgacgtcaaagctctcggaagatgctgcgtcgtttccagaagattccattctctcgttcctcaagtcgataacgtcgttgttcgtgtcgattgcgtaatctccgacgacgattcgtcatctttgtcatctatcaaatctcgctccggttcttccgctggttcgttctcggctatatttcgtcttgttgttggtggcattgttaagccgttacaagctttaggtcaattccttggtacgaagagatcatcatcatcatgtggtggttctggatcttcttcttcttcgttgtctattagtggagatgatgatggtggagagatcgaacaaggcggtgttacgcatcattcacctactcaggttttgaaaaacttcgatgagattcgttacttaagaattgagcttcctagtggtgaattagggattgatgatggagttttgttgaaatggagagctgaatttggttctactcttgataattgtgtgattctcggtgcttcttcagtgattccaccaaatccaatgagagtttctcaagcttgtgatactactacagtcgttgaagctcccggttctggctccgatgataatgggagtataccggaatcgttttacacaaacggaggtttgaaattgcgtgttgtatggacgattagctctttgattgctgcatcagcacgacattacttgttacaaccgataatcgcggagcataagacgcttgatagtttagtgctcactgattcagatgggcaaggtgtgctctgtatgaacagagatcagctagaagagcttagggtgaaaccattagcagcttcatcggcttcgaagaggacacttgtgcctgctctgaatatgagactatggtatgctccaaccttggaattgcctgatggaactgtgttaaaaggtgcgactttggttgcgataagaccgagtgaatcgaaaaaggaagtgtctgatatctcttgggtgtcttcggcttttgaggagccttatgagacggctgctaagatgctggttaaaagaaggacttactgtcttgaaatgaactcgttctagcttgaatggtttcagtcggaatctgaggtaagatagtgctcatgttctgcatcatgtgtttatgaagtgagtttagaatatcatttgcccaagcaccgattttgcttgacctgaaaccattaagatttaatccctttgcataggtaaagcttatagtttatcatcagcagtaggaactgtcttatgaatatcttataagtaacactatcccttaatgctttgcatttgaagataagttagcattttttatcattgtcttcacaactttcttttgatattttagaaagcacagaactttctcattgttatgaatcttgtttgtcagagaactggcaaccctgtggcgaattcaggaaattacaattaaaagcatataatggggagaagcagagaatgaaataaaatcgaagttttgatgaatcaagaaacaagttttgctgcctactactactgcatctgctagctagttttttcattgaagcatatgcctttgcaggatctcgcaatcatatataatatatatcaacaaattacagatatcatgtaagagtttttcttttcttttttctgtctttttcttctcctttgcttgctcttctctatttatgtgaatattgtaggtattgcttattcccctgtcattatacaagttatttaagattgt

SEQ ID NO: 1277 - protein, 395 aa, Arabidopsis thaliana
  misc_feature: Ceres SEEDLINE ID no.ME18314
  misc_feature: Bit score of 978.6 for HMM based on sequences of FIGURE 15.
  misc_feature (25)..(73): Pfam Name: F-box Pfam Description: F-box domain
MAVIIPRSDPPSRIHPEPPQTLEIDHFDHLPDSILLLVFNKIGDVKALGRCCVVSRRFHSLVPQVDNVVVRVDCVISDDDSSSLSSIKSRSGSSAGSFSAIFRLVVGGIVKPLQALGQFLGTKRSSSSCGGSGSSSSSLSISGDDDGGEIEQGGVTHHSPTQVLKNFDEIRYLRIELPSGELGIDDGVLLKWRAEFGSTLDNCVILGASSVIPPNPMRVSQACDTTTVVEAPGSGSDDNGSIPESFYTNGGLKLRVVWTISSLIAASARHYLLQPIIAEHKTLDSLVLTDSDGQGVLCMNRDQLEELRVKPLAASSASKRTLVPALNMRLWYAPTLELPDGTVLKGATLVAIRPSESKKEVSDISWVSSAFEEPYETAAKMLVKRRTYCLEMNSF

SEQ ID NO: 1278 - DNA, 1743 bp, Gossypium hirsutum
  misc_feature: Ceres CLONE ID no.1926352
  misc_feature: Encodes the peptide sequence at SEQ ID NO. 1279
aattaaccatttctctccgctctcaaacccactttttttctctttgtaattccgtagaacggatacttcaaccgaaaaaaacaaaaaaaaaaaacaaaccagatgtcttcggtttattcagatccgatccatggaacccacccggaaccaatcgatcacttcgaccgtcttcccgattctcttctccttttagtcttcaacatgatcggcgacgtgaaagtgcttggccgatgctgcgttgtttcgcgtcgtttccactccctcgtccctcaagttgaaaacgtcgtcgttcgtgtcgattgcgtcatctccgacgacgattgttccccttcttcctctgtcaaatcacgtgccgacggtccattttccaccctcttccgtctcgttttcggtggcattgtcaagcccctccaagctttgggccaattccttggccccgaacgcccctctctctacaaaacgctcaatacctcttcatcttcctctttatctgtcggtctcggcggaggtgaagatggggaaagggaccaaggtggggttacccatcattctccgacgcaagtgcttagaaatttcaacgagcttcgtttccttcgaattgaattgcccggcggcgagttagggatcgatgacggagttctgcttaaatggagagccgatttcgggtcaacccttgatagctgcgtaatcctcggagctgcttccgtttttaacaatgtgcatttccaagtaccagaccatgggaacgatgggttttgcatcaacaacggttctaatgttggcaacggtgatgataatgggagtatccctgagtcgttttataccagtggaggcttgaaattaagggttgtttggactattagctcgttaatcgcagcatcagcaaggcattatttgcttcaatccataattgcagagcataagacgctggatagcttggttttgaccgatgcggatggacaaggggtgctttgtatgaacggtgagcagcttcaggagttaagagtgaaaccattatcagcttcttctgcttcaaaaaggacgctggtgccggctttgaatatgaggctttggtatgctcctcatttggacttgcctgatggggttgttttacaaggtgccactttggttgctatcaggcctagtgaacaatctgcttcgaaaaaagaggtttcggatgcttcttggctatcatctgcttttgaagagccttatgggactgcagctaagatgctggttaagagaaggacttactgtctggagatgaactcgttctgatgtctgcttcctgttctgtaaagggaaagctgtaccatggtcaaggagatagaggtgatagcttgcttttggaaagctgataatcagaccacaattttgttacgtgttgttgctgattctcaggacaatatcgtttgaaagctaaaacttgctttggatcaccagtgagggcagcccatgcttgttgataattcactgctagtgtttgagcttttgtgcttcaactgattaccgaaatgcatctgctggttgttttttatttcaggcatatgcatttaagagtgcacacctgcaactaggatgatgttgtaagagctttgagtttgtagtctttttttaattctataatccctctatatgtgaatattgtaggtatgaagatctcatgttttatgttatatacatgtgaattttatcaataaaatgtagtctgcacttagcttttaaaaaaaaaaaaaaaaaaaa

SEQ ID NO: 1279 - protein, 391 aa, Gossypium hirsutum
  misc_feature: Ceres CLONE ID no.1926352
  misc_feature: Bit score of 967.1 for HMM based on sequences of FIGURE 15.
  misc_feature (18)..(66): Pfam Name: F-box Pfam Description: F-box domain
  misc_feature: Functional Homolog Of Ceres SEEDLINE ID no. ME18314 at SEQ ID NO. 1277
MSSVYSDPIHGTHPEPIDHFDRLPDSLLLLVFNMIGDVKVLGRCCVVSRRFHSLVPQVENVVVRVDCVISDDDCSPSSSVKSRADGPFSTLFRLVFGGIVKPLQALGQFLGPERPSLYKTLNTSSSSSLSVGLGGGEDGERDQGGVTHHSPTQVLRNFNELRFLRIELPGGELGIDDGVLLKWRADFGSTLDSCVILGAASVFNNVHFQVPDHGNDGFCINNGSNVGNGDDNGSIPESFYTSGGLKLRVVWTISSLIAASARHYLLQSIIAEHKTLDSLVLTDADGQGVLCMNGEQLQELRVKPLSASSASKRTLVPALNMRLWYAPHLDLPDGVVLQGATLVAIRPSEQSASKKEVSDASWLSSAFEEPYGTAAKMLVKRRTYCLEMNSF

SEQ ID NO: 1280 - DNA, 1812 bp, Gossypium hirsutum
  misc_feature: Ceres CLONE ID no.1848576
  misc_feature: Encodes the peptide sequence at SEQ ID NO. 1281
accttgaagaactagtttttctctccttagatctatatatcacaagtgatcactttcctctcgtttcctctcctaatcaaataacttacgaattcacagataagagagaagaaagggaaaagaaaatgtcttcacttcgttcagatccggttcacagaattcatcctgagccgatcgatcacttcgaccgtcttcccgattctcttctccctttagtcttcaacaagatcggtgacgttaaagctctcggccgatgctgtgtcgtttcgcgtcgtttccgttccctcgttcctcaagtcgaaaacgtcgtcgttcgtgtcgattgtgttatctctgacgacgattgttccccttcttcgtcttcctacgataagtcacgcgccgccggtccgatttctaacctcttacgtatccttcttggaggcattgtcaaaccatttcaagctttggttcagtttcttggtccaaaacggcccgttatcaatgaaacccttaacacccaccctgtctcttcctctttatcagtcggtcccggtgccgatgttaatgatggggaaatggagcaaggtggggtgacccatcattcaccgacgcaagtacttagaaatttcaacgagattcgtttcctccggatcgaattacccagcggtgagttagggatcgatgatggggttcttttgaaatggagagccgattttgggtcaactcttgataattgcgtcatcctcggagctgcttctgttactaagaacgtaaatttgcaagtagcggagtgtgggaatgatgggttttgccccaataataacatcgccaacggtttaaatgtcggtaacggcgatgacaatgggagtattcccgagtcgttttataccaacggagggttgaaattaagggttgtttggacgattagctcgttgatcgcagcatcagcgaggcattatttacttcaaccgataatcgcagagcataagacgctagatagcttggttctaaccgattcggatggtcaaggggtgctttgtatgaatagagatcagcttgaggagttaagagtgaagccattatctgcttcttctgcatcgaaaaggacattggtgccggcactgaatatgaggctttggtatgcccctcagttggaattgcctgatggggttgttttaaaaggtgctactttggttgctattaggccaagtgaacaatctgcttcaaagaaagaggtctctgatgcttcttggttatcaactgcttttgaagagccttatggaactgcagctaagatgcttgttaaaaggaggacttactgtttggagatgaactcgttttgatctctgcttcctgatctttgaagggagagcagtcgagcacaatggtctagggggaagaaggcatagcatacttttggaaagctgacgatcaaacaacaattttgttacgtgttgtagctttttaatgcaagagcagtgtcctgtgaaagctaaaaccttgcttatgaatgccattgaaagcaatcgatgcatgttgagaatgcagtgcaagtgtttcagcttttgttcttcaactgatagccaaaatgaatgcatctgctggttgtttttatgtcaggcatatgcttgtaagagtgcacacctgcaactagatctcatgctgtgtaagagcgccgagtttttcagtccttttacttcttttttaatctataatcctctatatgtgaatattgtaggtatgaagatgtcatgctttatgttctatacttatgaagttaatgaagaattgtagtttgcagtttgcacccaaaaaaaaaaaaaaaaaaaa

SEQ ID NO: 1281 - protein, 399 aa, Gossypium hirsutum
  misc_feature: Ceres CLONE ID no.1848576
  misc_feature: Bit score of 912.0 for HMM based on sequences of FIGURE 15.
  misc_feature (18)..(66): Pfam Name: F-box Pfam Description: F-box domain
  misc_feature: Functional Homolog Of Ceres SEEDLINE ID no. ME18314 at SEQ ID NO. 1277
MSSLRSDPVHRIHPEPIDHFDRLPDSLLPLVFNKIGDVKALGRCCVVSRRFRSLVPQVENVVVRVDCVISDDDCSPSSSSYDKSRAAGPISNLLRILLGGIVKPFQALVQFLGPKRPVINETLNTHPVSSSLSVGPGADVNDGEMEQGGVTHHSPTQVLRNFNEIRFLRIELPSGELGIDDGVLLKWRADFGSTLDNCVILGAASVTKNVNLQVAECGNDGFCPNNNIANGLNVGNGDDNGSIPESFYTNGGLKLRVVWTISSLIAASARHYLLQPIIAEHKTLDSLVLTDSDGQGVLCMNRDQLEELRVKPLSASSASKRTLVPALNMRLWYAPQLELPDGVVLKGATLVAIRPSEQSASKKEVSDASWLSTAFEEPYGTAAKMLVKRRTYCLEMNSF

SEQ ID NO: 1282 - DNA, 1872 bp, Gossypium hirsutum
  misc_feature: Ceres CLONE ID no.1981528
  misc_feature: Encodes the peptide sequence at SEQ ID NO. 1283
gtgtgtgttcttttttccggtcccgttcgcacctttcttctctttctgtaacgcgaatcctctcttcctctctctctgtgaaaaagacaaaaaccttgcaagtatctcatccttccatttccatcctactccgccctatctcccttcccttcccttaaaaacgataggtttaccctcagcccacccccagatctaaccccttttctcctcccaaccagataatcccatttagagaaacgaaaaatgtgtccggttcgttcagatcccatccacagattccatcccctgccactcgatcacttcgaccgtcttcccgactctctccttcttttaatcttcaacaagatcggcgacgttaaagctctcggccgatgctgtcttgtctcccgtcgtttccattccctcgtccctcaagttgaaaacgttctcgttcgtgtcgattgtgtcatctccgacgacgattcttccccttcttcctcatcctccgacaagtcatgtcccgccggtcccttctccaacctcttgcgtctcgtcttcggaggcattgttaaaccccttcaagctttgggtcaattcctcggccctaaacgctcccttctcgatgaaacgcttagcgccccttccacttcctcatccgtcggtcgcgccgctgatgatgatgatcccgaaatgggccaaactggtgtcacccaccattcccctactcaagtgcttagaaatttcaacgagattcgtttcctccgaatcgaattacccagcggcgagttagggattgacgatggagttctgttgaaatggagagcagatttcggatcaacccttgataactgcatcatccttggagctgcctccgttattaatgacgtgcattcgcaagtaccggagtatggcaacgatgggttttgcagcaacaattgcattaccggcaacggtgatgataatgggagtattccagagtcgttttataccaatggaggcttgaaattaagggttgtttggacgattagttcgttaatcgcagcatcagcaaggcattacttacttcaaccgataattgcggagcataggacgctggataccttggttttaaccgatgcggatggacaaggggtgcttcgtatgaacagggaacagcttgaggagttgagagtcaagccattatcggcttcttcagcttcaaaaaggacgcaggtgccggcattgaatatgaggctttggtatgcccctcatttggaattgcctaacggggttgtattaaaaggtgctactttagttgcaattaggcccagtgagcaatctgcttctagaaaagaggtctccgatgcttcttggttatcaactgctttcgaagagccttatgggactgctgcgaagatgctgattaagagaagaacgtattgtttggagatgaactccttttgataccctgcaacgggagagcagtcaagcacaatggtcaaggggaagaagatagcatgctttttgaaagctgatgaccaaacaacaattttgttacatgttgtagcttaatctcggtgctgtgtcctatggaagcaaaaccttgcttgggatcgccagtgaaagcaatccatgaatgttgataatgcactgcaagcgtttcggcttttgtgcttcaactgatagcctaatgcacttgctgcttgtttttatttccggcatatgcttgtaagagtgcacacctgtgatcagattgatgttgtaagagctttgaatttgtagccctttaactctgatccctcttttatgtgtatattgtaggtatgaagatgtgatgctttatgttatatacttgtgaagttcataaagaaatgttgtttgcaacttagcttttaaaaaaaaaaaaaaaaaaaa

SEQ ID NO: 1283 - protein, 392 aa, Gossypium hirsutum
  misc_feature: Ceres CLONE ID no.1981528
  misc_feature: Bit score of 899.3 for HMM based on sequences of FIGURE 15.
  misc_feature (18)..(66): Pfam Name: F-box Pfam Description: F-box domain
  misc_feature: Functional Homolog Of Ceres SEEDLINE ID no. ME18314 at SEQ ID NO. 1277
MCPVRSDPIHRFHPLPLDHFDRLPDSLLLLIFNKIGDVKALGRCCLVSRRFHSLVPQVENVLVRVDCVISDDDSSPSSSSSDKSCPAGPFSNLLRLVFGGIVKPLQALGQFLGPKRSLLDETLSAPSTSSSVGRAADDDDPEMGQTGVTHHSPTQVLRNFNEIRFLRIELPSGELGIDDGVLLKWRADFGSTLDNCIILGAASVINDVHSQVPEYGNDGFCSNNCITGNGDDNGSIPESFYTNGGLKLRVVWTISSLIAASARHYLLQPIIAEHRTLDTLVLTDADGQGVLRMNREQLEELRVKPLSASSASKRTQVPALNMRLWYAPHLELPNGVVLKGATLVAIRPSEQSASRKEVSDASWLSTAFEEPYGTAAKMLIKRRTYCLEMNSF

SEQ ID NO: 1284 - DNA, 1197 bp, Populus balsamifera subsp. trichocarpa
  misc_feature: Ceres ANNOT ID no.1448905
  misc_feature: Encodes the peptide sequence at SEQ ID NO. 1285
atgagctctcttcgagcagatccgccgacctccaaaattcacccagaagcagaagcagaagcaactactagttgtttttgttcttcttcaaaaatcgaccatttcgaccgccttcctgactctcttctgttattcgttttcaacaaaatcggcgatgtcaaagctcttggtcgttgctgtgttgtttctcgccgcttccactctctcgtccctcaggtcgataacgttgttgtccgtgtagactgtgtcatctccgatgacgacacctcctcttcttcctcctccatcaagtcacactcttcttcttcttctggcttctcctccatctttcgtttagtcttcggtggcatttccaaacccttccaagctctgagtcagatgtttggaaccaaggtcaattcgcgaaatggaaatgggccttccctttctgtcgccgccgatgatgatatggagctggatcaagctggtgtcacccatcattctccaactcaggttcttaagaattttaatgagattcgctttctaagaatcgagttacccagtggggaattgggaattgatgatggggttcttttaaaatggagggctgatttcggatctacccttgataattgtgttattcttggtgctgcttctgtcattaccaataataagatttcttctgctatgcaacaagaaaatgctgctgctgctgctgctgccgatgatgatgataatggaagcataccggagtcattttacaccaatgggggattgaagttgagagttgtgtggactattagctctttaattgctgcatctgccaggcattatttgcttcaaccaattattgctgagcataagactcttgatagtttggtcttggctgatgctgatgggcagggagtgttgtgtatgaatagggagcaattggaagagttgagggtcaagccgttatcggcttcttctgcttccaagaggactcttgtgcctgcacttaatatgcgcctttggtatgctcctcacttggaattgcctgatggggttgtgttgaaaggtgcaacattggttgctattaggcctagtgaacaggctgctactaagaaggatgtgtctgatgtctcctgggtctctaccacgtttgaggagccttatggtacagcagctaagatgctggtgaagagaaggacttactgcttggagatgaactcattctga

SEQ ID NO: 1285 - protein, 398 aa, Populus balsamifera subsp. trichocarpa
  misc_feature: Ceres ANNOT ID no.1448905
  misc_feature: Bit score of 994.3 for HMM based on sequences of FIGURE 15.
  misc_feature (33)..(81): Pfam Name: F-box Pfam Description: F-box domain
  misc_feature: Functional Homolog Of Ceres SEEDLINE ID no. ME18314 at SEQ ID NO. 1277
MSSLRADPPTSKIHPEAEAEATTSCFCSSSKIDHFDRLPDSLLLFVFNKIGDVKALGRCCVVSRRFHSLVPQVDNVVVRVDCVISDDDTSSSSSSIKSHSSSSSGFSSIFRLVFGGISKPFQALSQMFGTKVNSRNGNGPSLSVAADDDMELDQAGVTHHSPTQVLKNFNEIRFLRIELPSGELGIDDGVLLKWRADFGSTLDNCVILGAASVITNNKISSAMQQENAAAAAAADDDDNGSIPESFYTNGGLKLRVVWTISSLIAASARHYLLQPIIAEHKTLDSLVLADADGQGVLCMNREQLEELRVKPLSASSASKRTLVPALNMRLWYAPHLELPDGVVLKGATLVAIRPSEQAATKKDVSDVSWVSTTFEEPYGTAAKMLVKRRTYCLEMNSF

SEQ ID NO: 1286 - DNA, 1218 bp, Populus balsamifera subsp. trichocarpa
  misc_feature: Ceres ANNOT ID no.1465978
  misc_feature: Encodes the peptide sequence at SEQ ID NO. 1287
atgagctcccttcgtccagatccgacctccagaattcaccctgagcctgaaccaactactactacttcctctccttcaatcgaccatttcgaccgccttcctgactctcttctcttactcgttttcaacaaaatcggcgatgtcaaagctctcggtcgctgctgtgttgtttgtctccgcttccactctcttgtccctcaagtcgacaacgttgttgtccgtgtcgactgtgtcatctccgatgatgacacctcctcctcctcctcctccacaaagtcacactctccctcctcttcttctggattctcctccatctttcgattagtcttcggtggcattgtcaaacccttccaagttctgggtcagctgcttgggcccaaggttaattcgcgaaatgggtttctcaattcttcgctctctgtcggcaccaccacgagcaccgacgatgatacggaaccggatcaaggtggtgtcacccatcattctccaactcaggttcttaagaattttaatgagattcggtttctgcgaatcgagttacccagtggggaattggggattgatgatggggttcttttaaaatggagggctgatttcggatctacacttgataattgtgttatccttggtgctgcttctgtctttaccaataataagaattcttttgttatgcaagaaaatgatgctatatgcaacagtactgctgctattaataataataatggtgttgatgataatggaagcataccagagtcgttttacaccaatgggggattgaagttgagagtggtgtggactattagctctttaattgctgcatctgctaggcattatttgcttcaaccaattattgctgagcataagactcttgatagtttggtattgactgacgctgacgggcagggagtcttgcgtatgaacagggagcaactggaggagttgagggtgaagccattatcggcttcttctgcttcgaagaggactcttgtgcctgcattgaatatgcggctttggtatgctcctcacttggaattgcctgatggggttgtgctgaaaggggctactttggttgctattaggcctagtgaccaggctgctactaaaaaggatgtgtctgatatctcatgcctgtccactgcatttgaggagccttatggtaccgcagctaagatgctggtgaagaggaggacttactgcttggagatgaactcattctga

SEQ ID NO: 1287 - protein, 405 aa, Populus balsamifera subsp. trichocarpa
  misc_feature: Ceres ANNOT ID no.1465978
  misc_feature: Bit score of 918.8 for HMM based on sequences of FIGURE 15.
  misc_feature (28)..(76): Pfam Name: F-box Pfam Description: F-box domain
  misc_feature: Functional Homolog Of Ceres SEEDLINE ID no. ME18314 at SEQ ID NO. 1277
MSSLRPDPTSRIHPEPEPTTTTSSPSIDHFDRLPDSLLLLVFNKIGDVKALGRCCVVCLRFHSLVPQVDNVVVRVDCVISDDDTSSSSSSTKSHSPSSSSGFSSIFRLVFGGIVKPFQVLGQLLGPKVNSRNGFLNSSLSVGTTTSTDDDTEPDQGGVTHHSPTQVLKNFNEIRFLRIELPSGELGIDDGVLLKWRADFGSTLDNCVILGAASVFTNNKNSFVMQENDAICNSTAAINNNNGVDDNGSIPESFYTNGGLKLRVVWTISSLIAASARHYLLQPIIAEHKTLDSLVLTDADGQGVLRMNREQLEELRVKPLSASSASKRTLVPALNMRLWYAPHLELPDGVVLKGATLVAIRPSDQAATKKDVSDISCLSTAFEEPYGTAAKMLVKRRTYCLEMNSF

SEQ ID NO: 1288 - DNA, 927 bp, Populus balsamifera subsp. trichocarpa
  misc_feature: Ceres ANNOT ID no.1504997
  misc_feature: Encodes the peptide sequence at SEQ ID NO. 1289
atggacggctttgatcggctcccggactccttaatcctcctcatcttcaactctatctccgacatcaaggcactaatccgttgccgttccgtttcgaaacgtttcaactcactagtcccccaaaccgaatccctctctctcaaagtcgactgcgtcatctcacctgagtcggactccgactcgctcttcactctcttcaaatctctcctgaaatccatccacgatctcttcaaacccgaccccaaacccacggcccgaaaccaaacccagaactccccggcccgaatcctctcccagttcgaccggatccgtgacctccaaatcgaactgccagctggcgacttgaaattagagaaaggagccgttatcaaatggagagctgaattcggcaagtcgttaaaaagctgcgttattctagggtttcgccgcgtagcaaatcccgagggaaatagtgctgacgaggaaattgattttacgggagggttaaaaacaagagttgtgtgggcaataagtgcgttgattgcagcatcggcgaggcattatctgttaaacgacgtcgtcaaggggcatagggagatggagaggttggtgttggtggacagagaaggggaagggacggtggcgatggagaaggaagggttgagggagtgtagggaggcggcgcgtggaggagagtgggaggaggacggggggaggacggtagtgccgagtgtgaggatgaggatgaggcacgagcaaagagtgcagttgaaggatggagtttggatggaaggtgtgacgttggtggtggtcaggccttgtagcggcggaggggatggggaggatgctgagttggcattaggtgcgttcggtggtgggatttacggagaagctgtacaggtactccttaagaataagagttatttattggaaatgaattccttctaa

SEQ ID NO: 1289 - protein, 308 aa, Populus balsamifera subsp. trichocarpa
  misc_feature: Ceres ANNOT ID no.1504997
  misc_feature: Bit score of 239.7 for HMM based on sequences of FIGURE 15.
  misc_feature (2)..(50): Pfam Name: F-box Pfam Description: F-box domain
  misc_feature: Functional Homolog Of Ceres SEEDLINE ID no. ME18314 at SEQ ID NO. 1277
MDGFDRLPDSLILLIFNSISDIKALIRCRSVSKRFNSLVPQTESLSLKVDCVISPESDSDSLFTLFKSLLKSIHDLFKPDPKPTARNQTQNSPARILSQFDRIRDLQIELPAGDLKLEKGAVIKWRAEFGKSLKSCVILGFRRVANPEGNSADEEIDFTGGLKTRVVWAISALIAASARHYLLNDVVKGHREMERLVLVDREGEGTVAMEKEGLRECREAARGGEWEEDGGRTVVPSVRMRMRHEQRVQLKDGVWMEGVTLVVVRPCSGGGDGEDAELALGAFGGGIYGEAVQVLLKNKSYLLEMNSF

SEQ ID NO: 1290 - DNA, 969 bp, Populus balsamifera subsp. trichocarpa
  misc_feature: Ceres ANNOT ID no.1451909
  misc_feature: Encodes the peptide sequence at SEQ ID NO. 1291
atggacggctttgatcggctcccggactccttaatcctcctcatcttcaactctatctccgacatcaaggcactaatccgttgccgttccgtttcgaaacgtttcaactcactagtcccccaaaccgaatccctctctctcaaagtcgactgcgtcatctcacctgagtcggactccgactcgctcttcactctcttcaaatctctcctgaaatccatccacgatctcttcaaacccgaccccaaacccacggcccgaaaccaaacccagaactccccggcccgaatcctctcccagttcgaccggatccgtgacctccaaatcgaactgccagctggcgacttgaaattagagaaaggagccgttatcaaatggagagctgaattcggcaagtcgttaaaaagctgcgttattctagggtttcgccgcgtagcaaatcccgagggaaatagtgctgacgaggaaattgattttacgggagggttaaaaacaagagttgtgtgggcaataagtgcgttgattgcagcatcggcgaggcattatctgttaaacgacgtcgtcaaggggcatagggagatggagaggttggtgttggtggacagagaaggggaagggacggtggcgatggagaaggaagggttgagggagtgtagggaggcggcgcgtggaggagagtgggaggaggacggggggaggacggtagtgccgagtgtgaggatgaggatgaggcacgagcaaagagtgcagttgaaggatggagtttggatggaaggtgtgacgttggtggtggtcaggccttgtagcggcggaggggatggggaggatgctgagttggcattaggtgcgttcggtggtgggatttacggagaagctgtacaggatgtcccttccctcggcctcgaaaccaaagagcaaggtaggtgtgtatcggaagatgagtatggtagactgacagccagccgacgttga

SEQ ID NO: 1291 - protein, 322 aa, Populus balsamifera subsp. trichocarpa
  misc_feature: Ceres ANNOT ID no.1451909
  misc_feature: Bit score of 186.1 for HMM based on sequences of FIGURE 15.
  misc_feature (2)..(50): Pfam Name: F-box Pfam Description: F-box domain
  misc_feature: Functional Homolog Of Ceres SEEDLINE ID no. ME18314 at SEQ ID NO. 1277
MDGFDRLPDSLILLIFNSISDIKALIRCRSVSKRFNSLVPQTESLSLKVDCVISPESDSDSLFTLFKSLLKSIHDLFKPDPKPTARNQTQNSPARILSQFDRIRDLQIELPAGDLKLEKGAVIKWRAEFGKSLKSCVILGFRRVANPEGNSADEEIDFTGGLKTRVVWAISALIAASARHYLLNDVVKGHREMERLVLVDREGEGTVAMEKEGLRECREAARGGEWEEDGGRTVVPSVRMRMRHEQRVQLKDGVWMEGVTLVVVRPCSGGGDGEDAELALGAFGGGIYGEAVQDVPSLGLETKEQGRCVSEDEYGRLTASRR

SEQ ID NO: 1292 - DNA, 1086 bp, Populus balsamifera subsp. trichocarpa
  misc_feature: Ceres ANNOT ID no.1461635
  misc_feature: Encodes the peptide sequence at SEQ ID NO. 1293
atgtcctatcattctcctcacttcaacacctcggaaaagttccctaataccgaccccatgagttccatggaggaagattgctttgatcgccttcctgatgctcttctcctcgttatcttcaacaaagtaggtgatgctaaatctctcactcgatgcatctcagtctccaagcgcttcgcttcgcttgtcttcgaagccgacacagtatttctttccatacctcctcgcaaacacaacccaaaagcagacaacagatcattaagaagaaatcttttcaagattcttattagtacgttgatagccaaaccactccatttctttcatcgtttcattgctgacaggtcagatacagaccggaaaactgtttctttttattcacctaaagaagtcttgaagcacttccaacaagctaaaactatgcacatggagcttccttctgatggtggcatgacaggattggagggaaatgattcattgataaaatggaaagccaggtttggtagcgagataaagaattttgttattcttagtgctacatcttttcagaagagaatgcaacctttatcatcagacgaattttctgaaaacaacggagaagtcttaactgatggtcaaatgaagttacaaattgtacagacaatttattgcctgcttgctgcttcagcaaggcattatttgatgaagcaggttttggaagaacatcacgcacttgaaaatatcatagcaagtgatgtatgcaagcaagggagggtttgtatgggaaaagatgaggtcgccgagataagaaattcaatgaaatcaatggtggcaagtacagattcatctttggagaggacccgagtgcctgatttgagcatgaagttgtggtatgtgcccgtgctcgagttgccagaaaatgggtacataatgagaggagccacactagctgtgcttaggccgaatgatgatgggcagattggaaatggcagcaagtctgatttgtttggttttgatggggaagaatgtgaaaagaaggcatttaatgaagctgtgagagagatggtgaagatgaagaagagctatctaatgacagtggattccttttga

SEQ ID NO: 1293 - protein, 361 aa, Populus balsamifera subsp. trichocarpa
  misc_feature: Ceres ANNOT ID no.1461635
  misc_feature (26)..(74): Pfam Name: F-box Pfam Description: F-box domain
  misc_feature: Bit score of 208.9 for HMM based on sequences of FIGURE 15.
  misc_feature: Functional Homolog Of Ceres SEEDLINE ID no. ME18314 at SEQ ID NO. 1277
MSYHSPHFNTSEKFPNTDPMSSMEEDCFDRLPDALLLVIFNKVGDAKSLTRCISVSKRFASLVFEADTVFLSIPPRKHNPKADNRSLRRNLFKILISTLIAKPLHFFHRFIADRSDTDRKTVSFYSPKEVLKHFQQAKTMHMELPSDGGMTGLEGNDSLIKWKARFGSEIKNFVILSATSFQKRMQPLSSDEFSENNGEVLTDGQMKLQIVQTIYCLLAASARHYLMKQVLEEHHALENIIASDVCKQGRVCMGKDEVAEIRNSMKSMVASTDSSLERTRVPDLSMKLWYVPVLELPENGYIMRGATLAVLRPNDDGQIGNGSKSDLFGFDGEECEKKAFNEAVREMVKMKKSYLMTVDSF

SEQ ID NO: 1294 - protein, 380 aa, Arabidopsis thaliana
  misc_feature: Public GI ID no.15236865
  misc_feature: Bit score of 922.2 for HMM based on sequences of FIGURE 15.
  misc_feature (23)..(71): Pfam Name: F-box Pfam Description: F-box domain
  misc_feature: Functional Homolog Of Ceres SEEDLINE ID no. ME18314 at SEQ ID NO. 1277
MAIILRSSDPLLSRIHPEPQEIDHFDNLPDSILLLIFNNIGDVKALGRCSVVSKRFHSLIPQVENVFVRVDCVISDDDSSSLLSDKPRSASAASPFSAIFRLVFKPLQALGQFLKRSGSSSLPSGSSPSSLLISGGDDGEIEQGGVTHHSPTQVLKNFDEIKFLKIELPSGELGIDDGVLLKWRAEFGSTLENCVILGASSVIPPTNSDKTEASSAPVAAVEDNGSIPESFYTNGGLKLRVVWTISSLIAASARHYLLQPIIAEHKTLDSLVLTDVDGQGVLCMNRDQLEELRVKPLSASSASKRTLVPALNMRLWYAPSLELPDGTVLKGATLVAIRPSESKKEVCDVSWVSSAFDEPYGVAAKMLVKRRTYCLEMNSF

SEQ ID NO: 1295 - protein, 379 aa, Arabidopsis thaliana
  misc_feature: Public GI ID no.18397400
  misc_feature: Bit score of 802.7 for HMM based on sequences of FIGURE 15.
  misc_feature (24)..(72): Pfam Name: F-box Pfam Description: F-box domain
  misc_feature: Functional Homolog Of Ceres SEEDLINE ID no. ME18314 at SEQ ID NO. 1277
MSYLLRSDPVSRIHPEPQSLTSFDHFDLLPDSLLLLIFDKVADVKDLGRCCIVSRRFHSLVPFVENVLVRVDCVISDDDSSSSDENHRFSLNTASISDAGGAGGSFSALFRLVFAPIFKPFQMLGQILGPKRSSSSFDASFSAINDEIGVTHHSPTQVLKNFGEIRFLKIELPTGELGIEDGILLKWRADFGSTLDNCMILGASSVIQSNSVKNHENSVDEDNGNIPESFYTNGGLKLRVVWTISSLIAASARHYLLQPIINEHKSLDRLVLSDADGQGVLCMNREQLEELRVTPLSASSASKRTLVPALNMRLWYAPELDLPDGTVLKGATLVAIRPSESKKEVCDASWLSDAFEEPFGTVAKMLIKRRTYCLEMNSF

SEQ ID NO: 1296 - DNA, 1634 bp, Arabidopsis thaliana
  misc_feature: Ceres CLONE ID no.16226
  misc_feature: Encodes the peptide sequence at SEQ ID NO. 1297
aatctctccttctttagattcctttctatcttcttctcttctcaaagatctgattctctcaagtctcaccaatggcgataattctccgttcatcagatccactcctctcacgaatccatccggaaccacaagaaatcgaccacttcgataacctcccagactcaatcctcctcctcatcttcaacaacatcggcgacgtcaaagccttaggtcgttgctccgtcgtctccaaaagattccattccttaatccctcaagtcgaaaatgtcttcgttcgtgtcgattgcgttatctccgacgacgattcttcctctctcctctccgataaacctcgatccgcctccgccgcttctcctttctccgccattttccgtctcgtcttcaagccgttacaagctttgggacagttccttaaacgctcaggttcttcttctcttccttcaggatcatctccttcttcgttgttgattagtggtggtgatgatggagagattgaacaaggaggtgtaacgcatcattcaccgactcaggttttgaaaaacttcgatgagattaagtttcttaaaatcgagcttcctagtggtgaattagggattgatgatggtgttttattgaaatggagagctgaatttggttctactctcgagaattgtgtgatcctcggtgcttcctctgtgattccgccgacgaattcggataagacggaagcgagttcggctcccgtcgcggcggtggaagataatggaagtataccggaatcgttttatacaaacggagggcttaagctacgtgttgtatggactataagctctttgattgctgcttccgctagacattacttgttgcaaccgattatagcagagcataagacgcttgatagtttagtgcttactgatgttgatggtcaaggagttttgtgtatgaatcgagatcagttagaggaattagagtgaaaccattgtcagcttcttcagcttctaagaggactcttgtacctgctttgaatatgagactttggtatgctccttctttggaattgcctgatgggactgtgttgaagggagctacgcttgtggcgattaggccgagtgagtcgaggaaggaggtgtgtgatgtgtcttgggtttcttctgcgtttgatgagccttatggggtagctgctaagatgttggttaagagaaggacttattgtcttgaaatgaattcgttctaaagcttgacgatttcgctaagtcggatctgaggtgaatgaatcacaaaggctaaccaggttttgaaagagagagactacaatgcataagatcagttttgtatgcagtgtgactaatcttagattcaccaatggagctcaattctatgtgttattggtctattggaaggttcgaattccgtctgcttggtcatcggaaaccgcattcgctggctgttttttgttttagctggcaaagcaatcatgtaagagcaagttttaatcttataaaatcttccatgtagcaagttttctttcattatttatgtgaatattgtttgtaggtaagagatacagktgctttgcttctccttgtcttttgtatacttgtcccaagttgtttaaaaaataatattgagcaatgtaaagtactttattactttct

SEQ ID NO: 1297 - protein, 293 aa, Arabidopsis thaliana
  misc_feature: Ceres CLONE ID no.16226
  misc_feature: Bit score of 541.4 for HMM based on sequences of FIGURE 15.
  misc_feature (23)..(71): Pfam Name: F-box Pfam Description: F-box domain
  misc_feature: Functional Homolog Of Ceres SEEDLINE ID no. ME18314 at SEQ ID NO. 1277
MAIILRSSDPLLSRIHPEPQEIDHFDNLPDSILLLIFNNIGDVKALGRCSVVSKRFHSLIPQVENVFVRVDCVISDDDSSSLLSDKPRSASAASPFSAIFRLVFKPLQALGQFLKRSGSSSLPSGSSPSSLLISGGDDGEIEQGGVTHHSPTQVLKNFDEIKFLKIELPSGELGIDDGVLLKWRAEFGSTLENCVILGASSVIPPTNSDKTEASSAPVAAVEDNGSIPESFYTNGGLKLRVVWTISSLIAASARHYLLQPIIAEHKTLDSLVLTDVDGQGVLCMNRDQLEELE

SEQ ID NO: 1298 - protein, 334 aa, Arabidopsis thaliana
  misc_feature: Public GI ID no.18411823
  misc_feature: Bit score of 212.3 for HMM based on sequences of FIGURE 15.
  misc_feature (2)..(50): Pfam Name: F-box Pfam Description: F-box domain
  misc_feature: Functional Homolog Of Ceres SEEDLINE ID no. ME18314 at SEQ ID NO. 1277
MDAFDAIPDPVVIDILNRVGDVKTLIRCRSVSKRFNSLATQSESLLLQLDQILGATESDSEIDSPIASFFRSLFKSIHGLLPPIFSKPANSDEILTRSPKTPAQILSGFERIRNLEVELYGGDVKLEKGAAVKWKAEFGKTLKSCVIVAFRSATVNTSAATEAAAVVDGVVESDSEFVCGLKTRVVWTISALMAASTRHYLMRDLVKDHKEMEKLIVRDSDGEGTVVMDAAGMKEYRETEVRGDNKESERVGERTVVPSVRMSMRHAPSLMLKSGICLEAATLVVVRPTGVASDDNDVELVTEAFAGDGDDCMYGEAVTALLKRRRNVLEMNSF

SEQ ID NO: 1299 - protein, 314 aa, Arabidopsis thaliana
  misc_feature: Public GI ID no.15219845
  misc_feature: Bit score of 187.2 for HMM based on sequences of FIGURE 15.
  misc_feature (2)..(50): Pfam Name: F-box Pfam Description: F-box domain
  misc_feature: Functional Homolog Of Ceres SEEDLINE ID no. ME18314 at SEQ ID NO. 1277
MDVFDGLPDPIIVDILNKVGDVKTLLRCSSLSKRFNSLVPQSESLTLRLDHSVSDSPVVTSIFRSLFNGLVSLLSKPAKPITITTLSPSLPFKILSRFDRIRNLDVELPGGDVKLEKGAAVKWKAEFGKTLKSCVIVAFRSAGTVSSPVAVEGESDAEFVTGLKTRVVWTISALMAASSRHYLMREVVKEHEEIESLVMRDKEREGTVVMNEEGLKELRNTEARVEDEERVVKNKRSVVPSVRMSMRHAPSLKLKSGICLESATLVIVRPSGADFEVGDDAELATEAFVGDCMYGEAVVALLKCKKNALEMNSF

SEQ ID NO: 1300 - DNA, 1647 bp, Triticum aestivum
  misc_feature: Ceres CLONE ID no.934771
  misc_feature: Encodes the peptide sequence at SEQ ID NO. 1301
cccagtggtgagcagcacgcttcccctcctatagaaaacgtccccgggacgagaccccgagaccggaaattctccaaagcaaaccacatcctcttcccctcccctccccttccctgctcgcgcgacctcactgcccgaatccaagctcccgtctgggcggctgctcctgctcgtgtgggtgtgccgtcgttagtctgcgctcgggttcgtccggagctgggatccggttgggtttccgggcggaaggccggatttggggccggccggcttcatctcggcccattgttttcgccgccgagctctccgtagccattctcctgaaagtaaaaattagcttcagtttgaggggttctcccgccggctcaagtcatccgaagaaccggacgctctgttagcgctagcgtttcctgctgcaacagacaacggattgctggttcgttcgtagcagtccagagtctgaaaaatgcatcccaaggctcgcatccacgcggacccggcggcaccggagccggaccggatcgacggcctgccggactcgctcgtgctgctcatcctcaacaagctggaggacgtgcactcgctgggccgctgcgccgccgtgtccaggcgcttcaacgacctggtcccgctcgtccacgacgtgtacgtcaagatcgaccgcgtggtggccgtggacggcgaccccgacgacgcgctcaacctgtcgtcccccaagccccgccacatcttctcccacctcttcaagctcatgctcttcaccatcgccaagccgttccaaggcatgcgcggcccgggcggcgcgggcggccggccgctgttcccgcggctcgcccagcactcgcccgtgcaggtgctcaggggcttctcccacgtccgcaacctccgggtggagctcccctcgggggacgtcgggacggaggagggggttctgctcaagtggcgggccaggtacggcagcacgctccagagctgcgtcatcctgggcggcaccctggtcgaccgcaagcccgccggcgggcacgagccgtcggcggcggaggacggcgggagcatgccggagtccttctacaccaacggcgggctgaagctgcgcgtggtgtggaccatcagctccctgatcgccgcgtcgacgcggcactacctgctccggtctatcatcaaggagcatccgacgctgcgaagcctggtgctggcggacgccgacgggcaggggacgctgtgcatgggggcggagcagctcgcggagttcagggagagccggctgtcggcctcggcgtgctccaacaggacgcaggtcccggcgtgcagcatgaagctcaagtacgccccctacctcgagctgcccggcggcctggggctgcagggcgcgaccctggtcgtcatcaagccctccggcgacggggctggcgggtgtcacgttggccggaaggagaccgaagcctttgtctcgggtgcgttcgatgggccgttcaggttcgcggccaaggcgctgatgaagcggcgcacctatctgctggagatgaacgggttctagatgctgttgaggtgtttgtggatggatatcttgcatttgcagtgcttctcatgagtataactgttttctgcttgggcaaatgcagtttctgaattgcaaaaaaaaaaaaaaaa

SEQ ID NO: 1301 - protein, 356 aa, Triticum aestivum
  misc_feature: Ceres CLONE ID no.934771
  misc_feature: Bit score of 817.3 for HMM based on sequences of FIGURE 15.
  misc_feature (17)..(65): Pfam Name: F-box Pfam Description: F-box domain
  misc_feature: Functional Homolog Of Ceres SEEDLINE ID no. ME18314 at SEQ ID NO. 1277
MHPKARIHADPAAPEPDRIDGLPDSLVLLILNKLEDVHSLGRCAAVSRRFNDLVPLVHDVYVKIDRVVAVDGDPDDALNLSSPKPRHIFSHLFKLMLFTIAKPFQGMRGPGGAGGRPLFPRLAQHSPVQVLRGFSHVRNLRVELPSGDVGTEEGVLLKWRARYGSTLQSCVILGGTLVDRKPAGGHEPSAAEDGGSMPESFYTNGGLKLRVVWTISSLIAASTRHYLLRSIIKEHPTLRSLVLADADGQGTLCMGAEQLAEFRESRLSASACSNRTQVPACSMKLKYAPYLELPGGLGLQGATLVVIKPSGDGAGGCHVGRKETEAFVSGAFDGPFRFAAKALMKRRTYLLEMNGF

SEQ ID NO: 1302 - DNA, 1837 bp, Zea mays
  misc_feature: Ceres CLONE ID no.338386
  misc_feature: Encodes the peptide sequence at SEQ ID NO. 1303
atgttagaaatttggtattttcaaacggagaaattgctgggccttggttggacggtggacgctgtccctttcccaaccccaaacgagaaaaacaagagagtacgaggcagcccgcatcacttcctcgctctcctctcctctacgctcctcgtcgcgtgcccacgtctcccacgcctccctcgctggctccccctccctccggacctcccccctccagatccagtctggcccgccgccgccgatgtccgaggatcccgcgtgctcccgccgctcgcggtgcgacctcggcggcgacgagcgctggctctcggggcccgccggcgacgaccacttcgaccgccttccggacgcgctcctcctcgtcatcttcaaccgcatcggcgacgtcaaggcgctcggccgctgctccctcgtctccctccgcttccacgagctcgtccccctcgtcgactccgtcttcgtccgcgtcgactgcgtcatccccgacgagcccccctcctcctcgtcctcgccgtcgacgccgttctctcctacggcgtccgtgcgagcccgtggggtcttctcacagatcgcgcgcatcgtgctcggcggcatcgtgaagcccatacaggctctcggtcagatcctctcccccgccaactccgcctctggctttccggcatcctccgattcctcgccatcgtcgtcctcctcatcttcgccactgcctcctgcggatgtgtcgcaccactctccctcggaggtgctccgctccttcaaagagctccgccaccttcgcatcgagctcccggcgggcgagctcgacatggacgacggcgtgatgctcaagtggaaggccgactttgggtccacactgggcagctgcgtcatccttggagcatcctcggcctcggcctcgccctcgccctcctccgctggctcagatagcacgagcaccgctccctctgttgacggtggccgcactgaacctgatgaatgtgtcgattcaggaagcatcccggagtcgttctacacaaacggggggtttaagctgcgggtggtttggacaatcagctcattgattgcggccgccgccaggcattacttgctgcagccgatcattgctgatcacaagacgctcgagagattggacctgacagatgctgatggccagggagtgctcaccatggacaagtgccaactgcaggagctgagggtgagaccggtatcaacatctaggggctcacaccggacgctcatgccagagcttagcatgtggctgtggtacgcaccatgtattgagctgcctggggggctggtgctaaatggcgcaacgcttgtggccatcaagccaagtgaggaaggaacaggggacacagtttggaatggggctgctggtgcagcctgggtgttggatgcattcgaggagccgtataggacagcggtgaggatgcttctcaagcagaggacctacagtcttgagatgaattcgttctaactatggggagatgacattttgaaagcgtcagatgtgagaggatgctataactactgatgtcctggatgccttttatgcaccaatctgcacctacttcagatgtgccaagtatgtgctattgtatgcttcttgttgagcatctgacagcaggaacatggatgaaatcaaagacactgtgttaatttatggaaatgccaaaggcatagttgagttggtggtgttctctgagatcagatgtggcacaaatagtttttttttctatatgtatccacatcaactcatcaatgtactagccttatgtaatttcaactgttggattgtgggattttgctgcttgtttgcagaacaaaaaaaaaaaaa

SEQ ID NO: 1303 - protein, 411 aa, Zea mays
  misc_feature: Ceres CLONE ID no.338386
  misc_feature: Bit score of 948.8 for HMM based on sequences of FIGURE 15.
  misc_feature (29)..(77): Pfam Name: F-box Pfam Description: F-box domain
  misc_feature: Functional Homolog Of Ceres SEEDLINE ID no. ME18314 at SEQ ID NO. 1277
MSEDPACSRRSRCDLGGDERWLSGPAGDDHFDRLPDALLLVIFNRIGDVKALGRCSLVSLRFHELVPLVDSVFVRVDCVIPDEPPSSSSSPSTPFSPTASVRARGVFSQIARIVLGGIVKPIQALGQILSPANSASGFPASSDSSPSSSSSSSPLPPADVSHHSPSEVLRSFKELRHLRIELPAGELDMDDGVMLKWKADFGSTLGSCVILGASSASASPSPSSAGSDSTSTAPSVDGGRTEPDECVDSGSIPESFYTNGGFKLRVVWTISSLIAAAARHYLLQPIIADHKTLERLDLTDADGQGVLTMDKCQLQELRVRPVSTSRGSHRTLMPELSMWLWYAPCIELPGGLVLNGATLVAIKPSEEGTGDTVWNGAAGAAWVLDAFEEPYRTAVRMLLKQRTYSLEMNSF

SEQ ID NO: 1304 - DNA, 1383 bp, Zea mays
  misc_feature: Ceres CLONE ID no.1276710
  misc_feature: Encodes the peptide sequence at SEQ ID NO. 1305
aatcaaatcccccagcaagtcagccccgccccgccccgcgccgacgcctctccccgatcccgatctgtgtgcctggctgcctgcaacctccgtgggatggaggcggcgcggcagcagcaggaggagtgcccgtgcggcggggccgaggccgctgaccagttcgagcggctgcacgacgcggtgctgctcgacgtcctcaatcgcatcggcgacgtcaaggcgctcggccgctgcgccctcgtctcgcgccgcttccacgcgctcgtgccgctcgtcgactccgtcttcgtccgcgtcgactgcgtcatccctgacgacccgccgccctcgtcctcctcctcctcctcctcctcttccgccgcaccaggcaccccgccgcggcaggcgccagccccaaccgcgcgcgggcgcggcgcgctcgcgcacatcgtgcgcgtcctgctcggcggcatcgccaggcccatccacgcgctcggccagatcctctcccccgccgccgcggccgtctcccggcgctccgaggcactgcccgcttccccgcgcgcgcccgtcgcggacgtctctcaccactccccctccgaggtgctccgctccttcaaggagctgcggcgccttcacatcgagctgcccacgggcgagctcggcattgacgacggtgtgctccttaagtggaaggccgacttcggctccaccctcgtcagctgcgtcatcctcggcgcctcgtcgatctcgtccaagccgccgacagggtacactcaggcggaatcggaaactgctacggccgccactcccgataccagtcgggagactgaagagccggggagcctacctgattctctttatacaaatggaggactcaagcttcgcgttgtctggaccatcagctccctgattgccgcgtcggcgaggcattacttgctgcagccgattatctggaatcacgaattgctggagagcttggacctgacagatgctgacgggcaaggggtgctcaccatggacaagaggcagctgcaggaactgcgggtgcggcccgtctttccgtcagggagctcgcaccgcaccctcatgccggctctcagtatgcgtctgcactacgcaccgctcattgagctgcctgggggaacgctgctgaagggtgcgacactagtggcgatcaaaccaagcgaagatgccttgagggagggccaaggggctggggctgcaggtcctgttggtacatgctggatttcagaggcctttgaggagccatatcggactgcggcaaaggtgcttctcaagagaagggcatattgtcttgaaatgaactcgttctgagcactagggggtttacttccacagagttctacccttctgacaggtgaaatgccactttacagttct

SEQ ID NO: 1305 - protein, 406 aa, Zea mays
  misc_feature: Ceres CLONE ID no.1276710
  misc_feature: Bit score of 721.8 for HMM based on sequences of FIGURE 15.
  misc_feature (20)..(68): Pfam Name: F-box Pfam Description: F-box domain
  misc_feature: Functional Homolog Of Ceres SEEDLINE ID no. ME18314 at SEQ ID NO. 1277
MEAARQQQEECPCGGAEAADQFERLHDAVLLDVLNRIGDVKALGRCALVSRRFHALVPLVDSVFVRVDCVIPDDPPPSSSSSSSSSSAAPGTPPRQAPAPTARGRGALAHIVRVLLGGIARPIHALGQILSPAAAAVSRRSEALPASPRAPVADVSHHSPSEVLRSFKELRRLHIELPTGELGIDDGVLLKWKADFGSTLVSCVILGASSISSKPPTGYTQAESETATAATPDTSRETEEPGSLPDSLYTNGGLKLRVVWTISSLIAASARHYLLQPIIWNHELLESLDLTDADGQGVLTMDKRQLQELRVRPVFPSGSSHRTLMPALSMRLHYAPLIELPGGTLLKGATLVAIKPSEDALREGQGAGAAGPVGTCWISEAFEEPYRTAAKVLLKRRAYCLEMNSF

SEQ ID NO: 1306 - DNA, 1547 bp, Zea mays
  misc_feature: Ceres CLONE ID no.1479310
  misc_feature: Encodes the peptide sequence at SEQ ID NO. 1307
ccccagcaagtcagccccgccccgcgccgacgcctctccccgatcccgatctgtgtgcctggctgcctgcaacctccgtgggatggaggcggcgcggcagcagcaggaggagtgcccgtgcggcggggccgaggccgctgaccagttcgagcggctccacgacgcggtgctgctcgacgtcctcaatcgcatcggcgacgtcaaggcgctcggccgctgcgccctcgtctcgcgccgcttccatgcgctcgtgccgctcgtcgactccgtcttcgtccgcgtcggctgcgtcatccctgacgacccgccgccctcgtcctcctcttccgccgcaccaggcacctcgccgcggcaggcgccagccccggccgcgcgcgggcgcggcgcgctcgcgcacatcgcgcgcgtcctgctcggcggcatcgccaggcccatccacgcgctcggccagatcctctcccccgccgccgcggccgtctcccggcgctccgaggcactgcccgcttccccgcgcgcgcccgtcgcggacgtctctcaccactccccctccgaggtgctccgctccttcaaggagctgcggcgccttcacatcgagctgcccacgggcgagctcggcattgacgacggtgtgctccttaagtggaaggccgacttcggctccaccctcgtcagctgcgtcatcctcggcgcctcgtcgatctcgtccaagccgccgacagggtacactcaggcggaatcggaaactgctgcggccgccactcccgataccagtcgggagactgaagagccggggagcctgcctgattctctttatacaaatggagggctcaagcttcgcgttgtctggaccatcagctccctgattgccgcgtcggcgaggcattacttgctgcagccgattatctgtaatcacgaattgctggagagcttggacctgacagatgctgacgggcaaggggtgctcaccatggacaagaggcagctgcaggaactgcgggtgcggcccgtctttccgtcagggagctcgcaccgcaccctcatgccggctctcagtatgcgtctgcactacgcaccgctcattgagctgcctgggggaacgctgctgaagggtgcgacactagtggcgatcaaaccaagcgaagatsccttgagggagggccaaggggccggggctgcaggtcctgttggtacatgctggatttcagaggcctttgaggagccatatcggactgcggcaaaggtgcttctcaagagaagggcatattgtcttgaaatgaactcgttctgagcacctagggggtttacttccacagagttctacccttctgacaggatggtgggaagtgggacgccgttcagctaatacaggggaatttattattcagagcagaaattggacgaagatacatctatttccccatctgttgtatctgatttcggtgaaatggtgacttcgtgtacctgtaactttagggctataattacagatatgtatttgtgctggactactacacgcggaatggaatgttatttgggccgatttccgc

SEQ ID NO: 1307 - protein, 401 aa, Zea mays
  misc_feature: Ceres CLONE ID no.1479310
  misc_feature: Bit score of 713.2 for HMM based on sequences of FIGURE 15.
  misc_feature (20)..(68): Pfam Name: F-box Pfam Description: F-box domain
  misc_feature: Functional Homolog Of Ceres SEEDLINE ID no. ME18314 at SEQ ID NO. 1277
  misc_feature (355)..(355): Xaa is any aa, unknown, or other
MEAARQQQEECPCGGAEAADQFERLHDAVLLDVLNRIGDVKALGRCALVSRRFHALVPLVDSVFVRVGCVIPDDPPPSSSSSAAPGTSPRQAPAPAARGRGALAHIARVLLGGIARPIHALGQILSPAAAAVSRRSEALPASPRAPVADVSHHSPSEVLRSFKELRRLHIELPTGELGIDDGVLLKWKADFGSTLVSCVILGASSISSKPPTGYTQAESETAAAATPDTSRETEEPGSLPDSLYTNGGLKLRVVWTISSLIAASARHYLLQPIICNHELLESLDLTDADGQGVLTMDKRQLQELRVRPVFPSGSSHRTLMPALSMRLHYAPLIELPGGTLLKGATLVAIKPSEDXLREGQGAGAAGPVGTCWISEAFEEPYRTAAKVLLKRRAYCLEMNSF

SEQ ID NO: 1308 - DNA, 1902 bp, Zea mays subsp. mays
  misc_feature: Ceres CLONE ID no.376230
  misc_feature: Encodes the peptide sequence at SEQ ID NO. 1309
agggaaagcattctccaatatccacctcctcctcgcccccctctctctctctaaaagaactgaaaagataagggggaaatcctcaagtgctcgttacataaaccctaacctcgttggattcgcagcaaaagcccaccaattggaagccctccgatgttccagctgcatgctggagctgagccgtgctcggtttgacgaaattttgcatcccttctgtgcttggaccacccgattgaggctgtttctccgagggggcgtgccagcggtttcgcggcccaggtcctcacctgtgctatccggcgccggatccgggtttgttccggtgagaggtcgggcttttggtggggtctgtacagcttggagctcaatttgccggcctgagttggagtcgcgactgcggtggcggtgattgaggtagtcgcgtcgatttggcacgcgtttcctgccatttgggtgagccagcctttcctggcaatcttggcgggcgtttcgtcttgctgcgtggcagaaaggtgtgacctttgtgccgtgcgatgcatcccaaggcacgaatccacgccgacccagtgcgcgaggtcgaccactttgactgcctgccggattcgctcgtcctgctgatcctgaacaaggtcgaggacgtgcgatcgctcggccggtgctacgccgtgtccaagcggctttgtgggcttgtcccccttgtccatgatgtgtatgtcaagattgaccgcgtcgtggcggtcgacggcgacgctgaggacgcgctcaacctgtcatcgccgaagcctcggaacatcttctcgcacttcctgaagctgatgctcttcaccatcatcaagcctttccacaacatgcgcaaccctaatggtactgggaggtcattgttcccgcagctctcgcaccactcgccagcgcaggtgctcaggaacttcacgcacatcaggaatcttcggatcgagctcccctctggggatgtgggtactgaggagggagttctcctgaaatggcgggcagagtatgggagcacacttcagagttgtgtgatcctggggggtacccgggttgaccgcaagcctgttggtggagagcatgagcagtctttggaggataatggaagcatgccagagtctttctataccaacggtgggctgaaacttcgtgtcgtctggacaatcagctctctaattgcggcatcaacgaggcactatcttctccgctcaatcatcaatgaccatcccacacttctgagcttggtactgacagatgccgatggccaaggcacattgtgcatgggggcagagcagctgaaggaattcagagagaaccagttgtcggcatcagcatgttccaacaggactcaggtcccagcctgcaacatgaagctcaagtatgctccatatcttgaactgcctggtggtatggcgttgcaaggcgccactttggtggctatcaaaccctcacctgacggaagcaatggaagccaccctaaccgtaaagaagctgacgcatttgtctttggagcatttgatgggccatttaaggctgctgtgaaggctttgatgaagaggcgcacttaccttctggagatgaatggcttctagaaatcttgtgttcgcggtggtatcgagcttgttggtgctatgcatggcacatttagctaagcttttcacctgtgtaatatccaagaaggcaccatctctagttgctgcttttagtctgctgttttagctctttgtacagtgttaacatttggttatataaaaatcgtatcaagttctctagtgtaatagtgaatctctccatagttcmccatcctggcccctggtgtaatatccaagaaatcatatcaggtacataacattcattttgggattgtgaattgaaagagactgatctgatgccgac

SEQ ID NO: 1309 - protein, 354 aa, Zea mays subsp. mays
  misc_feature: Ceres CLONE ID no.376230
  misc_feature: Bit score of 800.3 for HMM based on sequences of FIGURE 15.
  misc_feature (16)..(64): Pfam Name: F-box Pfam Description: F-box domain
  misc_feature: Functional Homolog Of Ceres SEEDLINE ID no. ME18314 at SEQ ID NO. 1277
MHPKARIHADPVREVDHFDCLPDSLVLLILNKVEDVRSLGRCYAVSKRLCGLVPLVHDVYVKIDRVVAVDGDAEDALNLSSPKPRNIFSHFLKLMLFTIIKPFHNMRNPNGTGRSLFPQLSHHSPAQVLRNFTHIRNLRIELPSGDVGTEEGVLLKWRAEYGSTLQSCVILGGTRVDRKPVGGEHEQSLEDNGSMPESFYTNGGLKLRVVWTISSLIAASTRHYLLRSIINDHPTLLSLVLTDADGQGTLCMGAEQLKEFRENQLSASACSNRTQVPACNMKLKYAPYLELPGGMALQGATLVAIKPSPDGSNGSHPNRKEADAFVFGAFDGPFKAAVKALMKRRTYLLEMNGF

SEQ ID NO: 1310 - DNA, 1774 bp, Zea mays
  misc_feature: Ceres CLONE ID no.1290713
  misc_feature: Encodes the peptide sequence at SEQ ID NO. 1311
gctcgttccataaaccctaacctcgttggattctcggcaaaaatcctcccaattcggaaccctccgatgttccagctacctgcgggagctgagccgtgctcggtttggcgaaattttgcacccctcttgtgctaggaccacccggttcaagctgttcctcgctcctcggaaggatcaggtcttcaccggtgctctccggcgccggatccaggtttgtttcggcgagaggtcgggctcttggcgggggccagcccagcttcgagctcaatttgccggcctgagatggaatcgcgactgcggtgccggtgccggtggctcagctagtcgcgtcgagtcgacgcgcgattcctgccatttgggtgggccagcctttcctggcaatctcggggggcgtttcgcctcgctgcgtggcagaaaggtgtgacgtgtgatgcatcccaaggcacgaatctacgccgacccggtgcgcgaggtcgaccacttcgactgcctgccggattcgctcgtcctgctcatcctgaacaaggtcgaggacgtgcggtcgctcggccggtgctacgccgtgtccaagcggctctgtgggctcgtttccctcgtccatgatgtgtatgtcaagattgaccgcgtcgttgcggtcgacggcgacgccgagggcacgctcaacctgtcctcgccgaagcctcggagcatcttctcgcacttcctgaagctgatgctcttcacaatcatcaagccgttccacaacatgcgcagccctaatggtactgcgaggccattgttcccgcagctctcgcagcactcaccggcacaggtgctcaggaacttcacgcacgtcaggaaccttcggatcgagctcccctctggggatgtgggtactgaggagggagttctcctgaaatggcgagcagagtatgggagcacacttgagaattgtgtgatcctggggggtacccgggttgaccgcaagcctgttggtggagagcatgagccagctttggaggacaatggaagcatgccagagtctttctataccaatggtgggctgaaacttcgtgtcgtctggacaatcagctctctaatcgcggcatcaacaaggcactatcttctccgctcaatcatcaatggccatcccacactacagagcttggtactgacagatgctgatggccaaggcacattgtgcatgggggcaaagcagctggaggagttcagagagaaccagttgtcgacctcggcatgttccaacaggactcaggtcccagcctgcaacatgaagctcaagtatgctccatatgttgaactgcctggtggtatggcgttgcaaggcgctactttggtggctatcaaaccctcacctgagggaagcaatggaagccaccctaaccgcaaggaagccgaaggattcgtctttggagcattcgatgggccatttaaagctgctgtgaaggcgctgatgaagagacgcacttaccttctggagatgaatggcttctaggaatcttggtatctagcttgttggtgctatgcatggtacatttagctgagtgtctcatatgtgtaatattcaagaaggcaccatctctagttttgatgcttgctgtctgctgttttagctatttgtacagtgttaacatttggttagataaagatcatatcaagtcctctagcgcaatagtgaatctctctacagttcactattctggcccatgatgtcctgtgtgatatggaagactgaagcatcctactgttaactcttttaaaaaaaaaaaaaaaa

SEQ ID NO: 1311 - protein, 354 aa, Zea mays
  misc_feature: Ceres CLONE ID no.1290713
  misc_feature: Bit score of 776.2 for HMM based on sequences of FIGURE 15.
  misc_feature (16)..(64): Pfam Name: F-box Pfam Description: F-box domain
  misc_feature: Functional Homolog Of Ceres SEEDLINE ID no. ME18314 at SEQ ID NO. 1277
MHPKARIYADPVREVDHFDCLPDSLVLLILNKVEDVRSLGRCYAVSKRLCGLVSLVHDVYVKIDRVVAVDGDAEGTLNLSSPKPRSIFSHFLKLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLKLRVVWTISSLIAASTRHYLLRSIINGHPTLQSLVLTDADGQGTLCMGAKQLEEFRENQLSTSACSNRTQVPACNMKLKYAPYVELPGGMALQGATLVAIKPSPEGSNGSHPNRKEAEGFVFGAFDGPFKAAVKALMKRRTYLLEMNGF

SEQ ID NO: 1312 - DNA, 1418 bp, Zea mays subsp. mays
  misc_feature: Ceres CLONE ID no.321681
  misc_feature: Encodes the peptide sequence at SEQ ID NO. 1313
accaccaccctccctctctgcctcaccacctactccgcctgcgcctgcgagctgtgctgtgctgcgcaacggggagatccaatccacagaacaggatgcagtccaagcaccgggtcttcgcggaggacctgctcctggcggcggcggcggagggcgaggaccacttcgaccgggtgcccgactccctggtgctcctcatcttcaacaagctggccgacgcgcggtcgctggggcgctgctccgcggtgtcgcgccgcttcagcgcgctggtcccgctcgtggacgacgcctgcctgcgcatcgaccgcgtcatccccgccgacgccgccgacgcgggggcgccgcgcccgcgcgccgcgctctcgcacctcctcaagtccgtgctgctcgccgtgctcaagcccttcgcgcactgcgacgccaagtccgcgtcgccgcaaaagcacgcgcaccagcagcagcagcaccactcgcccgcccaggtgctcaggaacttcagcagcatccgcagcctccggatggagctcccggtctccgacgtgggcaccgacgacggcgtcgtgctcaggtggaaggccgtcttcggcagcacgctgcagagctgcgtcatcctcggcggcaccagggtggaccgcgcgggaccgccgcacgccccctcctccggctccgctccccccgcggtcgacgacgacggcggcagcatcccggagtccctgtacaccaacggcggcctcaagctgcgcgtcgtctggaccatcagctccctcatcgccgcggccaccaggcactacctcctccgcgagatcgtcaaggagcaccccaccctcgagcgggtggcgctgacggacgccggcgggcagggcacgctcagcatggggcgcgaccagctcagggagttcagggacaggccgctcgccgccgcgcccgccgccgccgccaaccgcacgcaggtgcccgcctgcaacatgaagctgcgctacgcgccgctgctggagctctcggacggcaccaggatccacggcgccacgctcgtggtcatcaagcccgtcggcgacgccggcgggaaggacctcgacgagctcggcgccggcgccttcgacgggcccctgagggaggccgtggccgcgctcggcaagcgccgcgcatacctgctcgagatgaacggcttctagtctgcgcgcctctctgctccattgcaatgggcattgttaattggccaatgggcaacggcaactagctagctagattgctcctccgctcgcttcacctcagctgtcagtcagctcctgtcctgacgatatccttgtgaaaaaaaaacagtagtatagaatggagtgggcagcgccagccagccggccagcttcacagtgcattctgatgctatcatgaacggaaatgaagcagtcagtcacatttcg

SEQ ID NO: 1313 - protein, 358 aa, Zea mays subsp. mays
  misc_feature: Ceres CLONE ID no.321681
  misc_feature: Bit score of 524.8 for HMM based on sequences of FIGURE 15.
  misc_feature (22)..(70): Pfam Name: F-box Pfam Description: F-box domain
  misc_feature: Functional Homolog Of Ceres SEEDLINE ID no. ME18314 at SEQ ID NO. 1277
MQSKHRVFAEDLLLAAAAEGEDHFDRVPDSLVLLIFNKLADARSLGRCSAVSRRFSALVPLVDDACLRIDRVIPADAADAGAPRPRAALSHLLKSVLLAVLKPFAHCDAKSASPQKHAHQQQQHHSPAQVLRNFSSIRSLRMELPVSDVGTDDGVVLRWKAVFGSTLQSCVILGGTRVDRAGPPHAPSSGSAPPAVDDDGGSIPESLYTNGGLKLRVVWTISSLIAAATRHYLLREIVKEHPTLERVALTDAGGQGTLSMGRDQLREFRDRPLAAAPAAAANRTQVPACNMKLRYAPLLELSDGTRIHGATLVVIKPVGDAGGKDLDELGAGAFDGPLREAVAALGKRRAYLLEMNGF

SEQ ID NO: 1314 - DNA, 1845 bp, Panicum virgatum
  misc_feature: Ceres CLONE ID no.1869072
  misc_feature: Encodes the peptide sequence at SEQ ID NO. 1315
atctctctctactttctctctctaccgctcctcgtgacgtcgcgtgcccacgtctcccacgccttcccgaccccccgtctctcctcctccagatccggtctcctcagccgccgccgatgtccgaggatctagcgggatcccgccgctggcggtgcgacctcggcggcgacgaccgctggctgtcgggggccgccggcgacgaccacttcgaccgcctccccgacgcgctcctcctcgtcatcttcaaccgcatcggcgacgtcaaggcgctcggccgctgctccatcgtctcccgtcgcttccacgagctcgtccccctcgtcgactccgtcctcgtccgcgtagactgcgtcatccccgacgagcccccttcctcctcgccgtccgcgccgtcctcccccacggcctccgtacgcgcccgcggggtcttctcgcagatcgcgcgcatcgtgctcggcggcatcgtgaagcccatccaggcgctcggccagatactctcaccggcccactctgcctccggcttttcagcatcctccgcttcctcgtcgtcatccttccccccatcttcgacgccgtactcgccgttgcctcctggggacgtgtcgcaccactcgccctcggaggtactccgctccttcaaggagctccgccaccttcgcattgagcttccggcgggcgagcttggcacggacgacggcgtgatgctcaagtggaaggctgactttgggtccacgctcggcagctgcgtcatcctcggcgcatcctcggcctcgccgtcccctgctggctcaaatggcgcgagcacagctccctctgttgacagtggccgcagcgagcccgaggaatgtgacgattcaggaagcatcccggaatccttctatacaaatggggggctgaggctgcgggtcgtgtggacaatcagctcgctgattgcagcagcagggaggcattacttgctgcagccaatcgttgctgaccacacaacgctggaaagattggacctgacggacgcagatgggcagggagtgctcaccatggacaagtgccaactgcaggagctgcgggtgaggccggtatcatcatctgcggcctcgcaccggaccctcatgccggagcttagcatgtggctgtggtacgcgccatgcattgagctgcctggggggttggtgctaaatggtgcgacattggtggccatcaagccgagcgaggaggcaacaagggacatggtagggaatggggctgctacggctgcctgggttttagatgcattcgaggagccataccgaacagcagcgaggatgcttctcaagcggaggacttacacccttgagatgaattcattctaatccatagaggaggtggcattttggaagcttcatatatgagaggattttatacctacaggggtcatttctggctgcctttttatgcccaatctgcacctattttggatgtgctccaattgtgttggatgcattcctttctgtgctgagcacctgccagcattccagcaagaacatggatggatatgaagagaatctgtgctttaatttatcgatgaaagagtcaagccattgttgagctgatggtgtttgctctgatggaactcccaatcactgagattagatgtggtggcatagatattttttttctgatatgtatccacatcaaggaactaaccttatgcaatttctgctttggatcgcactgcttgtttgcataatagcatccaatctgccctgtaaatcaacatgtgtcatgagtcatgagtgtattcatatatcggactggagttagcaaaagctgaaaactggtgatagtactcaaaaaaaaaaaaaaaaaaaa

SEQ ID NO: 1315 - protein, 409 aa, Panicum virgatum
  misc_feature: Ceres CLONE ID no.1869072
  misc_feature: Bit score of 889.3 for HMM based on sequences of FIGURE 15.
  misc_feature (29)..(77): Pfam Name: F-box Pfam Description: F-box domain
  misc_feature: Functional Homolog Of Ceres SEEDLINE ID no. ME18314 at SEQ ID NO. 1277
MSEDLAGSRRWRCDLGGDDRWLSGAAGDDHFDRLPDALLLVIFNRIGDVKALGRCSIVSRRFHELVPLVDSVLVRVDCVIPDEPPSSSPSAPSSPTASVRARGVFSQIARIVLGGIVKPIQALGQILSPAHSASGFSASSASSSSSFPPSSTPYSPLPPGDVSHHSPSEVLRSFKELRHLRIELPAGELGTDDGVMLKWKADFGSTLGSCVILGASSASPSPAGSNGASTAPSVDSGRSEPEECDDSGSIPESFYTNGGLRLRVVWTISSLIAAAGRHYLLQPIVADHTTLERLDLTDADGQGVLTMDKCQLQELRVRPVSSSAASHRTLMPELSMWLWYAPCIELPGGLVLNGATLVAIKPSEEATRDMVGNGAATAAWVLDAFEEPYRTAARMLLKRRTYTLEMNSF

SEQ ID NO: 1316 - DNA, 1858 bp, Panicum virgatum
  misc_feature: Ceres CLONE ID no.1780691
  misc_feature: Encodes the peptide sequence at SEQ ID NO. 1317
aaagcactcgccactcgcgtcgcagcacttcctctgcatctctctctctctctagaaaaaattgaaaagagaagggaaaaatccccaactcctcgccccataaaccctaatctcgtcggattcgcaccacaagcctcccaaatcgaagccctccggtggtccagccgcctgcgggagctgagccgttctcggtttggtggaaaattccggggttttctgcgctcggtgccgccatttctccgggctgttcctccgagggcagcggctccccggctcgggttctccggtgctcgccggcgccggatccggacgtgtcccggcgagaggtcgggtttcgcgtggggtcggttcagcttcgagctcgatttgcccgcttgagttgggtcgcggctgccgtggcggtgattgaggtagtcgcgtcgattttgggggcgcgaaggtttcgttgcgaggcagcagcgtttcttggtaatccttgggtctttctgccgtgcgatgcaccccaaggctcgaatccacgcggacccggtgctggaggtcgaccagttcgactgcctgccggattcgctcgtcctgctcatcctgaacaaggtggaggacgtgcggtcgctgggccggtgctccgccgtctcgaagcggttctgcgggcttgtctccctcgtccacgacgtgtatgtcaagatcgaccgcgtcgtggcggtcgacggcgacgccgaggacacgctcaacctgtcctcgcccaagcctcggaacatcttctcgcacttcctgaagctgatgctcttcacaatcatcaagccgttccacagcatgcgcaacccgaatggcaatgggaggccactgttcgctcagctctcacagcactcgccagcccaggtgctccggaacttcacgcacatccggaatcttcgggttgagctcccctctggggatgtgggtaccgaggagggagtgctcctgaaatggcgggcagagtatgggagtacacttcagagctgtgtgattctgggcggtacccgggttgatcgcaggcctgttggtggagagcatgaaccatctttggaggataatggaagcatgccagagtctttctataccaatggtgggctgaaactccgtgtcgtctggacaatcagctctctgattgcggcatcaacgagacactatcttctccggtcaattatcaaggaccatcccacacttacaagcctggtactaaccgacgccgatggccaaggcacattatgcatgggggcggaacagctgaaggagttcagagagaaccagttatcagcctcagcatgctccaacaggactcaggtcccagcctgcaacatgaagctcaagtacgccccatatctcgagctgcctggtggtatagctttgcaaggtgctacgttggtggctatcaagccatcgaccgagggaagcaatggaggccataccagccgtaaggaaactgatgctttcatctctggagcatttgatgggccattcaaggtagctgtgaaggcactgacgaagagacgtacttaccttctggagatgaatggcttctaggtatccgcagttttcatatctagcttggtggtgctaggcatggcacctttagttgacctttccatctgtgtaatatccaagatggcgccatctctagatttctagatggtgcttatctgctgttttagctctttgtacagtagtgacatttggctctatgaaaatcacatgaagttagtgtatctcttttttgctcaccattctgcatcctgatgccatgtttgatactgtaatgtatacttctgtcgactctttccagtgaaacagccttgtgtttcaaaaaaaaaaaaaaaaaaaa

SEQ ID NO: 1317 - protein, 354 aa, Panicum virgatum
  misc_feature: Ceres CLONE ID no.1780691
  misc_feature: Bit score of 827.0 for HMM based on sequences of FIGURE 15.
  misc_feature (16)..(64): Pfam Name: F-box Pfam Description: F-box domain
  misc_feature: Functional Homolog Of Ceres SEEDLINE ID no. ME18314 at SEQ ID NO. 1277
MHPKARIHADPVLEVDQFDCLPDSLVLLILNKVEDVRSLGRCSAVSKRFCGLVSLVHDVYVKIDRVVAVDGDAEDTLNLSSPKPRNIFSHFLKLMLFTIIKPFHSMRNPNGNGRPLFAQLSQHSPAQVLRNFTHIRNLRVELPSGDVGTEEGVLLKWRAEYGSTLQSCVILGGTRVDRRPVGGEHEPSLEDNGSMPESFYTNGGLKLRVVWTISSLIAASTRHYLLRSIIKDHPTLTSLVLTDADGQGTLCMGAEQLKEFRENQLSASACSNRTQVPACNMKLKYAPYLELPGGIALQGATLVAIKPSTEGSNGGHTSRKETDAFISGAFDGPFKVAVKALTKRRTYLLEMNGF

SEQ ID NO: 1318 - DNA, 1765 bp, Panicum virgatum
  misc_feature: Ceres CLONE ID no.1818502
  misc_feature: Encodes the peptide sequence at SEQ ID NO. 1319
gaaggaagggaaagcttccgcatcgcatccttgaaaaaactgaaaagagaaggggaaaatccccaactcctccccacataaaccctaatatccttggattcgcaccagaagccccccgaatcgaagccccctccggcgctccagctgcctgcaggagttgagccgtgctcgatctggtggaaaaatccaggtttttccgcgctcagagccgcgtcggagcgcttcgggttctccggtgctcgccggcgctggatccgtgcatgttccggcgagaggtcgggtttcgcgtggggtcggttccgcttcgagctcgattcgcccgcttgagttgggtcgcggctgccgtggcggtgattgaggtagtcgcgtcgatttgacgggtgcttcttgccattttggcgagccattcgggggaccgaagggttcgccgcaaggcagcagcgtttcttgataatcctgggccatttgcgtggctgaaaggcgtgacctttgtgccgtgcgatgcaccccaaggctcgaatccacgcggaccctgtgctcgaggtcgaccagttcgactgcctgccggattcgctcgtcctgcacatcctgaacaaggtggaggacgtgcggtcgctgggccggtgcttcaccgtctcgaagcggttctgcgggcttgtctccctcgtccacgatgtgtatgtcaagattgaccgcgtcgtggcggtcgatggcgacgccgaggacacgctcaacctgtcctcgccgaagcctcggaacatcttctcgcacttcctgaagctgatgctcttcacaatcatcaagccgttccacaacatgcgcaacccgaatggtaatgggaggccactgttcgcgcagctctcacagcactccccagcccaggtgctctggaacttcacgcacatccggaatcttcgggttgagctcccctctggggatgtgggtaccgaggagggagtgctcctgaaatggcgggcagagtatgggagtacacttcagagttgcgtgattctgggcggtacccgagttgatcgcaggcctgttggtggagagcaagaaccatctttggaggataatggaagcatgccagagtctttctataccaatggtgggctgaaactccgtgtcgtctggacaatcagctctctgattgcggcatcaacgagacactatcttctccggtcaattatcaaggaccatcccacacttacaagcctggtactaactgacgccgatggccaaggcacattatgcatgggggcggaacagctgaaggagttcagggagaaccagttatcagcctcagcatgctccaacaggactcaggtcccagcctgcaacatgaagcttaagtatgccccatatctcgagctgcctggtggtatagcgttgcaaggtgctacgttggtggctatcaagccatcaactgagggaagcaatggaggccatacctgccgtaaggaaactgatgctttcatctctggagcatttgatgggccattcaaggttgctgtgaaggcgctgatgaagagacgtacttacctcctcgagatgaatggcttctaggtgtccctagttttctgggggtatctagcatggtggtgccaggcatggcacctttagttgacctttccatctgtgtaatatccaagatggcgccatctctagatctctagattgtgcctatctgctttttagctctttgtacagtggtgacgtttggctatatgaaaatcacataagttagtgtatcccttttttgctc

SEQ ID NO: 1319 - protein, 354 aa, Panicum virgatum
  misc_feature: Ceres CLONE ID no.1818502
  misc_feature: Bit score of 808.3 for HMM based on sequences of FIGURE 15.
  misc_feature (16)..(64): Pfam Name: F-box Pfam Description: F-box domain
  misc_feature: Functional Homolog Of Ceres SEEDLINE ID no. ME18314 at SEQ ID NO. 1277
MHPKARIHADPVLEVDQFDCLPDSLVLHILNKVEDVRSLGRCFTVSKRFCGLVSLVHDVYVKIDRVVAVDGDAEDTLNLSSPKPRNIFSHFLKLMLFTIIKPFHNMRNPNGNGRPLFAQLSQHSPAQVLWNFTHIRNLRVELPSGDVGTEEGVLLKWRAEYGSTLQSCVILGGTRVDRRPVGGEQEPSLEDNGSMPESFYTNGGLKLRVVWTISSLIAASTRHYLLRSIIKDHPTLTSLVLTDADGQGTLCMGAEQLKEFRENQLSASACSNRTQVPACNMKLKYAPYLELPGGIALQGATLVAIKPSTEGSNGGHTCRKETDAFISGAFDGPFKVAVKALMKRRTYLLEMNGF

SEQ ID NO: 1320 - DNA, 1575 bp, Panicum virgatum
  misc_feature: Ceres CLONE ID no.1750477
  misc_feature: Encodes the peptide sequence at SEQ ID NO. 1321
accaccatccccttcctacctcacctactctcccctcccctccccgcctcctcatcctccctgctccggccgcagcggcagcgagaatccgaggcgggcagcatgcagtccaagcaccggatcttcgcggaggacctgctcctcgccgcggagggggaggaccacttcgaccgggtgccggactcgctggtcctcatcatcttcaacaagctggccgacgcgcgctcgctgggccgctgctccgcggtgtcgcgccgcttcaacgcgctcgtcccgctcgtcgacgacgcctgcctccgcatcgaccgcgtcatcccggccgacggcgcggacggtgccggcgtcgacgcgctcggcctggccggggcgccgcgcccgcgcgccgtgctctcgcacctcctcaaggccatgctgcaggccgtgctcaagcccttcgcgcactgcgacgccaagtccggcgccggggcgcacggcgccaagcacgcgcagctgcagcaccactcgcccgcccaggtgctcaagaacttcagcagcatccggaacctccgcatggagctccccgtctccgacgtcggcaccgacgacggcgtcatcctcaagtggaaggccgtgttcggcagcacgctccagagctgcgtcatcctcggcggcaccaaggtggaacgggctgccgctgccggcacccacgacgcctctgtgcctgccgccgccgccgccgccgactctgatgccacgggcgacgacagcggcagcatcccggagtccttctacaccaacggcggcctcaagctgcgcgtggtctggaccatcagctccctcatcgccgcggccaccaggcaatacctcctccgcgagatcgtcaaggagcaccccaccctggagcaggttgcgctcacggacgcgcacggccagggcaccctcagcatggggcgcgaccagctcaaggagttcagggacaagccgctcgccgccgccgccgccgccaaccgcacgcaggtgcccgcctgcaacatgaagctccgctacgcgccgctgctggagctctccgacggcacgaggatccacggcgccacgctcgtggtcatcaagcccgtcggcgagaccggtggcatcggcggcggcaggaaggagctcgacgacttcgtcgccgacaccttcgacgggcccttcagggaggccgtgggagtcctcagcaagcgccgcacctacctgctcgagatgaacggcttctagtctagctaggctccacctccggacctccctcccgtgcactgcaagactgcaacggccagaacagcaaccacctccatggctccatggcaatgggcaatgacgactaggttgctctgctcgcttcagctcggcccggctcagagatcggcggcatactgaggtgttcctccttgtaacaatcaacgctgatgccgcgctcgatctctcatctctcgttactgccttggcatcgttgtgacacaataatcgaatggagtgggcagcacctgcagccactccattacattttggtgctatgatgaatggatgaatcaatggatggaaaaaaaaaaaaaaaaaaaa

SEQ ID NO: 1321 - protein, 376 aa, Panicum virgatum
  misc_feature: Ceres CLONE ID no.1750477
  misc_feature: Bit score of 586.6 for HMM based on sequences of FIGURE 15.
  misc_feature (20)..(68): Pfam Name: F-box Pfam Description: F-box domain
  misc_feature: Functional Homolog Of Ceres SEEDLINE ID no. ME18314 at SEQ ID NO. 1277
MQSKHRIFAEDLLLAAEGEDHFDRVPDSLVLIIFNKLADARSLGRCSAVSRRFNALVPLVDDACLRIDRVIPADGADGAGVDALGLAGAPRPRAVLSHLLKAMLQAVLKPFAHCDAKSGAGAHGAKHAQLQHHSPAQVLKNFSSIRNLRMELPVSDVGTDDGVILKWKAVFGSTLQSCVILGGTKVERAAAAGTHDASVPAAAAAADSDATGDDSGSIPESFYTNGGLKLRVVWTISSLIAAATRQYLLREIVKEHPTLEQVALTDAHGQGTLSMGRDQLKEFRDKPLAAAAAANRTQVPACNMKLRYAPLLELSDGTRIHGATLVVIKPVGETGGIGGGRKELDDFVADTFDGPFREAVGVLSKRRTYLLEMNGF

SEQ ID NO: 1322 - protein, 412 aa, Oryza sativa subsp. indica
  misc_feature: Public GI ID no.125552947
  misc_feature: Bit score of 956.7 for HMM based on sequences of FIGURE 15.
  misc_feature (33)..(81): Pfam Name: F-box Pfam Description: F-box domain
  misc_feature: Functional Homolog Of Ceres SEEDLINE ID no. ME18314 at SEQ ID NO. 1277
MAEDPAGSRRWRCDAGDEHGCWLSSSAGGGGDDHFDRLPDPLLLVIFNRIGDVKALGRCSLVSRRFHDLVPLVDSVLVRVDCVIPDDPASSSSSSSSPSAAPSSPTASARARTVFSQIARIVLGGIVKPIQALGQILSPANSASVLAASVTSSPSSSSSSSSSSPPLPGDVSHHSPSEVLRSFKELRRLRIELPAGELSMEEGVLLKWKADFGSTLGSCVILGASSAGKDGGAGAAPAVDCGESDETGSIPESFYTNGGLKLRVVWTISSLIAASARHYLLQPIIADHTTLESLDLTDADGQGVLTMDKWQLQELRVKPVSASGGSHRTLMPALSMRLWYAPHIELPGGLVLNGATLVAIKPTEEATRDTVGTGIAGSAGGCWVSDAFEEPYRTAVGMLLKRRTYSLEMNSF

SEQ ID NO: 1323 - protein, 660 aa, Oryza sativa subsp. indica
  misc_feature: Public GI ID no.125527862
  misc_feature: Bit score of 726.2 for HMM based on sequences of FIGURE 15.
  misc_feature (278)..(326): Pfam Name: F-box Pfam Description: F-box domain
  misc_feature: Functional Homolog Of Ceres SEEDLINE ID no. ME18314 at SEQ ID NO. 1277
MAHAFAGGTSAICRCPHDPGRAALVSRPRHRLCVLASSLPTPAIEGQGVELSVTTRRGRVLPVLKDCSLRVPPGQLWMLLGPNGCGKSTLLKVLAGFLNPSSGTVYINRPCSYVFQNPDHQVVMPTVESDVAFGLGKLNLSLDERPIQTLSGGQKQRVAIAGALAEASKVLLLDELTTFLDEYDQMGVIKAVRKSVGAGGEVSALWVTHRLEELRYADGAIYMEDGQTIIQERGTSAPSVWRSDGSVGIYRPHPVQSGLHRFIRMEGHEGGEEEGLGDQFERLPDEVLLDVFGRIGDVKALGRCALVSRRFHALVPLVDSVFVRVDCVISDDPPPSSAGSAQAAAAAEGGPPAARGRGALAHLARLVLGGIVRPIQALGQILSPAAATVSRRSAAPPAAPAPAAADVSHHSPSEVLRSFKELRRLHIELPTGELGIEDGVLLKWKADFGSTLGSCVILGASSVTSKPPPPPAAPPPTAADSSAASPDSSREPDELGNIPESLYTNGGLKLRVVWTISSLIAASARHYLLQPIIADHSTLESLDLTDADGQGVLTMDKRQLQELRVRPVSASGNSHRTLMPALSMRLWYAPHIELPGGQLLKGATLVAIRPSEDVLREGGGIEVAGLTGASWILDAFEEPYRTAAQVLLKRRTYSLEMNSF

SEQ ID NO: 1324 - protein, 400 aa, Oryza sativa subsp. indica
  misc_feature: Public GI ID no.125543660
  misc_feature: Bit score of 608.2 for HMM based on sequences of FIGURE 15.
  misc_feature (38)..(86): Pfam Name: F-box Pfam Description: F-box domain
  misc_feature: Functional Homolog Of Ceres SEEDLINE ID no. ME18314 at SEQ ID NO. 1277
MATRKNAEQRRGEAASVTSRHRVFAEDLLLPREAEGEDHFDRVPDSLVLLIFNRLADARSLGRCSAVSKRFNSLVPLVDDACLRIDRVITDAADADDALGLAGPRPAGRGVLSHLLKAMLLAVLKPFGHCDAGVRGGGGGERAGKHGGGGGGCGAQQHHSPAQVLKNFSSIRNLRMELPVSDVGTDDGVLLRWKAVFGSTLQSCVILGGTRVDRAAAPPAAAATATAAGDSEASQGDDTGSIPESFYTNGGLKLRVVWTISSLIAAATRHYLLREIVKEHPTLERVALTDAHGQGTLSMGRDQIREFRDKPLAAAAAANRTQVPACNMKLRYAPMLELSDGTRIQGATLVVIKPVGEAGGIGGGRKELDEFVADAFDGPYREAVRALSKRRTYLLEMNGF

SEQ ID NO: 1325 - protein, 353 aa, Oryza sativa subsp. indica
  misc_feature: Public GI ID no.125528123
  misc_feature: Bit score of 762.7 for HMM based on sequences of FIGURE 15.
  misc_feature (16)..(64): Pfam Name: F-box Pfam Description: F-box domain
  misc_feature: Functional Homolog Of Ceres SEEDLINE ID no. ME18314 at SEQ ID NO. 1277
MHPRARIHADPAPEFDQFDCLPDPVVLLILNKLEDVRSLGRCAAVSKRFSGLVPLVSDVYVKIDRVVATDGDADDALNLSSAKPKNIFSHFFKLMLFTIVKPFHSMRNLNGTGRPLFPLAQHSPVHVLRNFSDVWNLRVELPSGDVGTEEGVLLKWRAEYGSTLRNCVILGGTLVDRKPIGAEHESSVEDNGSIPESFYTNGGLKLRVVWTISSLIAASTRHYLLRSIIKDHPTLRSLVLADADGQGTLYMGMEQLREFRENKLSASACSNRTQVPACNMKLKYAPYLELPGGMTLQGATLVVIKPSNDGGSGGHSSRKETEAFVSSAFDEPFRFAVKALMKRRTYLLEMNGF

SEQ ID NO: 1326 - protein, 412 aa, Oryza sativa subsp. japonica
  misc_feature: Public GI ID no.115464819
  misc_feature: Bit score of 956.4 for HMM based on sequences of FIGURE 15.
  misc_feature (33)..(81): Pfam Name: F-box Pfam Description: F-box domain
  misc_feature: Functional Homolog Of Ceres SEEDLINE ID no. ME18314 at SEQ ID NO. 1277
MAEDPAGSRRWRCDAGDEHGCWLSSSAGGGGDDHFDRLPDPLLLVIFNRIGDVKALGRCSLVSRRFHDLVPLVDSVLVRVDCVIPDDPASSSSSSSSPSAAPSSPTASARARTVFSQIARIVLGGIVKPIQALGQILSPANSASVLAASVTSSPSSSSSSSSSSPPLPGDVSHHSPSEVLRSFKELRRLRIELPAGELSMEEGVLLKWKADFGSTLGSCVILGASSAGKDGGAGAAPAVDCGESDETGSIPESFYTNGGLKLRVVWTISSLIAASARHYLLQPIIADHTTLESLDLTDADGQGVLTMDKWQLQELRVKPVSASGGSHRTLMPALSMRLWYAPHIELPGGLVLNGATLVAIKPTEEATRDTVGSGIAGSAGGCWVSDAFEEPYRTAVGMLLKRRTYSLEMNSF

SEQ ID NO: 1327 - protein, 396 aa, Oryza sativa subsp. japonica
  misc_feature: Public GI ID no.115440195
  misc_feature: Bit score of 714.4 for HMM based on sequences of FIGURE 15.
  misc_feature (14)..(62): Pfam Name: F-box Pfam Description: F-box domain
  misc_feature: Functional Homolog Of Ceres SEEDLINE ID no. ME18314 at SEQ ID NO. 1277
MEGHEGGEEEGLGDQFERLPDEVLLDVFGRIGDVKALGRCALVSRRFHALVPLVDSVFVRVDCVISDDPPPSSAGSAQAAAAAEGGPPAARGRGALAHLARLVLGGIVRPIQALGQILSPAAATVSRRSAAPPAAPAPAAADVSHHSPSEVLRSFKELRRLHIELPTGELGIEDGVLLKWKADFGSTLGSCVILGASSVTSKPPPPPAAPPPTAADSSAASPDSSREPDELGNIPESLYTNGGLKLRVVWTISSLIAASARHYLLQPIIADHSTLESLDLTDADGQGVLTMDKRQLQELRVRPVSASGNSHRTLMPALSMRLWYAPHIELPGGQLLKGATLVAIRPSEDVLREGGGIEVAGPTGASWILDAFEEPYRTAAQVLLKRRTYSLEMNSF

SEQ ID NO: 1328 - protein, 384 aa, Oryza sativa subsp. japonica
  misc_feature: Public GI ID no.115452717
  misc_feature: Bit score of 599.0 for HMM based on sequences of FIGURE 15.
  misc_feature (22)..(70): Pfam Name: F-box Pfam Description: F-box domain
  misc_feature: Functional Homolog Of Ceres SEEDLINE ID no. ME18314 at SEQ ID NO. 1277
MQSRHRVFAEDLLLPREAEGEDHFDRVPDSLVLLIFNRLADARSLGRCSAVSKRFNSLVPLVDDACLRIDRVITDAADADDALGLAGPRPAGRGVLSHLLKAMLLAVLKPFGHCDAGVRGGGGGERAGKHGGGGGGCGAQQHHSPAQVLKNFSSIRNLRMELPVSDVGTDDGVLLRWKAVFGSTLQSCVILGGTRVDRAAAPAAAAATATAAGDSEASQGDDTGSIPESFYTNGGLKLRVVWTISSLIAAATRHYLLREIVKEHPTLERVALTDAHGQGTLSMGRDQIREFRDKPLAAAAAANRTQVPACNMKLRYAPMLELSDGTRIQGATLVVIKPVGEAGGIGGGRKELDEFVADAFDGPYREAVSALSKRRTYLLEMNGF

SEQ ID NO: 1329 - protein, 353 aa, Oryza sativa subsp. japonica
  misc_feature: Public GI ID no.115440629
  misc_feature: Bit score of 762.5 for HMM based on sequences of FIGURE 15.
  misc_feature (16)..(64): Pfam Name: F-box Pfam Description: F-box domain
  misc_feature: Functional Homolog Of Ceres SEEDLINE ID no. ME18314 at SEQ ID NO. 1277
MHPRARIHADPAPEFDQFDCLPDPVVLLILNKLEDVRSLGRCAAVSKRFSGLVPLVSDVYVKIDRVVATDGDADDALNLSSAKPKNIFSHFFKLMLFTIVKPFHSMRNLNGTGRPLFPLAQHSPVHVLRNFSDVWNLRVELPSGDVGTEEGVLLKWRAEYGSTLRNCVILGGTLVDRKPIGAEHESSVEDNGSMPESFYTNGGLKLRVVWTISSLIAASTRHYLLRSIIKDHPTLRSLVLADADGQGTLYMGMEQLREFRENKLSASACSNRTQVPACNMKLKYAPYLELPGGMTLQGATLVVIKPSNDGGSGGHSSRKETEAFVSSAFDEPFRFAVKALMKRRTYLLEMNGF

SEQ ID NO: 1330 - protein, 351 aa, Oryza sativa subsp. japonica
  misc_feature: Public GI ID no.115464599
  misc_feature: Bit score of 786.0 for HMM based on sequences of FIGURE 15.
  misc_feature (13)..(61): Pfam Name: F-box Pfam Description: F-box domain
  misc_feature: Functional Homolog Of Ceres SEEDLINE ID no. ME18314 at SEQ ID NO. 1277
MARIHADPVLEADQFDRLPDSLVLVILNNVEDVRSLGRCSAVSKRFYGLVPLVHDVYVKIDRVVTVDGEAEDALNLSSPKPRNILSHFLKMMLFTIIKPFHSMRGPNGAGRPLFPQLAQHSPAQVLRNFTHIRNLRVELPSGDVGTEEGVLLKWRAEYGSTLQNCVILGGTQVDRKPVGAEHELYSEDNGSMPESFYTNGGLKLRVVWTISSLIAASTRHYLLRSIIKDHPTLTSLVLTDADGQGTLSMGAEQLKEFRENQLSASACSNRTQVPACNMKLKYAPYLELPGGIALQGATLVAIKPSPEGSNGGHTSRKETDAFVSGAFDGPFKFAVKALMKRRTYLLEMNGF

SEQ ID NO: 1331 - protein, 451 aa, Oryza sativa subsp. japonica
  misc_feature: Public GI ID no.20161462
  misc_feature: Bit score of 739.7 for HMM based on sequences of FIGURE 15.
  misc_feature (108)..(156): Pfam Name: F-box Pfam Description: F-box domain
  misc_feature: Functional Homolog Of Ceres SEEDLINE ID no. ME18314 at SEQ ID NO. 1277
MGGILVPYVCGACGPGRTGGKRGFAIRGSEATKSRHDAPQSPASTVARGVGGVPGASWGWFFQAAAGSPELDPAEERISGKGAAKLLDGRLVVALRARIHADPAPEFDQFDCLPDPVVLLILNKLEDVRSLGRCAAVSKRFSGLVPLVSDVYVKIDRVVATDGDADDALNLSSAKPKNIFSHFFKLMLFTIVKPFHSMRNLNGTGRPLFPLAQHSPVHVLRNFSDVWNLRVELPSGDVGTEEGVLLKWRAEYGSTLRNCVILGGTLVDRKPIGAEHESSVEDNGSMPESFYTNGGLKLRVVWTISSLIAASTRHYLLRSIIKDHPTLRSLVLADADGQGTLYMGMEQLREFRENKLSASACSNRTQVPACNMKLKYAPYLELPGGMTLQGATLVVIKPSNDGGSGGHSSRKETEAFVSSAFDEPFRFAVKALMKRRTYLLEMNEQLQSCLE

SEQ ID NO: 1332 - protein, 386 aa, Oryza sativa subsp. japonica
  misc_feature: Public GI ID no.125586076
  misc_feature: Bit score of 546.1 for HMM based on sequences of FIGURE 15.
  misc_feature (38)..(86): Pfam Name: F-box Pfam Description: F-box domain
  misc_feature: Functional Homolog Of Ceres SEEDLINE ID no. ME18314 at SEQ ID NO. 1277
MATRKNAEQRRGEAASVTSRHRVFAEDLLLPREAEGEDHFDRVPDSLVLLIFNRLADARSLGRCSAVSKRFNSLVPLVDDACLRIDRVITDAADADDALGLAGPRPAGRGVLSHLLKAMLLAVLKPFGHCDAGVRGGGGGERAGKHGGGGGGCGAQQHHSPAQLPVSDVGTDDGVLLRWKAVFGSTLQSCVILGGTRVDRAAAPAAAAATATAAGDSEASQGDDTGSIPESFYTNGGLKLRVVWTISSLIAAATRHYLLREIVKEHPTLERVALTDAHGQGTLSMGRDQIREFRDKPLAAAAAANRTQVPACNMKLRYAPMLELSDGTRIQGATLVVIKPVGEAGGIGGGRKELDEFVADAFDGPYREAVSALSKRRTYLLEMNGF

SEQ ID NO: 1333 - DNA, 1783 bp, Panicum virgatum
  misc_feature: Ceres CLONE ID no.1823216
  misc_feature: Encodes the peptide sequence at SEQ ID NO. 1334
acaatagagtgcgagccgacctcctccccatctctctctactctctctctctaccgctcctcgtgacgtcgcgtgcccacgtctcccacgccccctgtccctactcctcctcctcctccagatccggtctccccagccgccgccgatgtccgaagatctagcgggatcccgccgctggcggtgcgacctcggcggcgatgaccgctggctgtcgggggccgccggcgacgaccacttcgaccgcctccccgacgcgctcctcctcgtcatcttcaaccgcatcggcgacgtcaaggcgctcggccgctgctccatcgtctcccgccgcttccacgagctcgtccccctcgtcgactccgccctcgtccgcgtcgactgcgtcatccccgacgagcccccctcctcctcctcgccgtccgcgccgtcctcccccacggcctccgtacgcgcccgcggggtcttctcgcagattgcgcgcatcgtgctcggcggcatcgtgaagcccatccaggcgctcggccagatcctctcacctgcccactctgcctccggcttttcagcatcctccgcttcctcgtcgtcatccttccccccatcttcgacgtcgtactcgccgttgcctcctggggacgtgtcacaccactcgccctcggaggtgctccgctccttcaaggagctccgccaccttcgcattgagcttccggcgggtgagcttggcacggacgacggcgtgatgctcaagtggaaggctgacttcgggtccacgctcggcagctgcgtcatcctcggcgcatcctcggcctcgccgtcccctgctggctcagatggcgcgagcacagctccctctgttgacagtggccgcagcgagcctgaggaatgtgacgattcaggaagcatcccggaatccttctatacaaatggggggctgaggctgcgggtggtgtggataatcagctcgctgattgcagcagcagggaggcattacttgctgcagccaatcgttgctgaccacacaacgctggaaagattggacctgacggatgcagatgggcagggagtgctcaccatggacaagtgccaactgcaggagctgcgggtgagaccggtatcatcatctgcggcctcacaccggaccctcatgccggagcttagcatgtggctgtggtacgcaccatgcattgagctgcctggggggttggtgctaactggtgcgactttggtagccatcaagccgagcgaggaggcaacaagggacatggtagggaatggggctgctacggcagcctgggttttagatgcattcgaggagccatacagaacagcagcgaggatgcttctcaagcggaggacttacacccttgagatgaattcattctaatccatagaggaggtggcattttggaagcttcatatatgagaggatgttatacctacaagggtcatttctggctgcctttttataccccaatctgcactattctggatgtgttccaattgtgttggatgcattcctttccatgctgaggatctgccagcattcaagcaagaacatggatggaaatgaagagaatccgggcgttaatttatcgatgctggagtagagaggcaaagccattgttgagctggtgtttgctctgagggaactcccttatcactgagatcagatgtggtgacatagataaattttttttcttatatgtatccacatcaaggaactaaccttatgtaatttctgctttggatcgcactgcttatttgcataatagcatccgatgtgccctgt

SEQ ID NO: 1334 - protein, 410 aa, Panicum virgatum
  misc_feature: Ceres CLONE ID no.1823216
  misc_feature: Bit score of 883.8 for HMM based on sequences of FIGURE 15.
  misc_feature (29)..(77): Pfam Name: F-box Pfam Description: F-box domain
  misc_feature: Functional Homolog Of Ceres SEEDLINE ID no. ME18314 at SEQ ID NO. 1277
MSEDLAGSRRWRCDLGGDDRWLSGAAGDDHFDRLPDALLLVIFNRIGDVKALGRCSIVSRRFHELVPLVDSALVRVDCVIPDEPPSSSSPSAPSSPTASVRARGVFSQIARIVLGGIVKPIQALGQILSPAHSASGFSASSASSSSSFPPSSTSYSPLPPGDVSHHSPSEVLRSFKELRHLRIELPAGELGTDDGVMLKWKADFGSTLGSCVILGASSASPSPAGSDGASTAPSVDSGRSEPEECDDSGSIPESFYTNGGLRLRVVWIISSLIAAAGRHYLLQPIVADHTTLERLDLTDADGQGVLTMDKCQLQELRVRPVSSSAASHRTLMPELSMWLWYAPCIELPGGLVLTGATLVAIKPSEEATRDMVGNGAATAAWVLDAFEEPYRTAARMLLKRRTYTLEMNSF

SEQ ID NO: 1335 - DNA, 1278 bp, Sorghum bicolor
  misc_feature: Ceres ANNOT ID no.6040230
  misc_feature: Encodes the peptide sequence at SEQ ID NO. 1336
atgtccgaagatcccgcgggatcccgccgctggcggtgcgacctcggcggcgacgagcgctggctctcgggggccgccggcgacgaccacttcgaccgcctccccgacgcgttgctcctcgtcatcttcaaccgcatcggcgacgtcaaggcgctcggccgctgctccctcgtctcccgccgcttccacgagctcgtgcccctcgtcgactccgtcgtcgtccgcgtcgactgcgtcatccccgacgagcccccctcctcgtcgtcctccccgtcggcgccgtcctctcctacggcgtccgtgcgcgcccgcggggtcttctcacagatcgcgcgcatcgtgctcggcggcatcgtgaagcccattcaggcgctcggtcagatcctctcccccgccaactccgcctccggctttccggcatcctccacttcctcgccatcgtcgtcgtcctccgcctcgccactgcctgctggggacgtgtcccaccactctccctcggaggtgctccgctccttcaaggagctccgccaccttcgcatcgagctcccggcgggcgagctcggcatggacgacggcgtgatgctcaagtggaaggctgacttcgggtccacactgggcagctgcgtcatccttggagcatcctcggcctcgacctcgacctcgacctcgacctcgacctcgacctcgaccttgccctcgccctcgccctccgctggctcagagggcgcgagctccgctccctctgttgacgatgctggccgcacagagcctgatgattgtgacgattcaggaagcatccctgagtcgttctacacaaacggggggtttaagctgcgggtggtttggacaatcagctcgctgattgcagccgccgcgaggcattacttgctgcagcccatcattgctgatcacaggatgctcgagagcttggacctgacagatgctgatggccagggagtgctcaccatggacaagtgccaactgcaagagctgagggtgataccaatatcaacatctaggggctcacaccggacgctcatgccagagcttagcatgtggttgtggtacgcaccatgtattgagctgcctggggggttagtgctgaatggcgcaacactggtggccatcaagccaagtgaggaaggaacaggggacacagtttggaatggggctgatggtgcagcttgggtgttggatgcattcgaggagccgtataggacagcggtgaggatgcttctcaagcggaggacctacagccttgagatgaattcattctaa

SEQ ID NO: 1336 - protein, 425 aa, Sorghum bicolor
  misc_feature: Ceres ANNOT ID no.6040230
  misc_feature: Bit score of 921.6 for HMM based on sequences of FIGURE 15.
  misc_feature (29)..(77): Pfam Name: F-box Pfam Description: F-box domain
  misc_feature: Functional Homolog Of Ceres SEEDLINE ID no. ME18314 at SEQ ID NO. 1277
MSEDPAGSRRWRCDLGGDERWLSGAAGDDHFDRLPDALLLVIFNRIGDVKALGRCSLVSRRFHELVPLVDSVVVRVDCVIPDEPPSSSSSPSAPSSPTASVRARGVFSQIARIVLGGIVKPIQALGQILSPANSASGFPASSTSSPSSSSSASPLPAGDVSHHSPSEVLRSFKELRHLRIELPAGELGMDDGVMLKWKADFGSTLGSCVILGASSASTSTSTSTSTSTSTLPSPSPSAGSEGASSAPSVDDAGRTEPDDCDDSGSIPESFYTNGGFKLRVVWTISSLIAAAARHYLLQPIIADHRMLESLDLTDADGQGVLTMDKCQLQELRVIPISTSRGSHRTLMPELSMWLWYAPCIELPGGLVLNGATLVAIKPSEEGTGDTVWNGADGAAWVLDAFEEPYRTAVRMLLKRRTYSLEMNSF

SEQ ID NO: 1337 - DNA, 1257 bp, Sorghum bicolor
  misc_feature: Ceres ANNOT ID no.6015489
  misc_feature: Encodes the peptide sequence at SEQ ID NO. 1338
atggagctggaggcggcgccgcggcagcagcagcagctggaggaggaggaggaggaggtggtggggtgcacatgcggcggcggggccgaggccgcggaccagttcgagcggctccacgacgcggtgctgctcgacgtcctcaaccgcatcggcgacgtcaaggcgctgggccgctgcgccctcgtctcgcgccgcttccacgcgctcgtgccgctcgtcgactccgtcttcgtccgcgtcgactgcgtcatccccgacgacccgacgccctccgccgccgccgccgcaccgggctccgcgccgcaccaggccccggccacggccgcgcgcgggcgcggcggcgcgctcgcgcacatggcgcgcgtcctgctcggcggcatcgccaggcccatccacgcgctcggccagatcctctcccccgccgcggcggccgtctcccggcgctccgacccaccactgcccgcttccccgcccgcgcccgtcgcggacgtctcccaccactcgccctccgaggtgctccgctccttcagggagctgcggcgcctccacatcgagctgcccacgggcgagctcggcattgacgacggcgtgctccttaagtggaaggccgacttcggctccaccctcggcagctgcgtcatcctcggcgcctcgtcggtcttgtccaagccgcccacagggtcgaccacccaggcggaacctgctgcggccgacagcacggccgccgctctggataccagtagggagactgaagagccggggagcctgcctgattctctctacacaaatggagggctcaagcttcgcgttgtctggaccatcagctccctgattgctgcgtcggcgaggcattacttgctgcacccgattatctgtaatcacgaaacgctggagagcttggacctgacagatgccgacggccaaggggtgctcaccatggacaagaggcagctgcaggaactgcgggtgcggcccgtctctccgtcggggagctcgcaccgcacactcatgccggcactcagtatgcgtctgcactatgcaccgctcattgagctgcctgggggaacgctgctgaagggcgcgacactggttgcgatcagaccaagcgaggatgccttgagggagggccaaggggctggggctgcaggtcctgttggtacatgctggatttcagaggcctttgaggagccatatcggactgcggcaaaggtgcttctcaagagaagggcatattgccttgaaatgaactcgttctga

SEQ ID NO: 1338 - protein, 418 aa, Sorghum bicolor
  misc_feature: Ceres ANNOT ID no.6015489
  misc_feature: Bit score of 718.8 for HMM based on sequences of FIGURE 15.
  misc_feature (33)..(81): Pfam Name: F-box Pfam Description: F-box domain
  misc_feature: Functional Homolog Of Ceres SEEDLINE ID no. ME18314 at SEQ ID NO. 1277
MELEAAPRQQQQLEEEEEEVVGCTCGGGAEAADQFERLHDAVLLDVLNRIGDVKALGRCALVSRRFHALVPLVDSVFVRVDCVIPDDPTPSAAAAAPGSAPHQAPATAARGRGGALAHMARVLLGGIARPIHALGQILSPAAAAVSRRSDPPLPASPPAPVADVSHHSPSEVLRSFRELRRLHIELPTGELGIDDGVLLKWKADFGSTLGSCVILGASSVLSKPPTGSTTQAEPAAADSTAAALDTSRETEEPGSLPDSLYTNGGLKLRVVWTISSLIAASARHYLLHPIICNHETLESLDLTDADGQGVLTMDKRQLQELRVRPVSPSGSSHRTLMPALSMRLHYAPLIELPGGTLLKGATLVAIRPSEDALREGQGAGAAGPVGTCWISEAFEEPYRTAAKVLLKRRAYCLEMNSF

SEQ ID NO: 1339 - DNA, 1257 bp, Sorghum bicolor
  misc_feature: Ceres ANNOT ID no.6042890
  misc_feature: Encodes the peptide sequence at SEQ ID NO. 1340
atggagctggaggcggcgccgcggcagcagcagcagcagctggaggaggaggtggaggtggtggggtgcccatgcggcggcgggtccgaggccgcggaccagttcgagcggctccacgacgcggtgctgctcgacgtcctcaaccgcatcggcgacgtcaaggcgctgggccgctgcgccctcgtctcgcgccgcttccacgcgctcgtgccgctcgtcaactccgtcttcgtccgcgtcgactgcgtcatccccgacgacccgacgccctccgccgccgccgccgcaccgggctccccgacgcaccaggccccggccccggccgcgcgcgggcgcggcggcgcgctcgcgcacatggcgcgcgtcctgctcggcggcatcgccaagcccatccacgcgctcgcccagatcctctcccccgccgcggcggccgtctcccggcgctccgacccaccactgcccgcttccccgcccgcacccgtcgcggacgtctcccaccactcgccctccgaggtgctccgctccttcagggagctgcggcgcctccacatcgagctgcccacgggcgagctcggcattgacgacggtgtgctccttaagtggaaggccgacttcggctccaccctcggcagctgcgtcatcctcggcgcctcgtcggtcttgtccaagccgcccacagggtcgaccacccaggcggaacctgctgcggccgacagcacggccgccgctccggataccagtagggagactgaagagccggggagcctgcctgattctctctacacaaatggaggcctcaagcttcgcgttgtctggaccatcagctccctgattgctgcgtcggcgaggcattactcgctgcacccgattatctgtaatcacgaaacgctggagagcttggacctgacagatgccgacggccaaggggtgctcaccatggacaagaggcagctgcaggaactgcgggtgcggcccgtctctccgtcagagagctcgcaccgcacactcatgccggcactcagtatgcgtctgcactatgcaccgctcattgagctgcctgggggaaccctgctgaagggcgcgacactggttgcgatcagaccaagcgaggatgccttgagcgagggccaaggggctggggctgcaggtcctgttggtacatgctggatttcagaggcccttgaggagccatatcggactgctgcaaaggtgcttctcaagagaagggcatattgccttgaaatgaactcgttctga

SEQ ID NO: 1340 - protein, 418 aa, Sorghum bicolor
  misc_feature: Ceres ANNOT ID no.6042890
  misc_feature: Bit score of 698.4 for HMM based on sequences of FIGURE 15.
  misc_feature (33)..(81): Pfam Name: F-box Pfam Description: F-box domain
  misc_feature: Functional Homolog Of Ceres SEEDLINE ID no. ME18314 at SEQ ID NO. 1277
MELEAAPRQQQQQLEEEVEVVGCPCGGGSEAADQFERLHDAVLLDVLNRIGDVKALGRCALVSRRFHALVPLVNSVFVRVDCVIPDDPTPSAAAAAPGSPTHQAPAPAARGRGGALAHMARVLLGGIAKPIHALAQILSPAAAAVSRRSDPPLPASPPAPVADVSHHSPSEVLRSFRELRRLHIELPTGELGIDDGVLLKWKADFGSTLGSCVILGASSVLSKPPTGSTTQAEPAAADSTAAAPDTSRETEEPGSLPDSLYTNGGLKLRVVWTISSLIAASARHYSLHPIICNHETLESLDLTDADGQGVLTMDKRQLQELRVRPVSPSESSHRTLMPALSMRLHYAPLIELPGGTLLKGATLVAIRPSEDALSEGQGAGAAGPVGTCWISEALEEPYRTAAKVLLKRRAYCLEMNSF

SEQ ID NO: 1341 - DNA, 1065 bp, Sorghum bicolor
  misc_feature: Ceres ANNOT ID no.6040033
  misc_feature: Encodes the peptide sequence at SEQ ID NO. 1342
atgcatcccaaggctcgaatccacgccgacccggtgcgcgaggtcgaccacttcgactgcctgccggattcgctcgtcctgctgatcctgaacaaggtcgaggacgtgcgatcgctcggccggtgctacgccgtgtccaagcgcctctgtgggcttgttccccttgtccatgatgtgtatgtcaagattgaccgcgtcgtggcggtcgacggcgacgccgaggacactctcaacctgtcctcgcccaagcctcggaacatcttctcgcacttcctcaagctgatgctcctcacaatcatcaagccgttccacagcatgcgcaaccctaacggtactgggagaccattgttcccgcagctctcgcagcactcgccagcacaggtgctcaggaacttcacgcacgtcaggaatcttcggattgagctcccctctggggatgtgggtactgaggagggagttctgctgaaatggcgggcagagtatgggagcacacttcagaattgtgtgatcctcgggggtacccgggttgaccgcaagcctgttggtggagagcatgagccatctttggaggataatgggagcatgccagagtctttctataccaatggtgggctgaaacttcgtgttgtctggacaatcagctctctaattgcggcatcaacgaggcactatcttctccgctcaatcatcaatgaccatcccacacttcggagcttggtactaacagatgccgatggccaaggcacattgtgcatgggggcagagcagctgaaggagttcagagagaaccagttgtctgcctcagcgtgttctaacaggactcaggtcccagcctgcaacatgaagctcaagtatgctccatatcttgagctgcctggtggtatggcgttgcaaggcgctactttggtggctatcaaaccctcacctgagggaagcaatggaggccatcctaaccgtaaggaagccgacgggtttgtgtttggagcatttgatgggccatttaaggctgctgtgaaggcactgatgaagagacgtacttaccttctggagatgaatggcttctag

SEQ ID NO: 1342 - protein, 354 aa, Sorghum bicolor
  misc_feature: Ceres ANNOT ID no.6040033
  misc_feature: Bit score of 798.9 for HMM based on sequences of FIGURE 15.
  misc_feature (16)..(64): Pfam Name: F-box Pfam Description: F-box domain
  misc_feature: Functional Homolog Of Ceres SEEDLINE ID no. ME18314 at SEQ ID NO. 1277
MHPKARIHADPVREVDHFDCLPDSLVLLILNKVEDVRSLGRCYAVSKRLCGLVPLVHDVYVKIDRVVAVDGDAEDTLNLSSPKPRNIFSHFLKLMLLTIIKPFHSMRNPNGTGRPLFPQLSQHSPAQVLRNFTHVRNLRIELPSGDVGTEEGVLLKWRAEYGSTLQNCVILGGTRVDRKPVGGEHEPSLEDNGSMPESFYTNGGLKLRVVWTISSLIAASTRHYLLRSIINDHPTLRSLVLTDADGQGTLCMGAEQLKEFRENQLSASACSNRTQVPACNMKLKYAPYLELPGGMALQGATLVAIKPSPEGSNGGHPNRKEADGFVFGAFDGPFKAAVKALMKRRTYLLEMNGF

SEQ ID NO: 1343 - DNA, 1143 bp, Sorghum bicolor
  misc_feature: Ceres ANNOT ID no.6018414
  misc_feature: Encodes the peptide sequence at SEQ ID NO. 1344
atgcagtccaagcaccggatcttcgcggaggacctgctcctcgcggcggagggcgaggaccacttcgaccgggtgccggactccctggtgctcctcatcttcaacaagctcgccgacgcgcgctccctcgggcgctgctccgcggtgtcgcgccgcttcaacgcgctcgtcccgctcgtcgacgacgcctgcctccgcatcgaccgcgtcatccccgccgacgccgccgacggcggcgacgcgctgggcggcctcgcgggcgggccgcgcccgcgcgccgtgctgtcgcacctactcaaggccatgctgcaggccgtgctcaagcccttcgcgcactgcgacgccaagtccgcggcgcacaagcacgcgctgctgcagcaggggcagcagcagcaccactcgccggcgcaggtgctcaagaacttcagcagcatccgcaacctccgcatggagctccccgtgtccgacgtcggcaccgacgacggcgtcgtcctcaagtggaaggccgtgttcggcagcacgctgcagagctgcgtcatcctcggcggcaccaaggtggaacgggctgccagtggcagtgccaacgcctccgccgctcctcccccagctccccacgccgacgctggcgacgccgcggccgcgggcggccctgacgacagcggcagcatcccggagtccttctacaccaacggcgggctgaagctgcgcgtggtgtggaccatcagctccctcatcgccgcggccaccaggcactacctcctccgcgagatcgtcaaggagcaccccaccctggagcaggtggcgctcacggacgccaacgggcagggcacgctcagcatggggcgcgaccagctcagggagttcagggacaagccgctcgccgcggccgccgccgccaaccgcacgcaggtgcccgcctgcaacatgaagctccgctacgcgccgctgctcgagctctctgacggcaccaggatccacggcgccacgctcgtggtcatcaagcccgtcggcgacgccgcgggcgtcggcggcaggaaggagctcgacgagttcgtcgccggcgccttcgacgggcccttcagggaggccgtggccgcgctcagcaagcgccgcacctacctgctcgagatgaatggcttctag

SEQ ID NO: 1344 - protein, 380 aa, Sorghum bicolor
  misc_feature: Ceres ANNOT ID no.6018414
  misc_feature: Bit score of 592.0 for HMM based on sequences of FIGURE 15.
  misc_feature (20)..(68): Pfam Name: F-box Pfam Description: F-box domain
  misc_feature: Functional Homolog Of Ceres SEEDLINE ID no. ME18314 at SEQ ID NO. 1277
MQSKHRIFAEDLLLAAEGEDHFDRVPDSLVLLIFNKLADARSLGRCSAVSRRFNALVPLVDDACLRIDRVIPADAADGGDALGGLAGGPRPRAVLSHLLKAMLQAVLKPFAHCDAKSAAHKHALLQQGQQQHHSPAQVLKNFSSIRNLRMELPVSDVGTDDGVVLKWKAVFGSTLQSCVILGGTKVERAASGSANASAAPPPAPHADAGDAAAAGGPDDSGSIPESFYTNGGLKLRVVWTISSLIAAATRHYLLREIVKEHPTLEQVALTDANGQGTLSMGRDQLREFRDKPLAAAAAANRTQVPACNMKLRYAPLLELSDGTRIHGATLVVIKPVGDAAGVGGRKELDEFVAGAFDGPFREAVAALSKRRTYLLEMNGF

SEQ ID NO: 1345 - DNA, 1380 bp, Arabidopsis thaliana
  misc_feature: Ceres SEEDLINE ID no.ME18408
  misc_feature: Genomic Sequence
  misc_feature: Expected Sequence
  misc_feature: Encodes the peptide sequence at SEQ ID NO. 1347
aatcaacaccaacgaacacaaccttttccaaagccaataataaaagaacaaaagcttttagtttcatcaaagacgaagctgccttagaaatggagttggatcttggtctatctctttcacctcataaatcttccaagttagggtttaactttgacctcaacaagcattgtgcgatcgagggtgctgcgtcttgtttgggtaccgaaaaactgcgttttgaggcgacgtttgggttagggaatgtggaggaaaattgttatatgccaaaacagcgtttgtttgccttgaatggccagcccaacgaggaagacgaagatcctctggaatccgagtcttcaatagtttacgagtgagtaccttgactattttagtatttgacaacaattaggttaaagtagttacatctagtattattatataataaatgactccgtagttttcaaaaatgttatgatgttgtagacttgtagttaactcaatggagaggcataatttgtatttttttgtaacatataattaattttaatatttagtgatgaggaggaaaatagcgaagttgttggatggccaccagtaaaaacatgtatgataaagtatggtagttatcatcatcgtcatattcgtaatcaccatcattgcccgtatcatcatcgtggtaggaggatcacggcgatgaacaacaacatatctaatccaacaacggctactgtgggatcatcatcttcttcgtcaatatcatcaagatcatcaatgtatgttaaggttaagatggatggtgtggcaatagcaagaaaagtggatatcaagctttttaactcttacgagtccctcactaactccttgatcactatgtttaccgaatgtaagtactaattacgtttatcaaaatctagagtaagaaacctataaacaattgaaaatagaacgtaactttttactactattgaatctaattttgggttatcagatgaagattgcgacagagaagatacaaattatacattcaccttccaagggaaagagggtgactggctacttcgaggggatgttacatggaagtaagtttacttctctatatttcaagaaaaatgacttattgagtaatgactactatactctctttcttatatattgatacttaacttgttgttttggttttgtaggatctttgcggaatctgttcatcggatatcaataattagagatcgaccgtgtgcatatacaagatgtttgttttaaggataggcgttcaaatcggaccattattttttattttgtaattaaaatgtctatcatttgattaaatttccactcgatctttttcctctattcttctagttcttagtatcaaatccaatggtttataatctgttgttatct

SEQ ID NO: 1346 - DNA, 756 bp, Arabidopsis thaliana
  misc_feature: Ceres SEEDLINE ID no.ME18408
  misc_feature: Predicted Sequence
  misc_feature: Encodes the peptide sequence at SEQ ID NO. 1347
atggagttggatcttggtctatctctttcacctcataaatcttccaagttagggtttaactttgacctcaacaagcattgtgcgatcgagggtgctgcgtcttgtttgggtaccgaaaaactgcgttttgaggcgacgtttgggttagggaatgtggaggaaaattgttatatgccaaaacagcgtttgtttgccttgaatggccagcccaacgaggaagacgaagatcctctggaatccgagtcttcaatagtttacgatgatgaggaggaaaatagcgaagttgttggatggccaccagtaaaaacatgtatgataaagtatggtagttatcatcatcgtcatattcgtaatcaccatcattgcccgtatcatcatcgtggtaggaggatcacggcgatgaacaacaacatatctaatccaacaacggctactgtgggatcatcatcttcttcgtcaatatcatcaagatcatcaatgtatgttaaggttaagatggatggtgtggcaatagcaagaaaagtggatatcaagctttttaactcttacgagtccctcactaactccttgatcactatgtttaccgaatatgaagattgcgacagagaagatacaaattatacattcaccttccaagggaaagagggtgactggctacttcgaggggatgttacatggaagatctttgcggaatctgttcatcggatatcaataattagagatcgaccgtgtgcatatacaagatgtttgttttaa

SEQ ID NO: 1347 - protein, 251 aa, Arabidopsis thaliana
  misc_feature: Ceres SEEDLINE ID no.ME18408
  misc_feature: Bit score of 543.8 for HMM based on sequences of FIGURE 16.
  misc_feature (160)..(232): Pfam Name: AUX_IAA Pfam Description: AUX/IAA family
MELDLGLSLSPHKSSKLGFNFDLNKHCAIEGAASCLGTEKLRFEATFGLGNVEENCYMPKQRLFALNGQPNEEDEDPLESESSIVYDDEEENSEVVGWPPVKTCMIKYGSYHHRHIRNHHHCPYHHRGRRITAMNNNISNPTTATVGSSSSSSISSRSSMYVKVKMDGVAIARKVDIKLFNSYESLTNSLITMFTEYEDCDREDTNYTFTFQGKEGDWLLRGDVTWKIFAESVHRISIIRDRPCAYTRCLF

SEQ ID NO: 1348 - DNA, 690 bp, Populus balsamifera subsp. trichocarpa
  misc_feature: Ceres ANNOT ID no.1452612
  misc_feature: Encodes the peptide sequence at SEQ ID NO. 1349
atggaagtagagaagggaacaaagatgcggtttgaggagacagagctaaggctagggttaccagggaatggtggagggggtactgaaggaggggagttcgcaaggaagagaggattctctgagactgtggacttgaagctcaatctttcttccaaggaggggggtattgatccaaatcatgagaagactcaaagggagaagaaccttctggccactgatccagcaaaacctccagctaaggcacaggttgtgggttggcctccagtcagatctttccgaaagaacatgttagctgtccaaaaaagcagcaccgatcaggagagtactgacaaggttcctgggggcaatgcaacctttgtgaaggttagcatggatggcgcaccttacctccgtaaagtggacctgaagatgtacaagacctaccacgagctctctgatgccttgggcaaaatgttcagttccttcaccataggcaactgtggatcccatggaatgaaagatttcctgaatgaaagcaagctcatagatcttcttaatggcaccgactatgttccaacttatgaagataaggacggtgactggatgctcgtcggagatgtcccatgggacatgtttgttgaatcatgcaagcggctgcgaataatgaaaggaacggaggcgactggacttggtaatgagtatacagcataa

SEQ ID NO: 1349 - protein, 221 aa, Populus balsamifera subsp. trichocarpa
  misc_feature: Ceres ANNOT ID no.1452612
  misc_feature: Bit score of 233.4 for HMM based on sequences of FIGURE 16.
  misc_feature (1)..(218): Pfam Name: AUX_IAA Pfam Description: AUX/IAA family
  misc_feature: Functional Homolog Of Ceres SEEDLINE ID no. ME18408 at SEQ ID NO. 1347
MRFEETELRLGLPGNGGGGTEGGEFARKRGFSETVDLKLNLSSKEGGIDPNHEKTQREKNLLATDPAKPPAKAQVVGWPPVRSFRKNMLAVQKSSTDQESTDKVPGGNATFVKVSMDGAPYLRKVDLKMYKTYHELSDALGKMFSSFTIGNCGSHGMKDFLNESKLIDLLNGTDYVPTYEDKDGDWMLVGDVPWDMFVESCKRLRIMKGTEATGLGNEYTA

SEQ ID NO: 1350 - DNA, 1098 bp, Glycine max
  misc_feature: Ceres CLONE ID no.520455
  misc_feature: Encodes the peptide sequence at SEQ ID NO. 1351
agagagagaaagagtcataataaagtgaaagaaaaagaaaaaggagagtagtgaaacaagaagaaaggagaagaagatggtgtttgaggaaaytgagctgaggcttggactgagactaggactccctggaaatggagccgcgccaacaactgaagctgctgcggaattaggagtgaggaagagagggttctctgaaactgaaaccgatgaaacaacctccgttgatttgatgcttaacctctctcccaaggaagcttctgctgctgctactactgatggagcagatccacgtgagaatccaaagacttcgccgaaggacaagaatcttcctcttctcgatcccgcaaagcctcctgccaaggcgcaagtggtgggatggccacctgtaaggtctttccggaagaacatgtttgcagcccaaaagagcagcggcggagaggaaagcgagaagaacagccctaatgcaagctttgtcaaagttagcatggatggagcaccttacctccgcaaagttgacttgaagatgtacaagagttaccctgagctctctgatgccttgggcaaaatgtttagctccttcaccattggaaattgtgaatcccaaggcttcaaggatttcatgaatgagagcaagttgatggatcttctgaacagctccgactatgtcccgacctatgaagacagggatggcgactggatgcttgtcggtgatgtgccatgggagatgtttgttgaatcatgcaagcgtttacgtatcatgaaaggaaaggaagctattggactggcaccaagagccgtggagaaatgcaagaacaggagctagactagtagtaatttccagtccaaaacctgctccatcatcgttagtggtgcccagtagatcgacttagcaactgaagaagcaaggttaagctgcagcagacacagatcgacagagcagggtgttaaaaatatagttaattaaatctgtgtatcattaattatggtttgttatgtaatatatatttcaaacaaagttgtgagatgtcttaagtataaattatgaacagaaacgatataataactctaaattatgttgcaagactttcttatttattt

SEQ ID NO: 1351 - protein, 248 aa, Glycine max
  misc_feature: Ceres CLONE ID no.520455
  misc_feature: Bit score of 224.3 for HMM based on sequences of FIGURE 16.
  misc_feature (1)..(240): Pfam Name: AUX_IAA Pfam Description: AUX/IAA family
  misc_feature: Functional Homolog Of Ceres SEEDLINE ID no. ME18408 at SEQ ID NO. 1347
  misc_feature (6)..(6): Xaa is any aa, unknown, or other
MVFEEXELRLGLRLGLPGNGAAPTTEAAAELGVRKRGFSETETDETTSVDLMLNLSPKEASAAATTDGADPRENPKTSPKDKNLPLLDPAKPPAKAQVVGWPPVRSFRKNMFAAQKSSGGEESEKNSPNASFVKVSMDGAPYLRKVDLKMYKSYPELSDALGKMFSSFTIGNCESQGFKDFMNESKLMDLLNSSDYVPTYEDRDGDWMLVGDVPWEMFVESCKRLRIMKGKEAIGLAPRAVEKCKNRS

SEQ ID NO: 1352 - protein, 233 aa, Oryza sativa subsp. japonica
  misc_feature: Public GI ID no.75271810
  misc_feature: Bit score of 220.2 for HMM based on sequences of FIGURE 16.
  misc_feature (4)..(227): Pfam Name: AUX_IAA Pfam Description: AUX/IAA family
  misc_feature: Functional Homolog Of Ceres SEEDLINE ID no. ME18408 at SEQ ID NO. 1347
MAGLGFDETELRLGLPGAGELAARSSGKRGFAETIDLKLKLQPAAPAAVSGEEGAQEDKEDADAAAAAADEKMSMKRSASQSSVVTAEPDPDKPRAPKAQVVGWPPVRSFRKNVLAEKCKAAALVKVSMDGAPYLRKIDVAMYKSYPELSMAFQNMFTSFTIGKCGSHQQLKESNKLRDDLEYVPTYEDKDGDWMLVGDVPWEMFVESCKRLRIMKGSEAIGLAPRAVEKCKS

SEQ ID NO: 1353 - protein, 197 aa, Oryza sativa subsp. japonica
  misc_feature: Public GI ID no.115489446
  misc_feature: Bit score of 236.2 for HMM based on sequences of FIGURE 16.
  misc_feature (3)..(196): Pfam Name: AUX_IAA Pfam Description: AUX/IAA family
  misc_feature: Functional Homolog Of Ceres SEEDLINE ID no. ME18408 at SEQ ID NO. 1347
MENLKATELRLGLPGTEEEAAPPPSTPRAGSKRALAGEPDQAKIKPAAAAKAQVVGWPPVRSYRKSCLQPTTTTTKSKPPPAAAAAETQQKEDVAGAGGLFVKVSMDGAPYLRKIDLKVYKGYRELREALEAMFLCFSGGAAADAAVNPSDFAVTYEDKDGDLMLVGDVPFEMFISTCKRLRIMKGSEARGLGATRG

SEQ ID NO: 1354 - DNA, 1001 bp, Zea mays subsp. mays
  misc_feature: Ceres CLONE ID no.499878
  misc_feature: Encodes the peptide sequence at SEQ ID NO. 1355
acggcctctctgccttttccttttccttcccccgctttctccttccttcctcccccctccccgctcccctcgcccagccaccggccatgtcggtggagacggagcgcagctccaccgagtcctccggggcctccgggctcgacttcgaggacaccgcgctcacgctcaccctccgcctcccgggctccgcgccttccgccgccgcggcctccctgtccctctcctcctcgtcgtcctccgccttccccgaccccgaccgcaagcgcgcctcctccgacgccgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctccaggcgtacgccggctacgaccagctgctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgttcgtggaaacctgccagcgccttcgtctgatgaaaggttcagaggccgtgaacttggcaccgagagccgcccgatgaggcacactccgttgggcgttggcacgcactggcgtcttgaaggaaagcgggaactctgctggtcttgatgaggatcttcacgtgagataggaacgtgtgtacagttgtcgccttatggtattgagttgaggaaacttggaggttccattacttgtctgtagtctctactttatatagatgcgaagaagcttgagatacacattgcctacaatgtcttttgatgaataagaccagacagcaccgataaaaaaaaaaaaaaaa

SEQ ID NO: 1355 - protein, 217 aa, Zea mays subsp. mays
  misc_feature: Ceres CLONE ID no.499878
  misc_feature: Bit score of 179.5 for HMM based on sequences of FIGURE 16.
  misc_feature (75)..(215): Pfam Name: AUX_IAA Pfam Description: AUX/IAA family
  misc_feature: Functional Homolog Of Ceres SEEDLINE ID no. ME18408 at SEQ ID NO. 1347
MSVETERSSTESSGASGLDFEDTALTLTLRLPGSAPSAAAASLSLSSSSSSAFPDPDRKRASSDADPGRSSPLAASSDAAPAPKARVVGWPPVRSYRKNALADAAGSSKAAKFVKVAVDGAPYLRKVDLQAYAGYDQLLRALQDKFFSHFTIRKFADDERKLVDAVNGTEYVPTYEDKDGDWMLVGDVPWKMFVETCQRLRLMKGSEAVNLAPRAAR

SEQ ID NO: 1356 - DNA, 570 bp, Populus balsamifera subsp. trichocarpa
  misc_feature: Ceres ANNOT ID no.1491840
  misc_feature: Encodes the peptide sequence at SEQ ID NO. 1357
atggcacaacctcttggactagaaatcacagagctaaggttgggtccaccgggcagcgaaaatggaccaaaaaatgaaaagaaaagggttttctcagagttgtccggcgaagcaaacagcacaaccgatgggcgaaaaacccaaacaacgagtcaagttgtggggtggccaccagtatgttcctatcgaaagaagaatagtttcaatgagaaagatagccatgaaacttcaaaaatttacgtgaaagttagtatggacggagctccttttctcagaaaagttgatttgggcatgcacaaggagtattcggatcttgttgtcgcgttggagaagttgtttggctgttttggaatcggcaaagccttgaaggatacagacgactgcgaatacgttcccatatatgaagacaaggatggagactggatgctagtgggagacgtgccttgggagatgtttattgagtcttgcaagaggctaaggataatgaagaggtcagaagccaagggttttggactgcagccaagaggtgctcttcagcagggaaatatttcaaaagatgatcgtgactga

SEQ ID NO: 1357 - protein, 189 aa, Populus balsamifera subsp. trichocarpa
  misc_feature: Ceres ANNOT ID no.1491840
  misc_feature: Bit score of 245.4 for HMM based on sequences of FIGURE 16.
  misc_feature (5)..(173): Pfam Name: AUX_IAA Pfam Description: AUX/IAA family
  misc_feature: Functional Homolog Of Ceres SEEDLINE ID no. ME18408 at SEQ ID NO. 1347
MAQPLGLEITELRLGPPGSENGPKNEKKRVFSELSGEANSTTDGRKTQTTSQVVGWPPVCSYRKKNSFNEKDSHETSKIYVKVSMDGAPFLRKVDLGMHKEYSDLVVALEKLFGCFGIGKALKDTDDCEYVPIYEDKDGDWMLVGDVPWEMFIESCKRLRIMKRSEAKGFGLQPRGALQQGNISKDDRD

SEQ ID NO: 1358 - protein, 240 aa, Oryza sativa subsp. japonica
  misc_feature: Public GI ID no.125587204
  misc_feature: Bit score of 202.8 for HMM based on sequences of FIGURE 16.
  misc_feature (4)..(234): Pfam Name: AUX_IAA Pfam Description: AUX/IAA family
  misc_feature: Functional Homolog Of Ceres SEEDLINE ID no. ME18408 at SEQ ID NO. 1347
MAGLGFDETELRLGLPGAGELAARSSGKRGFAETIDLKLKLQPAAPAAVSGEEGAQEDKEDADAAAAASRREDVDEEVGEPEQRGHRGARSRQAARAQNAYMSIRAQVVGWPPVRSFRKNVLAEKCKAAALVKVSMDGAPYLRKIDVAMYKSYPELSMAFQNMFTSFTIGKCGSHQQLKESNKLRDDLEYVPTYEDKDGDWMLVGDVPWEMFVESCKRLRIMKGSEAIGLAPRAVEKCKS

SEQ ID NO: 1359 - DNA, 1235 bp, Zea mays subsp. mays
  misc_feature: Ceres CLONE ID no.320997
  misc_feature: Encodes the peptide sequence at SEQ ID NO. 1360
gctcccaccccacctcaccatctccactccaaacaaggggaaggcgagcgacagacaaacccaccccatcgcccctcctctgtctcctctcttgcccacgcccgccccaatgtcgccgcccctcgagccccacgactacatcggcctctccgccgcggccgcggccgcgccgccgaccccgacctcctcctcctcttcctcctcctcgccggccccccgcctcacccttcgcctcggcctgccgggctccgagtcccccgaccgcgaccgggactgctgcgaggacttcgccgccacgctctccctcggcccgctgccggcggcagccgccgtctccgccaagcgcgccttcccggaccccgcccagcgccccggcgcttccaaggctagcgacgccaagcagcaggcttcccccgccgcgccgccggccgccaaagcgcaggtggttggatggccgcccgtgcgcaactaccggaagaataccctcgccgccgcgaccgcctccaggagcaaggcgccggcggaggaggccgcgtccggagctgggcccatgtacgtaaaggtgagcatggatggcgcgccctacctcaggaaggtggacatcaagatgtactccagctacgaggacctctccctggcgctcgagaagatgttcagctgcttcatcgctggtcaaagtggtctgcataaatcatcgagcaaagacaggctgaccaatggctcaaaggtggatgccctcaaagatcaggagtatgtccttacatatgaggataaggatgcagactggatgcttgtcggtgatcttccctgggattattttacctctatctgccggaagctcaaaatcatgaggggctctgatgctgttggaatagctccacgaaccgtcgagcagacaggtcagaacaaataagctttggcctttgcctgcatccaaggaagacatctgagctagctgggagactatgttgaaggctgaagcctgaaatagttgccgggaatcgtcaaaacccgtcaaatgtttagtgtagttttcacgtgtccttgagacatgtgcatttgtatgtctgtgacgtgatccgttagatcgtgcaatcgtaggttgctgttcttgtgccctttaaaggccagacagatcagggagctctctgcttccttagtgcacttgctttgcagcattccttgttattctactctgaaatcatacatcatgccacaagaaccgatggttcgcg

SEQ ID NO: 1360 - protein, 267 aa, Zea mays subsp. mays
  misc_feature: Ceres CLONE ID no.320997
  misc_feature: Bit score of 212.9 for HMM based on sequences of FIGURE 16.
  misc_feature (40)..(259): Pfam Name: AUX_IAA Pfam Description: AUX/IAA family
  misc_feature: Functional Homolog Of Ceres SEEDLINE ID no. ME18408 at SEQ ID NO. 1347
MSPPLEPHDYIGLSAAAAAAPPTPTSSSSSSSSPAPRLTLRLGLPGSESPDRDRDCCEDFAATLSLGPLPAAAAVSAKRAFPDPAQRPGASKASDAKQQASPAAPPAAKAQVVGWPPVRNYRKNTLAAATASRSKAPAEEAASGAGPMYVKVSMDGAPYLRKVDIKMYSSYEDLSLALEKMFSCFIAGQSGLHKSSSKDRLTNGSKVDALKDQEYVLTYEDKDADWMLVGDLPWDYFTSICRKLKIMRGSDAVGIAPRTVEQTGQNK

SEQ ID NO: 1361 - DNA, 690 bp, Populus balsamifera subsp. trichocarpa
  misc_feature: Ceres ANNOT ID no.1455585
  misc_feature: Encodes the peptide sequence at SEQ ID NO. 1362
atggagcttcaactaggtctttcccttccaacctacaattttattgaaaactttgacctgaacaatggtgggtttgagcccaaagatcagatgcttggttcgaaaccatggatcagctgcgaagatggtaattacttggacaacaaacgtagctttgaagtagcctttgaaaagaatatcaaagatgcatctcaagaattgcctttacttttatggagtggccaaccaaatgatgaagatgattggaatggagagaagaaaatctctcgtagcattaacaaggatgatgaagaggaaaatcaagttgtggggtggccacctattaagtcatggaggaagaaggtgcttcatcaccagcatcaagctggtcatgttgtgaatagtactagaatggcaacagctgggaattatgaatatggtactggatcaaactccaagtatgtcaaggtgaagatggaaggagtagcaataacaagaaagattgatttaaggctctacaactcttaccagacactcacaaaatccttgatcagcatgtttgcaaaatgcaaaaaccttgaaaaagatgctgcacgttacagtctgacataccaagacaaagatggggactggctaattgcaggagatgttccatggcagactttcatggagtctgtgcagcgtttgaagatagtaaggaatgctggttaa

SEQ ID NO: 1362 - protein, 229 aa, Populus balsamifera subsp. trichocarpa
  misc_feature: Ceres ANNOT ID no.1455585
  misc_feature: Bit score of 269.6 for HMM based on sequences of FIGURE 16.
  misc_feature (100)..(225): Pfam Name: AUX_IAA Pfam Description: AUX/IAA family
  misc_feature: Functional Homolog Of Ceres SEEDLINE ID no. ME18408 at SEQ ID NO. 1347
MELQLGLSLPTYNFIENFDLNNGGFEPKDQMLGSKPWISCEDGNYLDNKRSFEVAFEKNIKDASQELPLLLWSGQPNDEDDWNGEKKISRSINKDDEEENQVVGWPPIKSWRKKVLHHQHQAGHVVNSTRMATAGNYEYGTGSNSKYVKVKMEGVAITRKIDLRLYNSYQTLTKSLISMFAKCKNLEKDAARYSLTYQDKDGDWLIAGDVPWQTFMESVQRLKIVRNAG

SEQ ID NO: 1363 - DNA, 555 bp, Populus balsamifera subsp. trichocarpa
  misc_feature: Ceres ANNOT ID no.1499460
  misc_feature: Encodes the peptide sequence at SEQ ID NO. 1364
atggcacaacctcttggacttgaaatcacagagctaaggttgggtctaccgggcagcgatgatggacataaaaatgacaagaaaagggttttctctgaggtgtccggcgaagcaaacagcacaaccgatgaccgaaaagttcaaacaaagagtcaagttgtggggtggccaccagtttgttcgtatcgaaaaaacattagtttcaatgagagagatcgccatcatgaaacttcaaaaatttacgtgaaagtaagcatggatggagctccttttcttcgaaaaattgatttgggcatgcataaagagtattcggatcttgttgtcgcgttggagaggttgtttggctgttatggaattggcaaagccttgaaggatgaatacgttcccatatatgaagacaaggatggagactggatgctagtgggagacgtgccttgggagatgttttttgagtcttgcaagaggctaaggatcatgaagagttcagaagccaaaggttttgggctgcagccaagaggcgctcttaagggaatttcaaaagatgaacgtcactga

SEQ ID NO: 1364 - protein, 184 aa, Populus balsamifera subsp. trichocarpa
  misc_feature: Ceres ANNOT ID no.1499460
  misc_feature: Bit score of 237.4 for HMM based on sequences of FIGURE 16.
  misc_feature (5)..(170): Pfam Name: AUX_IAA Pfam Description: AUX/IAA family
  misc_feature: Functional Homolog Of Ceres SEEDLINE ID no. ME18408 at SEQ ID NO. 1347
MAQPLGLEITELRLGLPGSDDGHKNDKKRVFSEVSGEANSTTDDRKVQTKSQVVGWPPVCSYRKNISFNERDRHHETSKIYVKVSMDGAPFLRKIDLGMHKEYSDLVVALERLFGCYGIGKALKDEYVPIYEDKDGDWMLVGDVPWEMFFESCKRLRIMKSSEAKGFGLQPRGALKGISKDERH

SEQ ID NO: 1365 - DNA, 1179 bp, Zea mays subsp. mays
  misc_feature: Ceres CLONE ID no.334484
  misc_feature: Encodes the peptide sequence at SEQ ID NO. 1366
cccctctgccttttccttttccttccccgctttctccttccttcctccccactccccgctcccctcgcccagccactggccatgtcggtggagacggagcggagctccaccgagtcctccggggcttccgggctcgacttcgaggacaccgcgctcacgctcaccctccgcctcccgggctccgcgccttccgccgccgccgccgccgcggcctccctgtccctctcctcctcgtcgtcctccgccttccccgaccccgaccgcaagcgcgcgtcctccgacgccgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctgcaggcgtacgccggctacgaccagctgctccgcgcgctccaggacaagttcttctcccacttcaccatsaggaagttcgccgacgacgagaggaagctggtggacgcggtgaacgggacggagtacgtgcccacgtacgaggacaaggatggcgactggatcctcgtcggcgacgtcccctggaagatgttcgtggaaacctgccagcgccttcgtctgatgaaaggttcagaggccgtgaacttggcaccgagagccgcccgatgaggcacactagctccgttgggcgttggcacgcacgcacgcactggcgtcttgaaggaaagcgggaactctgctggtcttgatgaggatcttcacgtgagataggaacgtgtgtacagttgtcgccttatggtattgagttgaggaaacttggaagttccattacttgtctgtagtctctactttatatagatgcgaagaagcttgagatacacattgcctacaatgtcttttgatgaataagaccagacagcaccgaaccgaactcgtccttccacatctccacacggttgctttgccatctcggtggttttgtggtggtggtggtggtggtggtcgtgcttcctataggtgtgaggctgatggcgtggctgccatttatacaatctttaatcctgttttgttgagctttattatatggttttgttttgagagtcc

SEQ ID NO: 1366 - protein, 220 aa, Zea mays subsp. mays
  misc_feature: Ceres CLONE ID no.334484
  misc_feature: Bit score of 174.2 for HMM based on sequences of FIGURE 16.
  misc_feature (78)..(218): Pfam Name: AUX_IAA Pfam Description: AUX/IAA family
  misc_feature: Functional Homolog Of Ceres SEEDLINE ID no. ME18408 at SEQ ID NO. 1347
  misc_feature (155)..(155): Xaa is any aa, unknown, or other
MSVETERSSTESSGASGLDFEDTALTLTLRLPGSAPSAAAAAAASLSLSSSSSSAFPDPDRKRASSDADPGRSSPLAASSDAAPAPKARVVGWPPVRSYRKNALADAAGSSKAAKFVKVAVDGAPYLRKVDLQAYAGYDQLLRALQDKFFSHFTXRKFADDERKLVDAVNGTEYVPTYEDKDGDWILVGDVPWKMFVETCQRLRLMKGSEAVNLAPRAAR

SEQ ID NO: 1367 - protein, 224 aa, Zea mays
  misc_feature: Ceres CLONE ID no.100819481
  misc_feature: Bit score of 212.9 for HMM based on sequences of FIGURE 16.
  misc_feature (7)..(223): Pfam Name: AUX_IAA Pfam Description: AUX/IAA family
  misc_feature: Functional Homolog Of Ceres SEEDLINE ID no. ME18408 at SEQ ID NO. 1347
METVVGDLMATELRLGLPGTVDDCSQHQQQTQLKVAAPPSNPTRGKKRPAAEEEEANKRDAEAAPPAAKAPVVGWPPVRSYRKSCFQQAKQQAVSSSSKAADKEDAAAPAPSCTASAAASNATASAGAGSFVKVSMDGAPYLRKLDLRMYKGYRELREALEAMFVSSGSANNNNNLSEFAVTYQDKDGDLMLVGDVPFEMFASTCRKLRIMKRSEATGLGSARQ

SEQ ID NO: 1368 - protein, 212 aa, Oryza sativa subsp. japonica
  misc_feature: Public GI ID no.115462401
  misc_feature: Bit score of 183.9 for HMM based on sequences of FIGURE 16.
  misc_feature (18)..(211): Pfam Name: AUX_IAA Pfam Description: AUX/IAA family
  misc_feature: Functional Homolog Of Ceres SEEDLINE ID no. ME18408 at SEQ ID NO. 1347
MSVETERSSTESSAASGLDFEDTALTLRLPGSSSSSSSSSSSSSSSSPSEPDRKRASATDDDPDNRLGSTATESPPSPKARVVGWPPVRAFRKNALAALAAASSSKAKFVKVAVDGAPYLRKVDLEAYRGYDQLLAALQDKFFSHFTIRKLGNEEMKLVDAVSGNEYVPTYEDKDGDWMLVGDVPWKMFVETCQRLRLMKSSEAVNLAPRSA

SEQ ID NO: 1369 - DNA, 1151 bp, Zea mays
  misc_feature: Ceres CLONE ID no.1448136
  misc_feature: Encodes the peptide sequence at SEQ ID NO. 1370
aaacacacacaacaccagtcaccagctcatcacatccatctcattctactactgcctcagagaccaagctgctgcaaccggagaaggagatctactctactcttcagagcactgtgcattgggacatggaaaccgtcgtgggagacctcatggcgaccgagctgaggcttggcctgccgggcaccgtggacgactgcagccagcaccagcagcagacccagctgaaggtggccgcgccgccgtccaaccctactaggggcaagaagcgccccgccgccgaggaggaggaggcaaacaagcgcgacgcggaggcagcacccccggcggccaaggcgcccgtggtcggatggccaccggtgaggtcataccggaagagctgcttccagcaggcaaagcagcaggccgtctgcagcagcagcagcaaggcggccgacaaagaggatgctgcggcgccggcgcccagctgcacggcgtccgcagccgcctcaaacgccaccgccagcgccggggccggctcattcgtcaaggtgagcatggacggcgccccgtacctgcggaagctcgacctgaggatgtacaaggggtaccgggagctccgggaggccctggaggccatgttcgtctcctccggcagcgctaacgccaacaacaacctgtccgagttcgccgtcacctaccaggacaaggacggcgacctcatgctcgtcggagacgtgccgttcgagatgttcgctagcacctgcaggaagctgaggatcatgaagagatctgaagccacaggcctgggatcggcgagacaatgaagaaggtctgacgacgactgagggcccgacaacgttcatgtcgatctcttcttttttttttctttttgccccattattttattttgttcttcttgttcgagagaccccaagccaaaaggatgagcttggtggcgcatcaatctacaaagcgcatgcatatacgcggatgtgtgtgcggctttggttctgtaagacgacgactagagtagctaggtcttttttagcagcagcacagaaggagatgcatgctgatgacgaggttgtttcggcttagctctccctctccatatgctgtgtttgtacaaaccaaacaatacagttatcttcatcgtaaaaaaaaaaaaaaaa

SEQ ID NO: 1370 - protein, 225 aa, Zea mays
  misc_feature: Ceres CLONE ID no.1448136
  misc_feature: Bit score of 211.9 for HMM based on sequences of FIGURE 16.
  misc_feature (7)..(224): Pfam Name: AUX_IAA Pfam Description: AUX/IAA family
  misc_feature: Functional Homolog Of Ceres SEEDLINE ID no. ME18408 at SEQ ID NO. 1347
METVVGDLMATELRLGLPGTVDDCSQHQQQTQLKVAAPPSNPTRGKKRPAAEEEEANKRDAEAAPPAAKAPVVGWPPVRSYRKSCFQQAKQQAVCSSSSKAADKEDAAAPAPSCTASAAASNATASAGAGSFVKVSMDGAPYLRKLDLRMYKGYRELREALEAMFVSSGSANANNNLSEFAVTYQDKDGDLMLVGDVPFEMFASTCRKLRIMKRSEATGLGSARQ

SEQ ID NO: 1371 - DNA, 1151 bp, Zea mays subsp. mays
  misc_feature: Ceres CLONE ID no.277751
  misc_feature: Encodes the peptide sequence at SEQ ID NO. 1372
acacacaacaccagtcaccagctcatcacatccatctcattctactactgcctcagagaccaagctgctgcaaccggagaaggagatctattctacaaagtgaagtacttggcttgggacatggaaaccgtcgtgggagacctcatggcgaccgagctgaggcttggcctgccgggcwccgtggacgactgcagccagcaccagcagcagacccagctgaaggtggccgcgccgccgtccaaccctactaggggcaagaagcgcgccgccgccgaggaggaggcagacaagcgcgacgcggaggcagcacccccggcggccaaggcgcccgtggtcggatggccaccggtgaggtcgtaccggaagagctgcttccagcaggcaaagcagcaggccgtcagcagcagcagcagcaaggcggccgacaaagaggatgctgcggcgccggcgccgagctgcacggcttccgcagccgcctcaaacgccaccgccggcgccggggccggctcattcgtcaaggttagcatggacggcgccccgtacctgcggaagctcgacctgaggatgtacaagggctaccgggagctccgggaggccctggaggccatgttcgtctcctccggcagcgccaacgacaaaaacctgtcggagtttgccgtcacctaccaggacaaggacggcgacctcatgctcgtcggagacgtgccgttcgagatgttcgctagcacctgcaggaagctgaggatcatgaagagatctgaagccacaggcctgggatcggcgaggcaatgaagaaggtctgaccacgaccgagggcccgacaacgttcatgtcgatctctctctctctctctctctctctcttctttttttttttgccccattattttattttgttcttcttgttcgggagaccccaagccaaaaggatgagcttggtggcgcatcaatctacaaagcgcatgcatatacgcggatgtgtgtgcggctttggttctgtaagacgacgactagtagagctaggtctttttttagcagcagcacagaaggagatgcatgctgatgacgaggttgtttcggcttagctctccatatgctgtgtttgtacaaaccaaacaatacagttatcttcaccgtcgtttgatcccttat

SEQ ID NO: 1372 - protein, 223 aa, Zea mays subsp. mays
  misc_feature: Ceres CLONE ID no.277751
  misc_feature: Bit score of 213.6 for HMM based on sequences of FIGURE 16.
  misc_feature (7)..(222): Pfam Name: AUX_IAA Pfam Description: AUX/IAA family
  misc_feature: Functional Homolog Of Ceres SEEDLINE ID no. ME18408 at SEQ ID NO. 1347
  misc_feature (20)..(20): Xaa is any aa, unknown, or other
METVVGDLMATELRLGLPGXVDDCSQHQQQTQLKVAAPPSNPTRGKKRAAAEEEADKRDAEAAPPAAKAPVVGWPPVRSYRKSCFQQAKQQAVSSSSSKAADKEDAAAPAPSCTASAAASNATAGAGAGSFVKVSMDGAPYLRKLDLRMYKGYRELREALEAMFVSSGSANDKNLSEFAVTYQDKDGDLMLVGDVPFEMFASTCRKLRIMKRSEATGLGSARQ

SEQ ID NO: 1373 - DNA, 576 bp, Populus balsamifera subsp. trichocarpa
  misc_feature: Ceres ANNOT ID no.1491839
  misc_feature: Encodes the peptide sequence at SEQ ID NO. 1374
atgtcaccggaaaatggttcaaacttgctggaatccgatgcggccaacgtgagtttcaaggagacagagttgaccttagggctgcctggtgagtctcgtgggctagcattaatagagaaaacaagtggcaagcgtgggtttttggagactgttgatctaaatcttggaagagcacaagtggtggggtggccaccggtgagggcgtataggaagaacgcaatgaagagctgtaaatacgtgaaggtggctgtagatggagctccatatttgagaaaggttgacctggagatgtacaacagttatcagcagctcttgaatgccctccaggacatgttctcttgcttcagcttcaccatccgcaactatttgaatgagaggacaattatggaacaggaagtgaataatggagtagagtatgtccctacttatgaggacaaggatggcgactggatgatgctgggggatgtaccatggaaaatgtttgttgaatcatgcaagcgtctacggttgatgaaaagctcagaagcaactggatttgctccaagaacaccttcaaaatgctcaagctcgagttga

SEQ ID NO: 1374 - protein, 191 aa, Populus balsamifera subsp. trichocarpa
  misc_feature: Ceres ANNOT ID no.1491839
  misc_feature: Bit score of 166.9 for HMM based on sequences of FIGURE 16.
  misc_feature (17)..(183): Pfam Name: AUX_IAA Pfam Description: AUX/IAA family
  misc_feature: Functional Homolog Of Ceres SEEDLINE ID no. ME18408 at SEQ ID NO. 1347
MSPENGSNLLESDAANVSFKETELTLGLPGESRGLALIEKTSGKRGFLETVDLNLGRAQVVGWPPVRAYRKNAMKSCKYVKVAVDGAPYLRKVDLEMYNSYQQLLNALQDMFSCFSFTIRNYLNERTIMEQEVNNGVEYVPTYEDKDGDWMMLGDVPWKMFVESCKRLRLMKSSEATGFAPRTPSKCSSSS

SEQ ID NO: 1375 - protein, 186 aa, Zea mays
  misc_feature: Ceres CLONE ID no.100913241
  misc_feature: Bit score of 155.9 for HMM based on sequences of FIGURE 16.
  misc_feature (46)..(184): Pfam Name: AUX_IAA Pfam Description: AUX/IAA family
  misc_feature: Functional Homolog Of Ceres SEEDLINE ID no. ME18408 at SEQ ID NO. 1347
MSVDTERSSTESSAASGLGYEDTALALTLRLPGSDPGRSSPLAAPSDAAPSPKTRVVGWPPVRSYRKNALADSSKANRSASFVKVAVDGAAYLRKVDLQAYGGYDQLLRALQDKFFSHFTIRKFADDERKLVDAVNGTEYVPTYEDKDGDWMLVGDVPWKMFVETCRRLRLMKGSEAVNLAPRAAR

SEQ ID NO: 1376 - DNA, 1052 bp, Triticum aestivum
  misc_feature: Ceres CLONE ID no.1053224
  misc_feature: Encodes the peptide sequence at SEQ ID NO. 1377
agagccgccgcctgtgaccgaccggagagccagacgacaaaccgagcccaccgcaccaacaccaactcctcctcctcttgcgcggctgcagctgccggccatgtcggtggagacggagcggagctccacggagtcctccgccgcctcgggcctcgacttcgaggacaccgccctcaccctccgcctccccggctccgaccccgaccgcaagcgcgcctccacctccgaccccgactgcccctccccgaccgccgccgcctccgactctcccccttcccccaaggcgcaggtggtgggctggccaccggtgcggtcgttccggaagaacgccctcgcggccgcggcctcgtccaagaccaagttcgtcaaggtggccgtcgacggcgcgccctacctgcgcaaggtcgacctcaaggcttacgctggctacacaagctctgcctcctacgaccagctcctcgccacgctccaggacaagttcatctcccacctcaccgtccgaaagcttgggaacgaggagatgaagctcgtggacgcggtgagcgggacggaatatgttccgacgtacgaggacaaggacggcgactggatgctcgtcggagacgtcccctggagaatgtttgtggagacctgccagcgcattcgtctcatgaaaagctccgaggttgtcaatctagcaccaagagctggtcggtgaggcacaatccttgctcctttttctacagaccgcttcagaggaagaaatgtctttgctcagtgaggttcttccgcaagtttccgagagagaaatgtgtacagccatctctactttttgcccagcacgctattgagttcagaaagtgtcgtagcttgtaattccactaccagtcagtcagtagtatctacatgtaagatggagaggttgtgatgcttcagaaatacacctacagttcgttcttgaaaaataagactgtggtccctgttctcccgagctgcttgctactggagcatggttttgtgtaactttatgcaagtgaggcacctggtacaagagtcgaaaaaaaaaaaaaaaa

SEQ ID NO: 1377 - protein, 198 aa, Triticum aestivum
  misc_feature: Ceres CLONE ID no.1053224
  misc_feature: Bit score of 143.7 for HMM based on sequences of FIGURE 16.
  misc_feature (18)..(196): Pfam Name: AUX_IAA Pfam Description: AUX/IAA family
  misc_feature: Functional Homolog Of Ceres SEEDLINE ID no. ME18408 at SEQ ID NO. 1347
MSVETERSSTESSAASGLDFEDTALTLRLPGSDPDRKRASTSDPDCPSPTAAASDSPPSPKAQVVGWPPVRSFRKNALAAAASSKTKFVKVAVDGAPYLRKVDLKAYAGYTSSASYDQLLATLQDKFISHLTVRKLGNEEMKLVDAVSGTEYVPTYEDKDGDWMLVGDVPWRMFVETCQRIRLMKSSEVVNLAPRAGR

SEQ ID NO: 1378 - DNA, 1025 bp, Zea mays
  misc_feature: Ceres CLONE ID no.425766
  misc_feature: Encodes the peptide sequence at SEQ ID NO. 1379
ataaactcaaccacctccggagtccggacctcccccgttggccttctccatccggccatccccttcgcccttcctcactctctgtctcagtctctctccggcctccctcgcccacagagtcagagcggaagccgccgatctcggagcccagcacgccgccgccagccatgtcggtggatacggagcggagctccaccgagtcgtccgcggcctccgggctcggctacgaggacaccgcgctcgccctcaccctccgcctcccgggctccgaccccgggcgttcctccccgctcgccgcgccctccgacgctgcgccgtctcccaaggcgcgggtggtggggtggccgccggtgaggtcgtacctcaagaacgcgctcgccgactccagcaaggccagccgggcagccaatttcgtgaaggtggccgtcgacggcgcgccctacctgcggaaggtggacctccaggcgtacggcggctacgaccagctcctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgttcgtggagacctgccggcgccttcgcctgatgaaagattcagaggccgttaacttggcaccaagagccgcccgatgaggcgcaagcgcaactccaccgtcaccagtatgcactggcttttagtggcttggcttgttggaggaacgagggaacgtacttcgtcgctgttttgaggatcttcacttgacatatatatagcaatgtgtacagctgtcacctgctgcttttgcctgaggaaagtttgtagttccattactttacttatctgtagtgtctatctatctatctatagatccgaagctttgatatacacatggcggctacaatgtatttttgatgaataagaccagaccagagtaccagacacaccgaacc

SEQ ID NO: 1379 - protein, 186 aa, Zea mays
  misc_feature: Ceres CLONE ID no.425766
  misc_feature: Bit score of 150.8 for HMM based on sequences of FIGURE 16.
  misc_feature (46)..(184): Pfam Name: AUX_IAA Pfam Description: AUX/IAA family
  misc_feature: Functional Homolog Of Ceres SEEDLINE ID no. ME18408 at SEQ ID NO. 1347
MSVDTERSSTESSAASGLGYEDTALALTLRLPGSDPGRSSPLAAPSDAAPSPKARVVGWPPVRSYLKNALADSSKASRAANFVKVAVDGAPYLRKVDLQAYGGYDQLLRALQDKFFSHFTIRKFADDERKLVDAVNGTEYVPTYEDKDGDWMLVGDVPWKMFVETCRRLRLMKDSEAVNLAPRAAR

SEQ ID NO: 1380 - DNA, 1239 bp, Zea mays
  misc_feature: Ceres CLONE ID no.485480
  misc_feature: Encodes the peptide sequence at SEQ ID NO. 1381
aacgacgagcagtgcaagccaagcattctcacgctagctgttctcttcttgcctcatccatcgtgcatctatattctcggcgcgagttacgtctttttcgtcgtccggccggcgagcattttgcttctgtgatcgatcggcgcgcgcgacgtacggccatggagatgatcgacgcagagctgcgtctgggtccgcccggcagcagcaacagagacgtcatcaacgtcgtgcagccttcgttggcggcggcgaaacggccgtcgtcgtcggtggtggagagcgaggcgtccgggacggacgaccatgaccatgacgacgccgcaccgacctccaaggtgcaggtggtggggtggccgccggtgagagtgtaccggaagaacgcgttccacgcggcggcggaggcgaggaggaccaggcggggcgagcagcagggaggaggaggcctgtacgtgaaggtgagcatggacggggcgccatacctccggaaggtggacctgcggacctacggcggctaccgtgagctgagggacgcgctggacgcgctcttcggctgcttctcctcctcggccgacggcggatgccagttcgccgtcgcctacgaggacaaggacggcgacctcatgctcgccggcgacgtgccatgggagatgttcatctgttcttgcaagaagctcaggatcatgagggggtccgaagcaagataaccaagcaacgaggatgcaaggacctgttgtatgcatatgcatggaggccggccggactcatgctgtcatgcatgagagtttgagagaggagaagaagacgacctactggaactgaaggcggttgggtatacctgcatggggagggagcccacgcatgcacgcgcgcgtcgtcgtgttctacggccagctagccaccagaccggctgccggcccatatgcacaccacggagatggaggtgatggttcaaggatcacggcggcgtacgcgcgcgtcatcagtcacgccgtcctgtcatcagatgagatggaggggtgatgcatgagggcagtgctagctgtggacggctggctggacgtgcagatcggagcgagattgtactgtgcacgcacataagctttgtacagtggcatgtgctggtcatctgtaattttgatttttttccccctccttttgtaagtgagcaagtttgaggaaaaaatgtatgaatgaagaaaaggagaggggggatttcaaattcgaaaaaaaaaaaaaaaa

SEQ ID NO: 1381 - protein, 181 aa, Zea mays
  misc_feature: Ceres CLONE ID no.485480
  misc_feature: Bit score of 201.3 for HMM based on sequences of FIGURE 16.
  misc_feature (1)..(181): Pfam Name: AUX_IAA Pfam Description: AUX/IAA family
  misc_feature: Functional Homolog Of Ceres SEEDLINE ID no. ME18408 at SEQ ID NO. 1347
MEMIDAELRLGPPGSSNRDVINVVQPSLAAAKRPSSSVVESEASGTDDHDHDDAAPTSKVQVVGWPPVRVYRKNAFHAAAEARRTRRGEQQGGGGLYVKVSMDGAPYLRKVDLRTYGGYRELRDALDALFGCFSSSADGGCQFAVAYEDKDGDLMLAGDVPWEMFICSCKKLRIMRGSEAR

SEQ ID NO: 1382 - DNA, 791 bp, Glycine max
  misc_feature: Ceres CLONE ID no.474845
  misc_feature: Encodes the peptide sequence at SEQ ID NO. 1383
actgtttgagagcacacaaacaatgtcctccgaatcacacgccgttgattgtaacttgaaggagacggagctcaccttaggccttcccggcaccaaaactactgccacaaaacgtggcttctctgatacccttcctccttctcaaaataaaatcttgcgccccacctccaaattcccaacacccaaggaacaactggtggggtggccgccggtgagggcaagcaggaagaatgctatgaagagctgttgcaagttggtgaaggtggcggtggatggagctccttatctaagaaaagtggatcttgacatgtacgatagttatgagcatttgatgagggaattagagacaatgttttgtggcttagccattcgtaatcatttgatgaatgagaggaaactgatggatcctggaaatgggattgaatacatgcccacctatgaggacaaagatggtgactggatgttggtcggggatgtaccctggaaaatgtttgttgaatcatgcaagaggataagacttatgattagctcagaggccgttggtttaggtccgaggtctacttcttcaaaatgtacgggttccacttagctagctagaagtgtgtaataatcataataagctgatagataagcattccgtggataccatcaacatgtaaaagctccggttagaacttagaagagtgaatttagtttaaggaaatatccatggtgcttgatgtacatgtccctttagcacctctggttaagtagttactttaaatgaagaactagaacaaagactggtctct

SEQ ID NO: 1383 - protein, 188 aa, Glycine max
  misc_feature: Ceres CLONE ID no.474845
  misc_feature: Bit score of 168.3 for HMM based on sequences of FIGURE 16.
  misc_feature (10)..(179): Pfam Name: AUX_IAA Pfam Description: AUX/IAA family
  misc_feature: Functional Homolog Of Ceres SEEDLINE ID no. ME18408 at SEQ ID NO. 1347
MSSESHAVDCNLKETELTLGLPGTKTTATKRGFSDTLPPSQNKILRPTSKFPTPKEQLVGWPPVRASRKNAMKSCCKLVKVAVDGAPYLRKVDLDMYDSYEHLMRELETMFCGLAIRNHLMNERKLMDPGNGIEYMPTYEDKDGDWMLVGDVPWKMFVESCKRIRLMISSEAVGLGPRSTSSKCTGST

SEQ ID NO: 1384 - DNA, 1297 bp, Zea mays subsp. mays
  misc_feature: Ceres CLONE ID no.354561
  misc_feature: Encodes the peptide sequence at SEQ ID NO. 1385
aacgacgagcagtgcaagccaagcattctcacgctagctgttctcttcttgcgcctcatccatcttgcatctatattctcggcgcgagttacgttttcgtcgtccggccggccggcgagcattttgcttctgcgatcgatcggcgcgacgtgtgcacggccatggagatgatcgacgcagagctgcgtctgggtccgcccggcagcaccaacagagacgtcatcaacgtcgtgcagccggcgttggcggcggcgaaacggccgtcgtcgtcggtggtggagagcgaggcgtccgggacggacgaccatgacgacgctgcaccgacctccaaggtgcaggtggtggggtggccgccggtgagagtgtaccggaagaacgcgttccacgcggcggcggaggcgaggaggaccaggcggggcgagcagcaaggaggaggaggcctgtacgtgaaggtgagcatggacggggcgccatacctccggaaggtggacctgcggacctacggcggctaccgtgagctgagggacgcactggacgcgctcttcggctgcttctcctcctcggccgacggcggatgccagttcgccgtcgcctacgaggacaaggacggcgacctcatgctcgccggcgacgtgccatgggagatgttcatctgttcttgcaagaagctgaggatcatgagggggtccgaaacaagataaccaagcaacgaggatgcaagaaccctgtttggatgcatatgcatggagaggccggccggactcatggtgtcatgcacgagagagaagaagaagaagacgacgacctgctggaactgaaggcggttgggtatacctgcatgcatggggagggagcccacgcatgcacgcgcgcgtcgtcgtgttctagccaccagaccggccgccggcccatatgctcaccacggagatggaggtgatggttcaaggatcacggcggcgtacgcgtcatcagtcacgccgtcgtcctgtcatcagatgagagatggaggggtgatgcatgagggcagtgctgtcgacggctggctggacgtgcagatcggagcgagattgtactgtgcacgcacatgagctttgtaattcattctaggggtgcagccgcacccacgtagaaataaataagaataccgccgtggttagagccaaattttttgccatttatattgttagcgtctcgtcagcgcagagaggagaagagaagaatcgggatgcgtggagaagaagaatagtgtagcgacgaggggaaatgtgtaatgtaagtatatgttcttttgatgcct

SEQ ID NO: 1385 - protein, 179 aa, Zea mays subsp. mays
  misc_feature: Ceres CLONE ID no.354561
  misc_feature: Bit score of 193.7 for HMM based on sequences of FIGURE 16.
  misc_feature (1)..(177): Pfam Name: AUX_IAA Pfam Description: AUX/IAA family
  misc_feature: Functional Homolog Of Ceres SEEDLINE ID no. ME18408 at SEQ ID NO. 1347
MEMIDAELRLGPPGSTNRDVINVVQPALAAAKRPSSSVVESEASGTDDHDDAAPTSKVQVVGWPPVRVYRKNAFHAAAEARRTRRGEQQGGGGLYVKVSMDGAPYLRKVDLRTYGGYRELRDALDALFGCFSSSADGGCQFAVAYEDKDGDLMLAGDVPWEMFICSCKKLRIMRGSETR

SEQ ID NO: 1386 - DNA, 1125 bp, Glycine max
  misc_feature: Ceres CLONE ID no.540858
  misc_feature: Encodes the peptide sequence at SEQ ID NO. 1387
accactactcctcctaagtctttgaagtcataaatgacaaaagaaaagacttagtcatagcagcaaacaaggaaatggcacgtacacgaccaccgtttacctgttttttgaacgttgaaattaattgacctgcgcctgcgcgtgtcactgtttgagagcacacaaacaatgtcctcccaatctgacgccgttggctgtaacttgaaggagacggagctcaccttaggccttcccggcaccaaaactaatggcacaaaacgtggcttctccgacacccttaacacttctcataataaaatgttgcgccccacctccaaggaacaagtggtggggtggccgccggtgagggcaagcaggaaaaatgctatgaagatgagttgcaagttggtgaaggtggcggtggatggagctccttatctaagaaaagtggatcttgaaatgtacgagacttatgagcatttgatgagggaattagagaccatgttttgtggcttagccattcgtaatcatttgatgaatgagaggaaactgatggagtctgaaaatgggattgaatacatgcccacctatgaggacaaagatggtgactggatgttggtcggggatgtaccctggaagatgtttgttgaatcatgcaagaggataagacttatgattagctcagaggccgttggtttaggtccgaggtctacttcttcaaaatgtacgggttccacctagctagctagaagaataattaattagtgcgtaataatgataagctgatagctgataattaagcattccttggacaccttcaacgtttacaagctccggttagaagaagagtgaatttggtacagggaaatatccatgcatggtgtttgatgtacatgtccctttagcacctctggttaattagttacttttgttttgactttaaatgaagaactagaacaaatactggtctctatattagctagtgatctaaaaaacaaataaggggaggctggcatgtaatcaatattaggatcatcgttatatcatgagtatgcatgtaatgtatgacttggctttgtgctagctagttattctacccccagttttctagttgttagataaattcmcctgatcattttatgtttc

SEQ ID NO: 1387 - protein, 183 aa, Glycine max
  misc_feature: Ceres CLONE ID no.540858
  misc_feature: Bit score of 154.4 for HMM based on sequences of FIGURE 16.
  misc_feature (10)..(174): Pfam Name: AUX_IAA Pfam Description: AUX/IAA family
  misc_feature: Functional Homolog Of Ceres SEEDLINE ID no. ME18408 at SEQ ID NO. 1347
MSSQSDAVGCNLKETELTLGLPGTKTNGTKRGFSDTLNTSHNKMLRPTSKEQVVGWPPVRASRKNAMKMSCKLVKVAVDGAPYLRKVDLEMYETYEHLMRELETMFCGLAIRNHLMNERKLMESENGIEYMPTYEDKDGDWMLVGDVPWKMFVESCKRIRLMISSEAVGLGPRSTSSKCTGST

SEQ ID NO: 1388 - DNA, 681 bp, Panicum virgatum
  misc_feature: Ceres CLONE ID no.2032994
  misc_feature: Encodes the peptide sequence at SEQ ID NO. 1389
tcctccccccccccccccccccctcgcgtctctctcgcccacacgcggagcggcagccgcagccgcgggagccccacccgcccacgccgccggccatgtcggtggagacggagcggagctccaccgagtcctccgccgcctcgggcctcgacttcgaggacaccgcgctcacgctcaccctccgcctcccgggctccgcgtcctcgtcctcgtcctcgtcctcctccgccttccccgaccccgaccgcaagcgcgcctcctccgacgccgacgccgcccgctcctccccgctcgccgccgcgtcctccgatgctcccccggcacccaaggcgcgggtggtggggtggccgccggtgaggtcgtaccgcaagaacgcgctcgccgacgtcgcgggctccagcaaggccaagcaggccgccaagttcgtcaaggtggccgtcgacggcgcgccctacctgcggaaggtggacctcgaggcctacgccggctacgaccagctcctccgcgcgctccaggacaagttcttctcccatttcaccatccggaagttcgccgacgacgagaggaagctggtggacgcagtgaacgggacggagtacgtgcccacgtacgaggacaaggacggcgactggatgctcgtcggcgacgtcccctggaagatgtttgtggaaaactgccagc

SEQ ID NO: 1389 - protein, 195 aa, Panicum virgatum
  misc_feature: Ceres CLONE ID no.2032994
  misc_feature: Bit score of 127.7 for HMM based on sequences of FIGURE 16.
  misc_feature (52)..(195): Pfam Name: AUX_IAA Pfam Description: AUX/IAA family
  misc_feature: Functional Homolog Of Ceres SEEDLINE ID no. ME18408 at SEQ ID NO. 1347
MSVETERSSTESSAASGLDFEDTALTLTLRLPGSASSSSSSSSSAFPDPDRKRASSDADAARSSPLAAASSDAPPAPKARVVGWPPVRSYRKNALADVAGSSKAKQAAKFVKVAVDGAPYLRKVDLEAYAGYDQLLRALQDKFFSHFTIRKFADDERKLVDAVNGTEYVPTYEDKDGDWMLVGDVPWKMFVENCQ

SEQ ID NO: 1390 - DNA, 730 bp, Panicum virgatum
  misc_feature: Ceres CLONE ID no.2015315
  misc_feature: Encodes the peptide sequence at SEQ ID NO. 1391
gaacgacgagcagtgcaagccaagcattctactcaggcaggctcacggtctctcactctctcttcctcttcctctctagcgatcttctcggcgagttcgtcgtcgttgcatctatccgagatctttttgtggtttcggccatggagatgatcgacgcggagctgcgtctcggtccgcccggcggcgatgttacggtcgtgcagccggcgaggaagccggcggcggcgaaacggtcgtcgtcggcggtgaagagcgaggcctccgggaccggtggccatgacgacgacgccgcgccggcctccaaggtgcaggtggtggggtggccgccggtgagggcgtaccggaagaacgcgttccatgcggcggcggaggcggcggcggcgaggacgacgaagggggagcaggggggcctgtacgtgaaggtgagcatggacggagcgccctacctccggaaggtggacctgcggacgtacggcgggtacagggagctgagggacgcgctcttcggctgcttctcctcggcggccgacggcgcctgccagttcgccatcgcctacgaggacaaggacggcgacctcatgctcgccggcgacgtgccatgggatatgttcatctgttcttgcaagaagctgaggatcatgaggggctctgaagcaagatgatccgagtgtcgaggtccacacatcgcgcgagaatttgttggacgcgtgtggatcagatgtataggtca

SEQ ID NO: 1391 - protein, 173 aa, Panicum virgatum
  misc_feature: Ceres CLONE ID no.2015315
  misc_feature: Bit score of 184.9 for HMM based on sequences of FIGURE 16.
  misc_feature (44)..(173): Pfam Name: AUX_IAA Pfam Description: AUX/IAA family
  misc_feature: Functional Homolog Of Ceres SEEDLINE ID no. ME18408 at SEQ ID NO. 1347
MEMIDAELRLGPPGGDVTVVQPARKPAAAKRSSSAVKSEASGTGGHDDDAAPASKVQVVGWPPVRAYRKNAFHAAAEAAAARTTKGEQGGLYVKVSMDGAPYLRKVDLRTYGGYRELRDALFGCFSSAADGACQFAIAYEDKDGDLMLAGDVPWDMFICSCKKLRIMRGSEAR

SEQ ID NO: 1392 - DNA, 683 bp, Panicum virgatum
  misc_feature: Ceres CLONE ID no.2016149
  misc_feature: Encodes the peptide sequence at SEQ ID NO. 1393
accggcacacttcaattccacacaaaacttttcctcctcatcatcatcttcgtcttcctctcctcctcatcctctctctagctgctgtggtcatactttctctctcttctattctctttctctgccaagaacaccggccggctagcagctcgtgctcccatggagatcgacgccgacaacctcagcgccaccgagctccgcctcggcctgccgggaaccagcagcggcgacgccgaccgcccgaagaggccggcgccctccgtcggcgccaagcgcgcgctcgacgacaccaggagcgaggcctcgggcaccagcccggccgccgggggcgaccacgacgccgccacgcctgccaaagcgcaagtggtggggtggccgccggtgagggcgtacaggaagaacaccttccaggcggcggcggcggcgaagaaggccgagcagccgggagggctgtacgtgaaggtgagcatggacggggcgccgtacctcaggaaggtggacctccggatgtataaggggtaccgggagctcagggaggcgctggacgccctcttcaccaagtccttctccgcctccgccggagcggagggcggcgacggccagcacgccctcgcctacgaggacaaggacggcgacctcatgctcgtcggagatgtgccctgggacatgttcatctcttcgtg

SEQ ID NO: 1393 - protein, 174 aa, Panicum virgatum
  misc_feature: Ceres CLONE ID no.2016149
  misc_feature: Bit score of 174.3 for HMM based on sequences of FIGURE 16.
  misc_feature (7)..(174): Pfam Name: AUX_IAA Pfam Description: AUX/IAA family
  misc_feature: Functional Homolog Of Ceres SEEDLINE ID no. ME18408 at SEQ ID NO. 1347
MEIDADNLSATELRLGLPGTSSGDADRPKRPAPSVGAKRALDDTRSEASGTSPAAGGDHDAATPAKAQVVGWPPVRAYRKNTFQAAAAAKKAEQPGGLYVKVSMDGAPYLRKVDLRMYKGYRELREALDALFTKSFSASAGAEGGDGQHALAYEDKDGDLMLVGDVPWDMFISS

SEQ ID NO: 1394 - DNA, 655 bp, Gossypium hirsutum
  misc_feature: Ceres CLONE ID no.1922843
  misc_feature: Encodes the peptide sequence at SEQ ID NO. 1395
gaatgtgttggtccaataatttagtgcaaaaaccatcttcttttttctgctttctcgtatagcatcctgttttgagaaactttttttttttgagggaatcagaaaatgtcatcggagaacgggaaaaggttgctggaaactgatgccggcggcttgaattttgaggctaccgagctgactttagggttacctggagagcctagagtaacatcggacggtggagctaagttgggcagtaaacgtggattttccgaaaccgttgatcttaagttgggtgacaacaatcgagaggttaagctgggtcactccctccaagaagctgctaagtctcctgtttcaaagacacaagtggtgggttggccgccggtgagaggctttgcaaagagaggaaagaagagttgcaaatatgtaaaagtggcggtggacggtgctccatatttaaggaaagttgatctcgagatatacaatagttatcagcagctgttaacctcccttgaagacatgttttcatgtttcaccataagaaactatttgaacgagaagaaaatagagcaagtgaatggaattgagtatatgcctacatatgaggataaggacggagattggatgttggtgggagatgtaccatggcaaatgtttgttgaatcttgcaaac

SEQ ID NO: 1395 - protein, 183 aa, Gossypium hirsutum
  misc_feature: Ceres CLONE ID no.1922843
  misc_feature: Bit score of 153.2 for HMM based on sequences of FIGURE 16.
  misc_feature (17)..(183): Pfam Name: AUX_IAA Pfam Description: AUX/IAA family
  misc_feature: Functional Homolog Of Ceres SEEDLINE ID no. ME18408 at SEQ ID NO. 1347
MSSENGKRLLETDAGGLNFEATELTLGLPGEPRVTSDGGAKLGSKRGFSETVDLKLGDNNREVKLGHSLQEAAKSPVSKTQVVGWPPVRGFAKRGKKSCKYVKVAVDGAPYLRKVDLEIYNSYQQLLTSLEDMFSCFTIRNYLNEKKIEQVNGIEYMPTYEDKDGDWMLVGDVPWQMFVESCK

SEQ ID NO: 1396 - DNA, 711 bp, Panicum virgatum
  misc_feature: Ceres CLONE ID no.2000263
  misc_feature: Encodes the peptide sequence at SEQ ID NO. 1397
acccgccacccaccctatatagccgcgcacaaagcgccgatcctcctcaccggcacacttcaattccactcaaaactttctctcttcctcctcatattcgtcttcctctctctagctgctgcggtcatactttctctccctctctctctcttcctctcggctagcagcttgtgtttgttgttcccatggagatcgacggcgacaacctcagcgccaccgagctccggctcggcctgccggggaccagcagcggcgacgaccggccgaggaggccggcgccctccgtcggcgccaagcgcgcgctcgaggacaccaggagcgaggcgtccggcaccacggccgccggcgacgaccacgacgacgccacgcctgctgccaaagcgcaagtggtggggtggccgccggtgagggcgtacaggaagaacaccttccaggcggcggcgaagaaggccgagcagccgggagggctgtacgtgaaggtgagcatggacggggcgccgtacctcaggaaggtggacctccggatgtacaaggggtaccgggagctcagggaggcgctggacgccctcttcaccaagtccttctccgccgccgccgccgccgccgccgccggagcggagggcggcgacggccagcacgccctcgcctacgaggacaaggacggcgacctcatgctcgtcggagacgtgccctgggacatgttcatctctt

SEQ ID NO: 1397 - protein, 175 aa, Panicum virgatum
  misc_feature: Ceres CLONE ID no.2000263
  misc_feature: Bit score of 174.4 for HMM based on sequences of FIGURE 16.
  misc_feature (7)..(175): Pfam Name: AUX_IAA Pfam Description: AUX/IAA family
  misc_feature: Functional Homolog Of Ceres SEEDLINE ID no. ME18408 at SEQ ID NO. 1347
MEIDGDNLSATELRLGLPGTSSGDDRPRRPAPSVGAKRALEDTRSEASGTTAAGDDHDDATPAAKAQVVGWPPVRAYRKNTFQAAAKKAEQPGGLYVKVSMDGAPYLRKVDLRMYKGYRELREALDALFTKSFSAAAAAAAAGAEGGDGQHALAYEDKDGDLMLVGDVPWDMFIS

SEQ ID NO: 1398 - DNA, 1448 bp, Gossypium hirsutum
  misc_feature: Ceres CLONE ID no.1943510
  misc_feature: Encodes the peptide sequence at SEQ ID NO. 1399
ataattttcccatttttctttgtctacagtttgcaagctttacatgtgatttctctcttctagacttataaaggtttgaaactttggttgaaccaaggaggctttgatttccaatgcaaggaggtggtggtggttctgaaagtgggtctttgtctacagtttcaagggaggacaacatggtggtgtcctcagaggattcttcatgccctgatgagtctgagttggagttgggtcttggtttgtgccttggtggttttaagatgcaccaagtctcaagaggtggtcaatttgctaggattttgactgctaaggatttcccttctgccatttctgcttctccatcaccttcttcttcatcatcatcatcatcttcttcttcttcttcttctttaagtagggctaatgtcacagctgggaccaagaggactgctgattctgtggctgctgctaattcctctagtcaagtcgtgggatggcctccgatcagagcttataggatgaatagcatggttaaccaagcaaaaaaccagaccaccgaaggatttaactcgacaatggagaaccataaaagtgagacctctacggttgagaagggtactactggcattagcagctaccataatagtggcaatgctaaactcagaaaatccctgtttgtgaaggtgaacatggacggaattccaattggaagaaaggttgatatgaatgcccatgaatcctatgaaaagttggcaaaaactttggaagatatgtttctgaaaaccactctgaatgtcaatccagcaggatcaagggctctagagcttggtatgatgaacaaactaacaagatcctcaaaactgctggatggatcatctgattttgtgctcacttacgaggacaaggagggggactggatgcttgttggggatgttccttggaagatgttcctttgctccgtgaagaggcttagaatcatgaggacatccgaggctactggattggctccacgattgcacgagaggaactgccagagacaaagaagcaagcacatctagaatatgccagcaaacatacaaatcaaaatggaaatacggaatagttaagccactttgactgagtaaagtttgaactccgaagacttggtttgttctcgattacaatattattttgttacatgttttcgtcaacctctcaattacagtcttgaggaatagttgccatacttattgaaaggcaccaatatctcagttttcaatatgtaatattatattatacgaaggtacccagtaaatgctgtaatttttttgtttctgtaaataacacagccattgttactgtattattttcaaaagcaaaaaattgagaagaattctcagaactgctttgtatggcttgtgaaaaaaaaagctggatattccaagaattaatctatagatgtttactactaaaaaaaaaaaaaaaaaaaa

SEQ ID NO: 1399 - protein, 307 aa, Gossypium hirsutum
  misc_feature: Ceres CLONE ID no.1943510
  misc_feature: Bit score of 150.4 for HMM based on sequences of FIGURE 16.
  misc_feature (102)..(294): Pfam Name: AUX_IAA Pfam Description: AUX/IAA family
  misc_feature: Functional Homolog Of Ceres SEEDLINE ID no. ME18408 at SEQ ID NO. 1347
MQGGGGGSESGSLSTVSREDNMVVSSEDSSCPDESELELGLGLCLGGFKMHQVSRGGQFARILTAKDFPSAISASPSPSSSSSSSSSSSSSSLSRANVTAGTKRTADSVAAANSSSQVVGWPPIRAYRMNSMVNQAKNQTTEGFNSTMENHKSETSTVEKGTTGISSYHNSGNAKLRKSLFVKVNMDGIPIGRKVDMNAHESYEKLAKTLEDMFLKTTLNVNPAGSRALELGMMNKLTRSSKLLDGSSDFVLTYEDKEGDWMLVGDVPWKMFLCSVKRLRIMRTSEATGLAPRLHERNCQRQRSKHI

SEQ ID NO: 1400 - DNA, 1239 bp, Gossypium hirsutum
  misc_feature: Ceres CLONE ID no.1835498
  misc_feature: Encodes the peptide sequence at SEQ ID NO. 1401
atgttcaatttcctctcacaaatctcctttttgattttcccatttctctctgcctgcaaaaatcccacatacaaacttttacttccatttgatcatttttcttctcctctttgaacctaggacctgggggttcagttttaaatgcaaggtggtggcggcggcggttctgaaagtgggtcaatgtctacagtgtcaagggatgagaacatggtggtgtcttctgaagattcttcatgcccggatgagtctgggttggagttgggtcttggtttgagccttggtggtggtggtggtggtggtggcggcggccgccaaggcggtggttttaagatgcatcatgtttcaaaaggtggtccatatgctaggattttgactgctaaagatttcccttcttcatcattatcttcatcgtcgtcatcatcatcatcctcaccatctttaagcaaagctaatgtcacagctgggaccaagagaactgctgaatctgttgctgttgctgctaacggatctagtcaagttgtggggtggcctcctatcagagcttatagaatgaatagcatggttaatcaagcaaaagtgctgacaatggagaaccgcaaaaaggagacctcgatggtcgagaacagcagcatcggcggctatcgtaacgatggtaacactaagctgaagaaatccacgtttgtgaaggtgaatatggatggaaccccaataggaaggaaggtcgatctgaatgcccatgaatcgtatgaaaagttagcgaaaacgttggaagatatgtttctcgaaaccgccccgagtgtcaatccatctggatcaacggcgctgcagcttgatatgttgaacaggatgacaagacactcgagactgctggatggatcatccgatttcgtgcttacttacgaggacaaggaaggtgactggatgcttgttggagatgttccttgggagatgttccttacttcagtgaaaaggcttaggatcatgaggaaatctgaggcaactggattagctccaaggtaacaagaaacagaaccagagacaaagaagaaagccaatgtagaaatgttttttttttggtttcaatgtcaattacagtgttgaagaaatatagtcaccataggttatgaatgtaatatttaatacaaataacaactagtgagagtgttgttctttgcttttatgcctgtaaataaaagcggcaagtttgttgttgttgtttaaaaaaaaaaaaaaaaaaaa

SEQ ID NO: 1401 - protein, 292 aa, Gossypium hirsutum
  misc_feature: Ceres CLONE ID no.1835498
  misc_feature: Bit score of 149.1 for HMM based on sequences of FIGURE 16.
  misc_feature (39)..(291): Pfam Name: AUX_IAA Pfam Description: AUX/IAA family
  misc_feature: Functional Homolog Of Ceres SEEDLINE ID no. ME18408 at SEQ ID NO. 1347
MQGGGGGGSESGSMSTVSRDENMVVSSEDSSCPDESGLELGLGLSLGGGGGGGGGGRQGGGFKMHHVSKGGPYARILTAKDFPSSSLSSSSSSSSSSPSLSKANVTAGTKRTAESVAVAANGSSQVVGWPPIRAYRMNSMVNQAKVLTMENRKKETSMVENSSIGGYRNDGNTKLKKSTFVKVNMDGTPIGRKVDLNAHESYEKLAKTLEDMFLETAPSVNPSGSTALQLDMLNRMTRHSRLLDGSSDFVLTYEDKEGDWMLVGDVPWEMFLTSVKRLRIMRKSEATGLAPR

SEQ ID NO: 1402 - protein, 211 aa, Zea mays
  misc_feature: Ceres CLONE ID no.101116694
  misc_feature: Bit score of 104.9 for HMM based on sequences of FIGURE 16.
  misc_feature (46)..(174): Pfam Name: AUX_IAA Pfam Description: AUX/IAA family
  misc_feature: Functional Homolog Of Ceres SEEDLINE ID no. ME18408 at SEQ ID NO. 1347
  misc_feature (109)..(109): Xaa is any aa, unknown, or other
  misc_feature (110)..(110): Xaa is any aa, unknown, or other
  misc_feature (122)..(122): Xaa is any aa, unknown, or other
  misc_feature (175)..(175): Xaa is any aa, unknown, or other
MSVDTERSSTKSSAASGLGYEDTALALTLRLPGSDPGRSSPLAAPSDSAPSPKARVVGWPPVRSYRKNALADSSKADRSASFVKVAVDGAAYLRKVDLQAYGGYDQLLXXLQDKFFSHFTIXKFSHHQKKLVDTVNRTEYVPTYEDKDGDWMLFRDIPWKMFLETFRRLPLIKGXKALSWDQEPPHDAQAQLHRHQYAVAFIGLACWRNKG

SEQ ID NO: 1403 - DNA, 1210 bp, Gossypium hirsutum
  misc_feature: Ceres CLONE ID no.1930596
  misc_feature: Encodes the peptide sequence at SEQ ID NO. 1404
aggaaattcagttttctttttcaatgcaaggaggtgttggtgatggtggttcagaaagtgggtcagtgtccactgtgtcaagggaggaaaacatggtggtgtcctcggaggattcttcatgccctgatcagtctgagttggagttgggtcttgggttgagccttggtggtggtggtggtggttttaagatgcatcatgtttcaaagggtggtcaatttgctaggattttgactgctaaggatctcccttctctggttttttctgctgcttctccatcttcttcttcttcttcatcatcatcttctttaagtagagctgatgtcacagctaagatcaagaggactgctgattccatggctgctgctaatggctttagtcaacttgtggggtggcctcctgtccaaactcatagaataaatagcatgggtaaccaagcaaaagaacttcccactgaagggtttaactcaaaaatggagaaccctaaaaatgagacctctatggttgagaagagtaccatcggcagctaccagaacaatggtaacgctaagctcagaaaatctcttttcgtgaaggtgaatatggatgggattccaattggaaggaaggttgatttgaatgcccatggatcctatgagaagttggctaaaactctagaagatatgtttctcgaaacgtccccaagtgttagtcaagtaggatcaagggcgctggagcatggtacgacaaataaactaacaagacctccgaaactgctggatgtatcttctgactttgcacttacttacaaggacaaagagggtgactggatgcttgttggagatgttccttgggagctgttcgttagttccgtgaagaggcttagaatcatgaggacatcagaggcaaccggattggctccaatgttacaaggaaggaaccagaggcaaagaagcaagcccaactagaacactattctctcaaagccgaccataacacgaataagacatgctatccaaagcagaaaagaaatacaacatagttaaaagcattttgacttgagcaaagtttgaacctttgcagctttctgtttgtttgtattatttgattacatgttaggaatagtcaacataggttttcaaagtctttagtttttcaatgtaatatatatctcgaaaacaacaattcaaacataaaggttgttccacttccataaaaaaaaaaaaaaaaaaaa

SEQ ID NO: 1404 - protein, 306 aa, Gossypium hirsutum
  misc_feature: Ceres CLONE ID no.1930596
  misc_feature: Bit score of 157.6 for HMM based on sequences of FIGURE 16.
  misc_feature (40)..(294): Pfam Name: AUX_IAA Pfam Description: AUX/IAA family
  misc_feature: Functional Homolog Of Ceres SEEDLINE ID no. ME18408 at SEQ ID NO. 1347
MQGGVGDGGSESGSVSTVSREENMVVSSEDSSCPDQSELELGLGLSLGGGGGGFKMHHVSKGGQFARILTAKDLPSLVFSAASPSSSSSSSSSSLSRADVTAKIKRTADSMAAANGFSQLVGWPPVQTHRINSMGNQAKELPTEGFNSKMENPKNETSMVEKSTIGSYQNNGNAKLRKSLFVKVNMDGIPIGRKVDLNAHGSYEKLAKTLEDMFLETSPSVSQVGSRALEHGTTNKLTRPPKLLDVSSDFALTYKDKEGDWMLVGDVPWELFVSSVKRLRIMRTSEATGLAPMLQGRNQRQRSKPN

SEQ ID NO: 1405 - DNA, 1013 bp, Triticum aestivum
  misc_feature: Ceres CLONE ID no.846036
  misc_feature: Encodes the peptide sequence at SEQ ID NO. 1406
ctcgaggcgcctcccctctcctctcgcgcacagacacgcgagcgcagccaagaaaccggccgatgcgagggccaggaggaggagttgcggcgttcggccccggcgagccgcccccggccgcggaggaggtggtggaggagaactcctcccccgccgatgccaaggcgggggaggggcccgcgcccgccgcctcgccggggactctcccckscggscasccacagagcagctttggagtggtgggatggccaccaatargaasattcaggatgaacagcctgttcggccaggcgaaagacaatgcctccgatgccgaaaccaagaaggccgccgccgatgactccggctcgcggaaagacaaggaggagggcgagaagaagggccgggtgcccgggtgggtgaaggtgaacatggatggagaggtcattgggaggaaggtggacctcaacgcccatcgctcgtacaagacccttgccttggcccttgagatcatgttcaccaagccatccgccggtctttgcgcctctaatagcacgaagtctctgaagctgttagaaaactcttgtgaataccagatgacatacgaagacagggatggtgactggatgcttgttggagatgtcccttgggaaatgtttgttggctctgtgaagaggctaaggattatgaggacatcggacgccagtggtcttgggccgcgatttcaagccaaccacagaaccgcggcctcgacaagagggagatcatgagggcagcactcaagtgaagagtcatatatcaccatctctgatgaaactacgtgggagcgagcagcctgacggcgcctctggcgcagccgttgttattacttgtgtgcctagttgagatagcaggagctaagatgtgctcctgcctgatggtgacttcttctgagctagtatctattcttttcccagcccccttcagttctgtctacacttggtgaagtgctagcatatgtgctcctttttcgtcatatatgttttttgtgcgac

SEQ ID NO: 1406 - protein, 228 aa, Triticum aestivum
  misc_feature: Ceres CLONE ID no.846036
  misc_feature: Bit score of 122.9 for HMM based on sequences of FIGURE 16.
  misc_feature (59)..(214): Pfam Name: AUX_IAA Pfam Description: AUX/IAA family
  misc_feature: Functional Homolog Of Ceres SEEDLINE ID no. ME18408 at SEQ ID NO. 1347
  misc_feature (50)..(50): Xaa is any aa, unknown, or other
  misc_feature (51)..(51): Xaa is any aa, unknown, or other
  misc_feature (52)..(52): Xaa is any aa, unknown, or other
  misc_feature (66)..(66): Xaa is any aa, unknown, or other
  misc_feature (67)..(67): Xaa is any aa, unknown, or other
MRGPGGGVAAFGPGEPPPAAEEVVEENSSPADAKAGEGPAPAASPGTLPXXXPQSSFGVVGWPPIXXFRMNSLFGQAKDNASDAETKKAAADDSGSRKDKEEGEKKGRVPGWVKVNMDGEVIGRKVDLNAHRSYKTLALALEIMFTKPSAGLCASNSTKSLKLLENSCEYQMTYEDRDGDWMLVGDVPWEMFVGSVKRLRIMRTSDASGLGPRFQANHRTAASTRGRS

SEQ ID NO: 1407 - DNA, 1659 bp, Triticum aestivum
  misc_feature: Ceres CLONE ID no.941614
  misc_feature: Encodes the peptide sequence at SEQ ID NO. 1408
acccaacccaagacacactcgctccttccttccttctccggctcttcaaacccgcagcagagagacgaggtagagagagcgagagagagagagaggtagtagtaggcagccgttgcttgctggcctagctagctgctgctgcggcgtgcttggctctggcgggcatctagatgctctcatttcctttcgcggcagctgctcccctacgccggaatccctccgtctccgtgccttccctccctcctctcatggcctagattcgtgccagtgctgctcgtagcaatcaatcgggagccgtttctttcttctttcctcgcgcctagtacgtagcgtagcctgctctgctgcggcctgcgcgctttgaatacgcgccctcctcctcaaaacgctcaaaccttgtccctttcccgcaaacccctgccgccttttggtcgctctagctctagcgtacaggcaggcaggcaggcaggcaggcacagtactatactccccgggcgccgcgccggccgccgggctctttcatctcgtctcggtctcaggtgggcgggcgggcgtccagcacctgcactgtgccctcctttcgcccccctctctctctctcttccgccatatattccgcccccgcttgtcaccgcgcaggaggaggagagaagagacacgcttgtgacctgtcggtctccatcactttcttgatttgtggcctgagctgggagcaggcgagcagcgccggcgagcgaggaggttgctagggacggacggtcgactcactcatggcgtggagcgggttcagggaggctgcggcggcgggggagagcggcctggagctcagcctcggcctccccgcctacttcaccaagccggcagcaccaacagcagatttggacgggcaggagtccagcggcgccggcggctctgctcgccaacttcaaggaggaaactacaaggccaagccggcggcagcagcagcagcagctccggtcgtggggtggccgccggtgcgctcgttccgacggaacctggccgcctccaagccgtcgtcgtccaaggaggacggcagggcaagcaaagacgacgacgtcgccgtcaagggcgccgacgagcctgcgggccggaagggtctgttcgtgaaggtcaacatggacggcgtccccatcgggcggaaggtggagctcaaggaggacggcagctacgccgacctctcggccaccgtcgacaagctcttccgcagcctcctcgccgctcaaagggacgccgccgctgccccagacgcgatcgccggcggcgagtacacgctggtgtacgaggacgacgagggcgacaggatgctggtcggggacgtcccatggcagatgttcatcgtcacggcgaagaggctgcgagggctcaagagctccgacctgccggcctcgtcgctgacggcggccgggagcaggaagaggccggcggctgcagccgactgctgattcgaactcgcccggcgttgtaaaggccttttttgacgagggttaatccggttttgctgctacgtatgtacgtacgcacgtatgaggatgaaatcacggctgtaattagagccgtgtctgtgatgctactgctattttgggtggccatcgtggccgtattttgatgcttttttctacgtcaaaaaaaaaaaaaaaa

SEQ ID NO: 1408 - protein, 230 aa, Triticum aestivum
  misc_feature: Ceres CLONE ID no.941614
  misc_feature: Bit score of 83.9 for HMM based on sequences of FIGURE 16.
  misc_feature (70)..(209): Pfam Name: AUX_IAA Pfam Description: AUX/IAA family
  misc_feature: Functional Homolog Of Ceres SEEDLINE ID no. ME18408 at SEQ ID NO. 1347
MAWSGFREAAAAGESGLELSLGLPAYFTKPAAPTADLDGQESSGAGGSARQLQGGNYKAKPAAAAAAAPVVGWPPVRSFRRNLAASKPSSSKEDGRASKDDDVAVKGADEPAGRKGLFVKVNMDGVPIGRKVELKEDGSYADLSATVDKLFRSLLAAQRDAAAAPDAIAGGEYTLVYEDDEGDRMLVGDVPWQMFIVTAKRLRGLKSSDLPASSLTAAGSRKRPAAAADC

SEQ ID NO: 1409 - DNA, 1240 bp, Zea mays subsp. mays
  misc_feature: Ceres CLONE ID no.238788
  misc_feature: Encodes the peptide sequence at SEQ ID NO. 1410
gtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcggatggagctggagctcgggctcgcgccgccgaacccgcatcagccgctggctgccaccgccgagttcgtcggtctcctcagcagctcggctggctcgtgcgggaacaagagggttctcggcgacgcgttcggggccgccaaggcggccacgcttccgctcttcgtctgcgaggatggcgacggaggcggcggcgaccgcgaccgcgacggcgtcgtcgaccatgaacagcaaagcaacaatgtacccaggaagaagaggctggtggggtggccgccggtgaagtgcgcgcgtaggcgtagctgcggcggcgggtacgtgaaggtgaagctggaaggggtgcccatcgggcggaaggtggacgtgtccatccacggctcgtaccaggagctgctccgcacgctcgagagcatgttcccttcgggtaaccaacaagaagacgaggtggtggtctcgcacgagcgccgccgtcgccatccttatgtagtcacctacgaggacggcgaaggggactggttgctcgtcggagatgatgtgccgtgggaggtctttgtcaagtcagtgaagcggctcaagatacttgcgtagccgacggtcggcgcctcagagacgtcgtgtggtccgtctcaccaggatcggagcagtgtagtactcctgggcgtcatctgcgtaataacgttgtttctgtcctgtgtgcccgtagcagtacgtactgtcctatagtaagctagctttatggggtgcttcagctttcagagcatgacgaaagcactgattagctgctgtcatcacatttggttcgtctttgtgtcgtacggtatcgctggcgtcagtgtcgcggcagcctaggtgatctaagcatacttactatctcaagttacttttggttcccttagcttgcatggtaattcatataccgtatacgtgtgtgactcaggggcgaagctgccttaaggcacaggggtcaccggacccgatggaatttatcaaatccagtgtaaaatactatttaacactgttcatcaatatatttgatttc

SEQ ID NO: 1410 - protein, 194 aa, Zea mays subsp. mays
  misc_feature: Ceres CLONE ID no.238788
  misc_feature: Bit score of 92.5 for HMM based on sequences of FIGURE 16.
  misc_feature (2)..(194): Pfam Name: AUX_IAA Pfam Description: AUX/IAA family
  misc_feature: Functional Homolog Of Ceres SEEDLINE ID no. ME18408 at SEQ ID NO. 1347
MELELGLAPPNPHQPLAATAEFVGLLSSSAGSCGNKRVLGDAFGAAKAATLPLFVCEDGDGGGGDRDRDGVVDHEQQSNNVPRKKRLVGWPPVKCARRRSCGGGYVKVKLEGVPIGRKVDVSIHGSYQELLRTLESMFPSGNQQEDEVVVSHERRRRHPYVVTYEDGEGDWLLVGDDVPWEVFVKSVKRLKILA

SEQ ID NO: 1411 - protein, 183 aa, Oryza sativa subsp. indica
  misc_feature: Public GI ID no.125554220
  misc_feature: Bit score of 89.8 for HMM based on sequences of FIGURE 16.
  misc_feature (78)..(181): Pfam Name: AUX_IAA Pfam Description: AUX/IAA family
  misc_feature: Functional Homolog Of Ceres SEEDLINE ID no. ME18408 at SEQ ID NO. 1347
MELELGLRLALPSPSPSPATATAAGSELDLLNSAPGSCRKRGFEEALGGFKTDDDNDDGNGRGGDGDSDGEMGNKRRKLVGWPPVKCLHRRRDGGCGGGYVKVKMEGLAIGRKLDLSILGSYAELLDTLHLMFPSTNQEDGHDRRRRHPYAVTYEDGEGDWMLVGDVPWEAFAKSVKRLKILV

SEQ ID NO: 1412 - protein, 246 aa, Oryza sativa subsp. indica
  misc_feature: Public GI ID no.125559895
  misc_feature: Bit score of 92.8 for HMM based on sequences of FIGURE 16.
  misc_feature (91)..(235): Pfam Name: AUX_IAA Pfam Description: AUX/IAA family
  misc_feature: Functional Homolog Of Ceres SEEDLINE ID no. ME18408 at SEQ ID NO. 1347
MKSSSVAPRLKQERQDDCKFQEGDVNSLELRLGISSDNGQISGGGAASPWLGVGVHPWSLAARQGKAALEQAHQRPNECAVQRENRAASSAQLVGWPPVRAFRKNLSTPKPADADDLMNKVKLCSDEGHGSRCAAQERRSSSTMFVKVNLEGYAVGRKIDLKAHRSYDSLSQALQSMFHGFLSDGIATRDNELQQMEEGSKKRYVLVYEDNEGDRMLVGDVPWELFIASVKRLYIAQDPRVHAKLR

SEQ ID NO: 1413 - protein, 183 aa, Oryza sativa subsp. japonica
  misc_feature: Public GI ID no.75252070
  misc_feature: Bit score of 81.7 for HMM based on sequences of FIGURE 16.
  misc_feature (78)..(181): Pfam Name: AUX_IAA Pfam Description: AUX/IAA family
  misc_feature: Functional Homolog Of Ceres SEEDLINE ID no. ME18408 at SEQ ID NO. 1347
MELELGLRLALPSPSPSPATATAAGSELDLLNSAPGSCRKRGFEEALGGFKTDDDNDDGNGRGGDGDSDGEMGNKRRKLVGWPPVKCLHRRRDGGCGGGYVKVKMEGLAIGRKLDLSILGSYAELLDTLHLMFPSTNQEDGHDRRRRHPYAVTYEDGEGDWMQVGDVPWEAFAKSVKRLKILV

SEQ ID NO: 1414 - protein, 183 aa, Oryza sativa subsp. japonica; identical to SEQ ID NO: 1413
  misc_feature: Public GI ID no.115466632
  misc_feature: Bit score of 81.7 for HMM based on sequences of FIGURE 16.
  misc_feature (78)..(181): Pfam Name: AUX_IAA Pfam Description: AUX/IAA family
  misc_feature: Functional Homolog Of Ceres SEEDLINE ID no. ME18408 at SEQ ID NO. 1347

SEQ ID NO: 1415 - protein, 180 aa, Oryza sativa subsp. indica
  misc_feature: Public GI ID no.125541525
  misc_feature: Bit score of 70.3 for HMM based on sequences of FIGURE 16.
  misc_feature (148)..(178): Pfam Name: AUX_IAA Pfam Description: AUX/IAA family
  misc_feature: Functional Homolog Of Ceres SEEDLINE ID no. ME18408 at SEQ ID NO. 1347
MELELGLAPPNSGHLVVDELSSSSGGGSGSAPVSASSAGKRGFREAFQETLLLFDDGSCCNTSDDDCRRRKKTVVGWPPVSSARRACGGANYVKVKKEGDAIGRKVDLALHSSYDELAATLARMFPTNDHQGEKKMANDDHGDAAGPVVTYEDGDGDWMLVGDVPWDDFARSVKRLKILG

SEQ ID NO: 1416 - DNA, 1317 bp, Panicum virgatum
  misc_feature: Ceres CLONE ID no.1805110
  misc_feature: Encodes the peptide sequence at SEQ ID NO. 1417
gtgatccttcaggcagtcaaagggagatgaggagtggtacaagctcgcaatttattatgcgagaggggtgcccaccccaactaagcctgttacgacaacaggggcgccccaatgactttaccatctgatcccgaacgcacacacggaaacagccactcctcacctcccctaccctccggttcatgtcctgctgctccccatgtcgcccccactcgagctcgactacataggcctctcgccgccggcggccgccgctgccgcagatgccgccgacgacctgaagggcaccgagctccgcctcggcctgccggggtccgagtcgccggaccgccgcgtcgcggctgccaccgcgaccaccctggacctgctcccagccaaaggcgccaagcgcgggttctccgacgaggtgccgccgccttcgcccgccgccgctgcgggcaagggcaagaaggtggcggacgaggaggacgacgacaagaaggtggcagcgatcccgcagccggccgccaaggctcaggtggtgggatggccaccaatccgcagctaccgcaagaacacgatggctactacccagcagaagggcagcaaggaggatgctgaggccaagcagggccaagggttcctctacgtgaaggtcagcatggatggagccccgtacctcaggaagattgacctcaagacatacaagaactacaaggatctctccactgcacttgagaagatgttcagtggctttagtaatggcaaggacggcttatctgagtaccgcaaggatggtgaatatgttctgacttatgaagacaaggacggagattggatgcttgtcggcgacgtgccatgggagatgtttgctgactcttgccgtaggctcaggatcatgaaaggttcagatgcaattggacttgctccaagggcagctgataagtccaagaaccgcaactagaatggttgctactacagtccagagcaagagggagatccaatggctgtagggccctttatgaaaaccgaaaagtcaaacagttttaagacgaattctgccttatggtctgtactacatgggttgctgttacgcgagtaaagaactccatgtctgttatgttagtttcgcaaaatcatctatggaccaaacctctattcgattgtggttaaggctttgtacgagtgttattcgtatccgtgtaaatggtttggttcattgtgtgctgctactttgattgagcagtcctcctacctagtttgcaaaagggttggtgtccatgaactgtttgttgtttctctatataatgttcaatgaagctcgcgaatgtattgtcc

SEQ ID NO: 1417 - protein, 247 aa, Panicum virgatum
  misc_feature: Ceres CLONE ID no.1805110
  misc_feature: Bit score of 419.6 for HMM based on sequences of FIGURE 16.
  misc_feature (26)..(239): Pfam Name: AUX_IAA Pfam Description: AUX/IAA family
  misc_feature: Functional Homolog Of Ceres SEEDLINE ID no. ME18408 at SEQ ID NO. 1347
MSPPLELDYIGLSPPAAAAAADAADDLKGTELRLGLPGSESPDRRVAAATATTLDLLPAKGAKRGFSDEVPPPSPAAAAGKGKKVADEEDDDKKVAAIPQPAAKAQVVGWPPIRSYRKNTMATTQQKGSKEDAEAKQGQGFLYVKVSMDGAPYLRKIDLKTYKNYKDLSTALEKMFSGFSNGKDGLSEYRKDGEYVLTYEDKDGDWMLVGDVPWEMFADSCRRLRIMKGSDAIGLAPRAADKSKNRN

SEQ ID NO: 1418 - DNA, 1257 bp, Zea mays subsp. mays
  misc_feature: Ceres CLONE ID no.285028
  misc_feature: Encodes the peptide sequence at SEQ ID NO. 1419
aaacaaaccactcttcgcttcgactcccactcccactctccctttccactctcaggctcccactccccccctaccggctaccctacccatcacacacaaacagccactcctcacctcccccgtcctccggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaaccaccctggacctgctcccggctaagggcgccaagcgcgggttttctgacgaggcgccgacgccatcgcccggtgcagcttccgggaagggaaagaaggtagcggaagaggaggacgacaagaaggttgcagcgacgccgcagccggtcgcaaaagctcaggtggtgggatggccaccaatccgaagctaccgcaagaacacgatgtctaccacccagctgaagggcagcaaggaggatgctgaggccaagcaggaccaggggttcctgtacgtcaaggtcagcatggatggcgcgccgtacctcaggaagattgacctcaagacttacaagaactacaaggacctgtcgactgcgcttgagaagatgttcagtggcttcagtactggcaaggatggcttatctgagtaccgcaaggatggtgaatatgttctgacttacgaggacaaggatggagattggatgcttgttggcgatgtaccatgggagatgttcgctgactcttgccgcaggctcaggatcatgaaaggatcagatgcaattggacttgctccaagggcagctgataagtccaagaatcgcaactagaatggttgcttcttacagtccagagcaagagggagatatccagtgactgtagggatctttgtggaagccggaaaacgtctaacagtttcaagaagaattctgccttatggtctgtaccacatgtttttgctgctacgcaagtaaagaactccacgtctgtcaatgttagttttacaacatcgtctacggacaaaaaaaaaacccccgctatttgattgttgctaagccttcgtacgacgtgtaaatggtttggtacaatgagtgctgcgactacgattgagcacccctctacctagtttgcaaaaaccagtgtcccatggactgtctgttgtccctctatataaatgtccaatgaagcttgctaatgtgtgc

SEQ ID NO: 1419 - protein, 244 aa, Zea mays subsp. mays
  misc_feature: Ceres CLONE ID no.285028
  misc_feature: Bit score of 440.3 for HMM based on sequences of FIGURE 16.
  misc_feature (24)..(236): Pfam Name: AUX_IAA Pfam Description: AUX/IAA family
  misc_feature: Functional Homolog Of Ceres SEEDLINE ID no. ME18408 at SEQ ID NO. 1347
MSPPLDLDYIGLSPAAAAAAAHDDLKGTELRLGLPGSGSPDRRVVAATATTLDLLPAKGAKRGFSDEAPTPSPGAASGKGKKVAEEEDDKKVAATPQPVAKAQVVGWPPIRSYRKNTMSTTQLKGSKEDAEAKQDQGFLYVKVSMDGAPYLRKIDLKTYKNYKDLSTALEKMFSGFSTGKDGLSEYRKDGEYVLTYEDKDGDWMLVGDVPWEMFADSCRRLRIMKGSDAIGLAPRAADKSKNRN

SEQ ID NO: 1420 - DNA, 1229 bp, Panicum virgatum
  misc_feature: Ceres CLONE ID no.1725309
  misc_feature: Encodes the peptide sequence at SEQ ID NO. 1421
actctctctccttcccctctctttctccccccacacacacggaaacagccactcctcacctcccccaccctccggttcatgtcctgctgctccccatgtcgcccccactcgagctcgactacataggactctcgccgccggaggtcgccgccgccgcagatgccgccgacgacctgaagggcaccgagctccgcctcggcctgccggggtccgagtcgccggggcgccgcgtcgcggctgccacggcgaccaccctggacctgctcccagccaagggcgccaagcgcgggttctccgacgaggtgccgccgccgtcgcccgccgccgctgcgggcaagggcaagaaggtggcggacgaggaggacgacgacaagaaggtggcagcgaccccgcagccggccgccaaggctcaggtggtgggatggccaccaatccgcagctaccgcaagaacacgatggctactacccagcagaagggcagcaaggaggatgctgaggccaagcagggccaagggttcctctacgtgaaggtcagcatggatggcgccccgtacctcaggaagattgacctcaagacatacaagaactacaaggatctctccactgcacttgagaagatgttcagtggctttagtaatggcaaggacggcttatctgagtaccacaaggatggtgaatatgttctgacttatgaagacaaggatggagattggatgctcgtcggcgacgtgccatgggagatgtttgctgactcttgccgtaggctcaggatcatgaaaggttcagatgcaattggacttgctccaagggcagctgataagtccaagaaccgcaactagaatggttgctactacagtccagagcaagagggagatccaatgactgtagggccctttatgaaaatcgaaaagtctaacagttataagacgaattctgccttatggtctgtactacatggtttgctgttacgcgagtaaagaactccatgtctgttatgttagtttctcaaaatcgtctatggaccaaacctctatccgattgtggttagggctttgtatgggtgttattcgtatcagtgtaaatggtttggttcattgtgtgctgctactttgattgagcagtcctcctacctagtttgcaaaatggtgtccatgaactgtttgtcggtcctctatataatgttcaatgaagctcgtgaatgtattgtctaaaaaaaaaaaaaaaaaaaa

SEQ ID NO: 1421 - protein, 247 aa, Panicum virgatum
  misc_feature: Ceres CLONE ID no.1725309
  misc_feature: Bit score of 418.2 for HMM based on sequences of FIGURE 16.
  misc_feature (26)..(239): Pfam Name: AUX_IAA Pfam Description: AUX/IAA family
  misc_feature: Functional Homolog Of Ceres SEEDLINE ID no. ME18408 at SEQ ID NO. 1347
MSPPLELDYIGLSPPEVAAAADAADDLKGTELRLGLPGSESPGRRVAAATATTLDLLPAKGAKRGFSDEVPPPSPAAAAGKGKKVADEEDDDKKVAATPQPAAKAQVVGWPPIRSYRKNTMATTQQKGSKEDAEAKQGQGFLYVKVSMDGAPYLRKIDLKTYKNYKDLSTALEKMFSGFSNGKDGLSEYHKDGEYVLTYEDKDGDWMLVGDVPWEMFADSCRRLRIMKGSDAIGLAPRAADKSKNRN

SEQ ID NO: 1422 - protein, 246 aa, Zea mays subsp. mays
  misc_feature: Ceres CLONE ID no.100969565
  misc_feature: Bit score of 430.1 for HMM based on sequences of FIGURE 16.
  misc_feature (25)..(238): Pfam Name: AUX_IAA Pfam Description: AUX/IAA family
  misc_feature: Functional Homolog Of Ceres SEEDLINE ID no. ME18408 at SEQ ID NO. 1347
  misc_feature (186)..(186): Xaa is any aa, unknown, or other
MSPPLELDYIGLSPPAAAAAAENDELKGTELRLGLPGSGSPDRRVVAATATTLDLLPAKGAKRGFSDEAPPPSPVATAGKGKKVAEEEYDEKKVAATPQPAAKAQVVGWPPVCNYRKNTMTTTQLEGSKEDGDAKQGQGFLYVKVSMDGAPYLRKIDLKTYKNYKDLSTALEKMFSGFSTGKDGSXEYRKDGEYVLTYEDKDGDWMLVGDVPWEMFAGSCRRLRIMKGSDAIGLAPRAADKSKNRN

SEQ ID NO: 1423 - protein, 256 aa, Zea mays
  misc_feature: Ceres CLONE ID no.100861679
  misc_feature: Bit score of 411.0 for HMM based on sequences of FIGURE 16.
  misc_feature (25)..(248): Pfam Name: AUX_IAA Pfam Description: AUX/IAA family
  misc_feature: Functional Homolog Of Ceres SEEDLINE ID no. ME18408 at SEQ ID NO. 1347
MSPPLELDYIGLSPPAAAAAAENDELKGTELRLGLPGSGSPDRRVVAATATTLDLLPAKGAKRGFSDEAPPPSPVATAGKGKKVAEEEYDEKKVAATPQPAAKAQVVGWPPVCNYRKNTMTTTQLEGSKEDGDAKQGQGFLYVKVSMDGAPYLRKIDLKTYKNYKDLSTALEKMFSGFSTGKDGSSEYRKDGEYVLTYEDKDGDWMLVGDVPWDCHIVFRSNCRMFAGSCRRLRIMKGSDAIGLAPRAADKSKNRN

SEQ ID NO: 1424 - protein, 257 aa, Oryza sativa subsp. japonica
  misc_feature: Public GI ID no.75226278
  misc_feature: Bit score of 372.6 for HMM based on sequences of FIGURE 16.
  misc_feature (27)..(249): Pfam Name: AUX_IAA Pfam Description: AUX/IAA family
  misc_feature: Functional Homolog Of Ceres SEEDLINE ID no. ME18408 at SEQ ID NO. 1347
MSPPLELDYIGLSPPVPAAADAAADNDLKGTELRLGLPGSHSPDRSPPAATLDLLPAAKGAKRGFSDEARPLPASAAAAAAAGKGKKAAAGEEDEDAEEEDKKVAAAPQAPAAKAQVVGWPPIRSYRKNTMATNQLKSSKEDAEAKQGQGFLYVKVSMDGAPYLRKVDLKTYKNYKDLSTALEKMFIGFTTGKDGLSESRKDGEYVLTYEDKDGDWMLVGDVPWEMFANSCRRLRIMKGSDAIGLAPRAVDKSKNRN

SEQ ID NO: 1425 - protein, 266 aa, Oryza sativa subsp. indica
  misc_feature: Public GI ID no.125525030
  misc_feature: Bit score of 364.3 for HMM based on sequences of FIGURE 16.
  misc_feature (32)..(255): Pfam Name: AUX_IAA Pfam Description: AUX/IAA family
  misc_feature: Functional Homolog Of Ceres SEEDLINE ID no. ME18408 at SEQ ID NO. 1347
MSPPLELDYIGLSPPPPPPSSSSAAAARADDVDLKGTELRLGLPGSESPDRHPAAIAAAAATATTLELLPAKGAKRVFPDEAALTPPTAAAGKGKAAREGEEVGAEEEDKKVAAPPQPAAKAQVVGWPPIRSYRKNTMATNQIKSNKEDVDAKQGQGFLYVKVSMDGAPYLRKVDLKTYKNYKDMSLGLEKMFIGFSTGKEGAENQKDGEYVLTYEDKDGDWMLVGDVPWEMFTDSCRRLRIMKGSDAIGLGCSQLRLVPLFVPKL

SEQ ID NO: 1426 - protein, 263 aa, Oryza sativa subsp. japonica
  misc_feature: Public GI ID no.115435474
  misc_feature: Bit score of 355.9 for HMM based on sequences of FIGURE 16.
  misc_feature (32)..(255): Pfam Name: AUX_IAA Pfam Description: AUX/IAA family
  misc_feature: Functional Homolog Of Ceres SEEDLINE ID no. ME18408 at SEQ ID NO. 1347
MSPPLELDYIGLSPPPPPPSSSSAAAARADDVDLKGTELRLGLPGSESPDRRPAAIAAAAATATTLELLPAKGAKRVFPDEAALTPPTAAAGKGKAAREGEEVGAEEEDKKVAAPPQPAAKAQVVGWPPIRSYRKNTMATNQIKSNKEDVDAKQGQGFLYVKVSMDGAPYLRKVDLKTYKNYKDMSLGLEKMFIGFSTGKEGAENQKDGEYVLTYEDKDGDWMLVGDVPWEMFTDSCRRLRIMKGSDAIGLAPRAGEKSKNRN

SEQ ID NO: 1427 - protein, 189 aa, Pisum sativum
  misc_feature: Public GI ID no.1352057
  misc_feature: Bit score of 407.5 for HMM based on sequences of FIGURE 16.
  misc_feature (1)..(189): Pfam Name: AUX_IAA Pfam Description: AUX/IAA family
  misc_feature: Functional Homolog Of Ceres SEEDLINE ID no. ME18408 at SEQ ID NO. 1347
MEFKATELRLGLPGITEEEEKKIIHGSSVVKNNNKRQLPQTSEESVSISKVTNDEHIVESSSAAPPAKAKIVGWPPIRSYRKNSLHEADVGGIFVKVSMDGAPYLRKIDLRVYGGYSELLKALETMFKLTIGEYSEREGYKGSEYAPTYEDKDGDWMLVGDVPWDMFVTSCKRLRIMKGTEAKGLGCGV

SEQ ID NO: 1428 - DNA, 702 bp, Populus balsamifera subsp. trichocarpa
  misc_feature: Ceres ANNOT ID no.1453784
  misc_feature: Encodes the peptide sequence at SEQ ID NO. 1429
atggaacttcaacttggtctcggtcttccaagtgaaaaaacaatgaagggtttggacctaaacagctatgtttcggagcctaaagagttgctgggctcgggccaacttcacctgggttcatattcgtggttttctacaaatgataatgacaagaaacggagttttattgatgcctctgaagagagctcgagaaatgaagacgtgcctcgaacgctgcctctcttggtttggaataaccagccaaacgaggaagatgatccgcctaaagatcttgataaccactgcaactactctttttcctccaacaaaagtgatggagaaagtgatggaatagtggggtggccaccaataaagttcaagaggaagaagcttagtcgtcaaaacagtagagtgctagaggttaatcgggcagtggacaatggttgtgaagattgccaagctagatcatcaaactccatgtacattaaggtcaagatggagggagtaggaatagcaaggaaaattgatgttagcgtctaccgttgctttccaacacttaaacatacgttgcttgacatgtttgggatctgccaggaaaattcaagcaactacagactgacttaccaggatagagaaggtgactggctactagctgaagatgtaccttggaggaactttcttgggtcagtccaacgactaaaactgatgaggagcagcaattga

SEQ ID NO: 1429 - protein, 233 aa, Populus balsamifera subsp. trichocarpa
  misc_feature: Ceres ANNOT ID no.1453784
  misc_feature: Bit score of 491.5 for HMM based on sequences of FIGURE 16.
  misc_feature (1)..(233): Pfam Name: AUX_IAA Pfam Description: AUX/IAA family
  misc_feature: Functional Homolog Of Ceres SEEDLINE ID no. ME18408 at SEQ ID NO. 1347
MELQLGLGLPSEKTMKGLDLNSYVSEPKELLGSGQLHLGSYSWFSTNDNDKKRSFIDASEESSRNEDVPRTLPLLVWNNQPNEEDDPPKDLDNHCNYSFSSNKSDGESDGIVGWPPIKFKRKKLSRQNSRVLEVNRAVDNGCEDCQARSSNSMYIKVKMEGVGIARKIDVSVYRCFPTLKHTLLDMFGICQENSSNYRLTYQDREGDWLLAEDVPWRNFLGSVQRLKLMRSSN

SEQ ID NO: 1430 - protein, 187 aa, Pisum sativum
  misc_feature: Public GI ID no.452777
  misc_feature: Bit score of 392.4 for HMM based on sequences of FIGURE 16.
  misc_feature (1)..(187): Pfam Name: AUX_IAA Pfam Description: AUX/IAA family
  misc_feature: Functional Homolog Of Ceres SEEDLINE ID no. ME18408 at SEQ ID NO. 1347
MEFKATELRLGLPGITEEEEKKIIHGSSVVKNNNKRQLPQTSEESVSISKVTNDEHIVESSSAAPPAKAKIVGWPPIRSYRKNSLHEADVGGIFVKVSMDGAPYLRKIDLRVYGGYSELLKALETMFKLTIGEYSEREGYKGSEYAPTYEDKDGDWMLVGDVPWDVTSCKRLRIMKGTEAKGLGCGV

SEQ ID NO: 1431 - protein, 213 aa, Medicago truncatula
  misc_feature: Public GI ID no.92873297
  misc_feature: Bit score of 421.6 for HMM based on sequences of FIGURE 16.
  misc_feature (90)..(160): Pfam Name: AUX_IAA Pfam Description: AUX/IAA family
  misc_feature: Functional Homolog Of Ceres SEEDLINE ID no. ME18408 at SEQ ID NO. 1347
MELQSGLALPIHSSIEGFDPYNSDLNNHIRGSENIKYVKNKRSFDESFGDFSKPLPLLVWSGQPNEEDGRSEKKNRSIHTSNNEGENHLVGWPPIKSWRKKEFHDQQLPEHIRKANENQNRRSKPLYVKVNMEGVGMGRQINLRLYNSYQTLKDSLISMFVKCQNFEETGANYTLTFQNKQGEWKLTSHITWQSFIGTVRRLAILRNGECETI

SEQ ID NO: 1432 - DNA, 1369 bp, Musa acuminata
  misc_feature: Ceres CLONE ID no.1728516
  misc_feature: Encodes the peptide sequence at SEQ ID NO. 1433
aatgtcaccacctctcgagcatgattacataggcctgtcggagctccccttctctgctgcagccgctgccggcgcagccgaggatggggcgcttaacctgaaggagacggaactgcggctgggcctccccggatcggagtcccccgaccggaaggagaaggtgggcctcaccctggggctccttcccaaggtgttcggctccggtgccaagcgcgggttctccgacgccatcgacggggccgggaagtgggaactcgcctccgggggatgtggatccgaggtggaaggcgggaaaggtggcgccttgttctcgccgaggggggaggacggctgcgggcagctgtccgggcacgggaacgctggcaaagatgtggtgccgaaggcggacgggccggagaggaaggccgctggacaggtcgggagctccgctgggaatgatcgcggcgtggcgcctgctgccaaggcacaggtggtaggttggccaccaatccgtagctaccgtaaaaacacgatggctacaaacccatcaaaggacaaagaagatgctgatgaaaaacaaggtccaggatgtctttacgttaaggtcagcatggatggagcaccgtacctccggaaagtcgacctaaaagcatacaacaactataaggagctctcctcggcactcgagaagatgtttagctgcttcaccattggtcagtgtggttctcatggaataccaggccgagatggattatctgagagcaggttgacggatcttctgaatggatctgaatatgtgctcacttatgaagacaaggatggtgactggatgcttgtcggtgatgtaccatgggagatgttcaccaactcctgcaagaggatgaggattatgaagggttcagatgcaattggacttgctccaagggccatggagaaatgcaagaaccgaattaggatcagcttctgacccttaactgaaatcagaagagccctccttgagactgaaagggttaacaagatcacttggctactctcttacatctaccatgtgccatggctttctgctttatatggactaagacttcgtgctagctttctaagattccctagggacataagctctgtagtttgtaagattgtgtgttcagtacttgcgcatgtctcgttatcactgtctgtctaaacatttggcttgctgtctgcaactgttatagttgaagttccctatttgaaattgtagttcacaaggccctattgtctcttgtcctaatcctaacaatcaaagtcaaagttacccaacaacgaccacctctggtcggaacaaaactatcgaaaggcagcttttttgtgtgtacttgttcccaaatcaatgtcagtgaatgaattggac

SEQ ID NO: 1433 - protein, 314 aa, Musa acuminata
  misc_feature: Ceres CLONE ID no.1728516
  misc_feature: Bit score of 254.7 for HMM based on sequences of FIGURE 16.
  misc_feature (31)..(302): Pfam Name: AUX_IAA Pfam Description: AUX/IAA family
  misc_feature: Functional Homolog Of Ceres SEEDLINE ID no. ME18408 at SEQ ID NO. 1347
MSPPLEHDYIGLSELPFSAAAAAGAAEDGALNLKETELRLGLPGSESPDRKEKVGLTLGLLPKVFGSGAKRGFSDAIDGAGKWELASGGCGSEVEGGKGGALFSPRGEDGCGQLSGHGNAGKDVVPKADGPERKAAGQVGSSAGNDRGVAPAAKAQVVGWPPIRSYRKNTMATNPSKDKEDADEKQGPGCLYVKVSMDGAPYLRKVDLKAYNNYKELSSALEKMFSCFTIGQCGSHGIPGRDGLSESRLTDLLNGSEYVLTYEDKDGDWMLVGDVPWEMFTNSCKRMRIMKGSDAIGLAPRAMEKCKNRIRISF

SEQ ID NO: 1434 - protein, 266 aa, Oryza sativa subsp. japonica
  misc_feature: Public GI ID no.115467910
  misc_feature: Bit score of 250.6 for HMM based on sequences of FIGURE 16.
  misc_feature (21)..(258): Pfam Name: AUX_IAA Pfam Description: AUX/IAA family
  misc_feature: Functional Homolog Of Ceres SEEDLINE ID no. ME18408 at SEQ ID NO. 1347
MAPPQERDYIGLSPAAAAALATELRLGLPGTAEEAESEGGGGGGTDAAPLTLELLPKGGAKRGFADAIVGGPAGQRREAAGGKAAAAAAEAEEEEEKKKAQAPAAKAQVVGWPPIRSYRKNTMAMSQPALKGKDDGEAKQAPASGCLYVKVSMDGAPYLRKVDLKMYKNYKELSLALEKMFSCFTVGHGESNGKSGRDGLSDCRLMDLKNGTELVLTYEDKDEDWMLVGDVPWRMFTDSCRRLRIMKGSDAVGLAPRATDKSKNRN

SEQ ID NO: 1435 - protein, 186 aa, Arabidopsis thaliana; identical to SEQ ID NO: 197
  misc_feature: Public GI ID no.15239950
  misc_feature: Bit score of 308.0 for HMM based on sequences of FIGURE 16.
  misc_feature (11)..(185): Pfam Name: AUX_IAA Pfam Description: AUX/IAA family
  misc_feature: Functional Homolog Of Ceres SEEDLINE ID no. ME18408 at SEQ ID NO. 1347

SEQ ID NO: 1436 - protein, 179 aa, Nicotiana tabacum
  misc_feature: Public GI ID no.4887012
  misc_feature: Bit score of 311.3 for HMM based on sequences of FIGURE 16.
  misc_feature (11)..(179): Pfam Name: AUX_IAA Pfam Description: AUX/IAA family
  misc_feature: Functional Homolog Of Ceres SEEDLINE ID no. ME18408 at SEQ ID NO. 1347
MECVMAHEKDLNLKATELRLGLPGTEDESIVSSSKNKKRGLPESAEDEDCESKKKTQIVGWPPVRSYRKNNIQPKKTETECGMYVKVSMDGAPYLRKIDLKMYKGYAELLKALENMFKLSIGEYSEREGYNGSEFAPAYEDKDGDLMLVGDVPWDMFLSSCKRLRIMKGSEARGLGCGV

SEQ ID NO: 1437 - DNA, 702 bp, Populus balsamifera subsp. trichocarpa
  misc_feature: Ceres ANNOT ID no.1478544
  misc_feature: Encodes the peptide sequence at SEQ ID NO. 1438
atggaacttcaacttggtctcggtctcccaagtgagaaaacaatgaagggtttagacctaaacagctatgtttctgagcctaaagggttgctgggctcgggacaacttcaactgggtcaatattcatggttttctacgaatgctaatgacaagaaacggagttttattgatgcctttgaagagagctcaggaaatgaagatgggcctcaaacgttacctctcttggtttggaataaccagccaaacgacgaagatgatttccctaaagatctcgacaaccatagtagcaactcttgtgcctccaacaaaagtgatggagaaagtgattggatagtggggtggccaccaataaagttcaagaagaagaagcttagtcgtcaaagcagcagggcgctagagatcaatcgggcagtggacaatggttatgaagattgccaagctagaacatcaaagtatatgtacattaaggtcaagatggagggggtaggaatagcaaggaaaattgatgttagcctccaccattcttttccaacactcaagcagaccttgcttgacatgtttgggatatgccaggaaaattcaagcaactacagactgacttaccaggatagagaaggtgactggctactagctgaagatgtaccttggaggaactttcttgggacagtccaactactaaaattgatgaggagaagcagctga

SEQ ID NO: 1438 - protein, 233 aa, Populus balsamifera subsp. trichocarpa
  misc_feature: Ceres ANNOT ID no.1478544
  misc_feature: Bit score of 405.5 for HMM based on sequences of FIGURE 16.
  misc_feature (1)..(232): Pfam Name: AUX_IAA Pfam Description: AUX/IAA family
  misc_feature: Functional Homolog Of Ceres SEEDLINE ID no. ME18408 at SEQ ID NO. 1347
MELQLGLGLPSEKTMKGLDLNSYVSEPKGLLGSGQLQLGQYSWFSTNANDKKRSFIDAFEESSGNEDGPQTLPLLVWNNQPNDEDDFPKDLDNHSSNSCASNKSDGESDWIVGWPPIKFKKKKLSRQSSRALEINRAVDNGYEDCQARTSKYMYIKVKMEGVGIARKIDVSLHHSFPTLKQTLLDMFGICQENSSNYRLTYQDREGDWLLAEDVPWRNFLGTVQLLKLMRRSS

SEQ ID NO: 1439 - protein, 305 aa, Striga asiatica
  misc_feature: Public GI ID no.90811713
  misc_feature: Bit score of 286.9 for HMM based on sequences of FIGURE 16.
  misc_feature (65)..(297): Pfam Name: AUX_IAA Pfam Description: AUX/IAA family
  misc_feature: Functional Homolog Of Ceres SEEDLINE ID no. ME18408 at SEQ ID NO. 1347
MTPPFSGIEGQNQFNAHLMASSSSADCITQNTLGLKERNYLGLSDCSSVDSSTVSSSPDEGKTNLNLKATELRLGLPGSQSPKRDLDFSLLSSVNKLDEKQLFPLVPNTVIVSGNKRGFSDTVNANWMFNADSGLPKTTVKKEAPEKDTVEFSNKMNGSNTNNAPAAKAQVVGWPPIRSFRKNTLAITSKVNDEVDGKPGPSALYVKVSMDGAPYLRKVDLRSYATYQELSSALEKMFSCFTIGQCGAQGTENVLTYEDKDGDWMLVGDVPWEMFIASCKRLKIMKGSDAIGLAPRAVEKSKNRN

SEQ ID NO: 1440 - protein, 349 aa, Solanum tuberosum
  misc_feature: Public GI ID no.25989504
  misc_feature: Bit score of 253.5 for HMM based on sequences of FIGURE 16.
  misc_feature (67)..(341): Pfam Name: AUX_IAA Pfam Description: AUX/IAA family
  misc_feature (67)..(341): Pfam Name: AUX_IAA Pfam Description: AUX/IAA family
  misc_feature: Functional Homolog Of Ceres SEEDLINE ID no. ME18408 at SEQ ID NO. 1347
MSPPLLGVGEEEGQSNVTLLASSTSLGSICKKGSALKERNYMGLSDCSSVDSCNISTSSEDNNGCGLNLKATELRLGLPGSQSPERGEETCPVSSTKVDEKLLFPLHPAKDTAFSVSQKTVVTGNKRGFSDTMDGFSEGKFLSNSGVKSGDAKETSRVQPSKMKDANTQSTVPERPSAVNDASNRAGSGAPATKAQVVGWPPIRSFRKNTLASASKNNEEVDGKAGSPALFIKVSMDGAPYLRKVDLRTYSAYQELSSALETMFSCFTIGQYGSHGAPGKDMLSESKLKDLLHGSEYVLTYEDKDGDWMLVGDVPWEMFIDTCKRLRIMKGSDAIGLAPRAMEKCRSRN

SEQ ID NO: 1441 - DNA, 1596 bp, Glycine max
  misc_feature: Ceres CLONE ID no.1113354
  misc_feature: Encodes the peptide sequence at SEQ ID NO. 1442
attctcttttgcacagtaatgcaatcacaatctctcattcccagttcaatattcccatttcttcctttttctttttttgttacaccacacacaattccattgctaccagtttaacagaatgcatagagttttataataatatcatagaaacaaactgaacacataaaaattcagttcagagaagcttctcttcatcaaagcttcatatttttatttttattgtataaactctaattctcaaccttagtttctgtttccttatctctctcttgttttccacttttttgaaaagaagtgatactgtgtggtagtagtgtgagctgaagtttgatgtctgtgtcattggagcaagaaggctatgtaggcttatcagaggttcctgcaatggaaggttgttctgagaggactggtggtggcttgaacctcaaggctactgagctgaggcttggtttgccaggttctgagtcaccagagagagaagagggtgtggaggacaagaatgtgcaccctttaggcatggtgaagtgtttggtgtcaggggccaagaggggtttctcagacaccattgatgggggttctgggaagtggcttctttctgggaatagtggatctgaggtgggtttggggaaagatggtggcttcttctctccaaggggtgttggtgttagtgttagtgctgccaaggctgagtgtaccaaccaacaaacttgtgttgtaaaagataaagttcctcaatctccaaagccgttgaatgagaagaagcctcagatatctgttcctgctgcaaaggaacaagttgtgggatggccaccaatccgttctttcagaaagaactcaatggccactcagccacaaaagaatgatgataatgcagaagccaagtcggtatgcctttatgtgaaggtcagcatggatggtgctccatacttgaggaaagttgacctcaaaaactttggcacttacatggaactgtcttcagcactggaaaagatgtttagttgttttacaatcagtcaatgtggttcccatggagtttgtggtcgagataagttgactgaaaatagattgatggatctcctccatggttcagaatatgtgctcacctatgaagacaaggatggtgattggatgcttgttggtgatgttccatgggagatgttcaccgactcttgcaagaggttgaggataatgaagagttctgaagcaattggactagcaccaagagccatggaaaaatgcaaaagtcgcaactagcaagatggtgttgatacagaaagatgaattattattattacctttaaacacgtacatcatacaagagtccagaggcaagtgcagggcacaagctggggcttttcttgcttgaatatgtatgatataatcctacatatgggatccaagtatcctagactttttagtaggcaagatatgtttgttgtagacatttaaggtttcttaggcttgtttcccctcacttctcttcaatcactgtcactgtggacttcataagactgaagctacgtcgttactatgtaaattttgtaacttaagtctcatatatagattagtttgagatggttaaaaaaaaaaaaaaaa

SEQ ID NO: 1442 - protein, 307 aa, Glycine max
  misc_feature: Ceres CLONE ID no.1113354
  misc_feature: Bit score of 250.7 for HMM based on sequences of FIGURE 16.
  misc_feature (30)..(299): Pfam Name: AUX_IAA Pfam Description: AUX/IAA family
  misc_feature: Functional Homolog Of Ceres SEEDLINE ID no. ME18408 at SEQ ID NO. 1347
MSVSLEQEGYVGLSEVPAMEGCSERTGGGLNLKATELRLGLPGSESPEREEGVEDKNVHPLGMVKCLVSGAKRGFSDTIDGGSGKWLLSGNSGSEVGLGKDGGFFSPRGVGVSVSAAKAECTNQQTCVVKDKVPQSPKPLNEKKPQISVPAAKEQVVGWPPIRSFRKNSMATQPQKNDDNAEAKSVCLYVKVSMDGAPYLRKVDLKNFGTYMELSSALEKMFSCFTISQCGSHGVCGRDKLTENRLMDLLHGSEYVLTYEDKDGDWMLVGDVPWEMFTDSCKRLRIMKSSEAIGLAPRAMEKCKSRN

SEQ ID NO: 1443 - DNA, 919 bp, Glycine max
  misc_feature: Ceres CLONE ID no.1113630
  misc_feature: Encodes the peptide sequence at SEQ ID NO. 1444
attttcccaaattctcattatctctctctctctctgtttcgctttcaccgaagaataacttgactttcccgaactccacctgagaaaaagatacccttaattcgcaggcgcgtcttgtgttggacaacaaccacaagatgattaacttcgaagaaaccgagttgcgactcggcctccctggcaacgactcagcactcaagggaagtgctgccaagagaggcttctctgaaactgcttctgttgatttgaagcttaatctttcttcttgcattaacgactctgcctcggattcaccctcatctgtgtctacagagaagcccaaagagaacaagactaccactgctgaacctcctccagctaatgatccagcaaaaccacctgcaaaggcacaagtggtgggttggccaccagttaggtcatttagaaagaacatagttcaaaggaacagcaatgaagaagaggcagagaagagcacgaagaatgctttcgtgaaggtgagcatggatggtgcaccgtatctacgaaaggtggacataaagttgtacaagagctaccaggagctgtcagatgcgctggctaagatgttcagttccttcacgattgaaaagtgtgggtcccaagggatgaaggactttatgaatgagaccaatggctctgactatgtacccacatatgaagacaaggacggagactggatgctcgtcggtgatgtgccctgggagatgttcgttgaatcatgcaagcgtcttcgcataatgaaaggctccgaggcaatcggtcttgcgccaagagccgtggaaaagtgcaagaacagaagctgaagaagtgatttcatctgcgtcacaaggaagcaaattgactcgagcaagatcgagtctaatataggaataagagtttaattatcatgtgcctttgttat

SEQ ID NO: 1444 - protein, 227 aa, Glycine max
  misc_feature: Ceres CLONE ID no.1113630
  misc_feature: Bit score of 262.0 for HMM based on sequences of FIGURE 16.
  misc_feature (2)..(219): Pfam Name: AUX_IAA Pfam Description: AUX/IAA family
  misc_feature: Functional Homolog Of Ceres SEEDLINE ID no. ME18408 at SEQ ID NO. 1347
MINFEETELRLGLPGNDSALKGSAAKRGFSETASVDLKLNLSSCINDSASDSPSSVSTEKPKENKTTTAEPPPANDPAKPPAKAQVVGWPPVRSFRKNIVQRNSNEEEAEKSTKNAFVKVSMDGAPYLRKVDIKLYKSYQELSDALAKMFSSFTIEKCGSQGMKDFMNETNGSDYVPTYEDKDGDWMLVGDVPWEMFVESCKRLRIMKGSEAIGLAPRAVEKCKNRS

SEQ ID NO: 1445 - DNA, 750 bp, Sorghum bicolor
  misc_feature: Ceres ANNOT ID no.6072030
  misc_feature: Encodes the peptide sequence at SEQ ID NO. 1446
atgtcgcccccactcgagctcgactacataggcctctcgccgcagccggccgccgccgccgccgccgccgatgccgacgacgacctgaagggtaccgagctccgcctcggtctgccagggtccgggtcgccggaccgccgtgtcgcggctgccaccgctaccaccctggagctgctcccggccaagggcgccaagcgcgggttttctgacgaggcgcccccgccatctcccgctgccgctgccgggaagggaaagaaggtggcggaagaggaggacgacgacaagaaggttgcagcgacgccgcagccggccgcaaaagctcaggtggtgggatggccaccaatccgcagctaccgcaagaacacgatggctaccacccagctgaagggtagcaaggaggatactgaggccaagcagggccagggattcctgtacgtcaaggtcagcatggatggcgcgccgtacctgaggaagattgacctcaagacttacaagaactacaaggacctgtctactgcgcttgagaagatgttcagtggcttcagtactggcaaggatggcttatctgagtaccgcaaggatggtgaatatgttttgacttatgaggacaaggatggagattggatgcttgtcggcgatgtaccatgggagatgttcgctgactcttgccgcaggctcaggatcatgaaaggatcagatgcaattggacttgctccaagggcagctgataagtccaagaaccgcaactag

SEQ ID NO: 1446 - protein, 249 aa, Sorghum bicolor
  misc_feature: Ceres ANNOT ID no.6072030
  misc_feature: Bit score of 434.3 for HMM based on sequences of FIGURE 16.
  misc_feature (28)..(241): Pfam Name: AUX_IAA Pfam Description: AUX/IAA family
  misc_feature: Functional Homolog Of Ceres SEEDLINE ID no. ME18408 at SEQ ID NO. 1347
MSPPLELDYIGLSPQPAAAAAAADADDDLKGTELRLGLPGSGSPDRRVAAATATTLELLPAKGAKRGFSDEAPPPSPAAAAGKGKKVAEEEDDDKKVAATPQPAAKAQVVGWPPIRSYRKNTMATTQLKGSKEDTEAKQGQGFLYVKVSMDGAPYLRKIDLKTYKNYKDLSTALEKMFSGFSTGKDGLSEYRKDGEYVLTYEDKDGDWMLVGDVPWEMFADSCRRLRIMKGSDAIGLAPRAADKSKNRN

SEQ ID NO: 1447 - DNA, 591 bp, Sorghum bicolor
  misc_feature: Ceres ANNOT ID no.6025654
  misc_feature: Encodes the peptide sequence at SEQ ID NO. 1448
atggagctggagctcgggctcgcgctgccaaacccgtaccagtcgccgatggccgccggcggggagctcgtcggtctgctcagcggctcggcgggcgcgtgcgggaagaagagggtgttcggcgacgcgttcggggccgccgccaaggccacgcttcttccgctcttcgtgcacgaggatggtgacggcggcagcggcgaccacgacgatgtcgaccatgatccaagcaacaagaagaagaggctggttgggtggccgccggtgaagtgcgcgcgcaggcggagctgcggcggcggcggtggttacgtgaaggtcaagatggaaggggtggccatcgggcggaaggtggacgtgtccctccacggctcgtaccaggagctgctccgcacgctcgagcgcatgttcccctcggctaaccaacaaggtcatgcagaagaagaggaggtggtggcctcgcacgcagagcgccgccgtcgccatccgtacgtggtcacctacgaggacggcgaaggggactggttgctcgtcggagatgatgtgccgtgggaggtctttgtgaagtcagtgaagcggctcaagatacttgcgtag

SEQ ID NO: 1448 - protein, 196 aa, Sorghum bicolor
  misc_feature: Ceres ANNOT ID no.6025654
  misc_feature: Bit score of 112.0 for HMM based on sequences of FIGURE 16.
  misc_feature (1)..(196): Pfam Name: AUX_IAA Pfam Description: AUX/IAA family
  misc_feature: Functional Homolog Of Ceres SEEDLINE ID no. ME18408 at SEQ ID NO. 1347
MELELGLALPNPYQSPMAAGGELVGLLSGSAGACGKKRVFGDAFGAAAKATLLPLFVHEDGDGGSGDHDDVDHDPSNKKKRLVGWPPVKCARRRSCGGGGGYVKVKMEGVAIGRKVDVSLHGSYQELLRTLERMFPSANQQGHAEEEEVVASHAERRRRHPYVVTYEDGEGDWLLVGDDVPWEVFVKSVKRLKILA

SEQ ID NO: 1449 - DNA, 594 bp, Sorghum bicolor
  misc_feature: Ceres ANNOT ID no.6091150
  misc_feature: Encodes the peptide sequence at SEQ ID NO. 1450
atggagctggagctcgggctggcgccgccgagcgcgcgtcaccccattcccatgacgatcgaccacctcaccgccgaagacgagctgagcagcacctcgtcggaccaccaccaccacccttgtgctgcgcgcgccgggaagagagcgttcgcggaagcgttccaggaggcagcggcgacgacgacgacaacgctgccgctcttcgatgacggctcgtcgtgcggcgggacgaacggcagcagcagcaagaggccgctggtcgggtggccgccggtgagctccgcgcgcagcagggcatgcggtgtcggcggcgccaagtacgtgaaggtgaagaaggaaggcgacgccatcggcaggaaggtggacttgtcgctccacgcctcctacgacgagctcctcgccacgctctcccgcatgttcccgaccaccggctgcaacaaagacgacaaggagatcagcagctccagcagcagcaccagccatgtggacgtggtggtcacttacgaagatggagaaggggactggatgctggtcggagatgtgccatggaatgattttgcaaggtccgtcaagcggctcaagatactgggatga

SEQ ID NO: 1450 - protein, 197 aa, Sorghum bicolor
  misc_feature: Ceres ANNOT ID no.6091150
  misc_feature: Bit score of 63.5 for HMM based on sequences of FIGURE 16.
  misc_feature (87)..(195): Pfam Name: AUX_IAA Pfam Description: AUX/IAA family
  misc_feature: Functional Homolog Of Ceres SEEDLINE ID no. ME18408 at SEQ ID NO. 1347
MELELGLAPPSARHPIPMTIDHLTAEDELSSTSSDHHHHPCAARAGKRAFAEAFQEAAATTTTTLPLFDDGSSCGGTNGSSSKRPLVGWPPVSSARSRACGVGGAKYVKVKKEGDAIGRKVDLSLHASYDELLATLSRMFPTTGCNKDDKEISSSSSSTSHVDVVVTYEDGEGDWMLVGDVPWNDFARSVKRLKILG

SEQ ID NO: 1451 - DNA, 561 bp, Sorghum bicolor
  misc_feature: Ceres ANNOT ID no.6100390
  misc_feature: Encodes the peptide sequence at SEQ ID NO. 1452
atggagatgatcgacgcggagctgcgtcttggtccgcctgggagcaacagcgacgtcgtcgtcaccgtcgtgcagccgacgaggacgccggcgtcggcggcggcgaaacggcggccggagtcgtcggtggtgaagagcgaggcgtccgggacggacgaccatgacgacgcggcaccggcctccaaggtgcaggtggtggggtggccgccggtgagagcgtaccggaagaacgcgttccacgcggcggcggaggcgaggagggcgacaaagggcggcgagcagcaaggatctggcctgtacgtgaaggtgagcatggacggggcgccctacctccggaaggtcgacctgcggacctacggcggctaccgggagctgagagacgcgctggacacgctcttcggttgcttctcctcctctgccgccgccgacggcggctgccagttcgccatcgcctacgaggacaaggacggcgacctcatgctcgccggcgacgtgccctgggagatgttcatctgttcttgcaagaagctgaggatcatgagggggtccgaagcaagataa

SEQ ID NO: 1452 - protein, 186 aa, Sorghum bicolor
  misc_feature: Ceres ANNOT ID no.6100390
  misc_feature: Bit score of 211.4 for HMM based on sequences of FIGURE 16.
  misc_feature (55)..(186): Pfam Name: AUX_IAA Pfam Description: AUX/IAA family
  misc_feature: Functional Homolog Of Ceres SEEDLINE ID no. ME18408 at SEQ ID NO. 1347
MEMIDAELRLGPPGSNSDVVVTVVQPTRTPASAAAKRRPESSVVKSEASGTDDHDDAAPASKVQVVGWPPVRAYRKNAFHAAAEARRATKGGEQQGSGLYVKVSMDGAPYLRKVDLRTYGGYRELRDALDTLFGCFSSSAAADGGCQFAIAYEDKDGDLMLAGDVPWEMFICSCKKLRIMRGSEAR

SEQ ID NO: 1453 - DNA, 1194 bp, Arabidopsis thaliana
  misc_feature: Ceres SEEDLINE ID no.ME19304
  misc_feature: Predicted Sequence
  misc_feature: Expected Sequence
  misc_feature: Encodes the peptide sequence at SEQ ID NO. 1457
atggattttaatgccggagttcccatgtcttctctttcacctttgatgaatcaagatgcaatgtggcaaatgaatttgagttcagatgaaacaatggaaactggttcttaccctgaacgaccaggagagcctgattgttcttattacataagaactggtctttgtagatttggctctacttgtcggttcaaccatcctcgtgatcgggaactggttatagctactgcaaggatgagaggagaataccctgaaaggattggtcagcctgaatgcgagtactatttgaagacaggaacctgcaagtttggagtaacatgtaagtttcatcatccaaggaacaaagctgggattgctggaagagtctctctcaatatgttaggctatcctctacgctcgaatgaggttgattgtgcttatttcctaagaaccggacactgtaaatttggtggtacttgtaaattcaaccaccctcagcctcaaccaaccaacatgatggttcctacctcagggcaacagtcttatccttggtcaagagcttcttttattgccagccctcgttggcaagatccgtctagctacgcttccttaatcatgcctcaaggagttgtcccggttcaaggatggaacccttacagtggtcagctcggctcagtttctccttcaggtaccggaaatgatcaaaactacagaaatttacagcagaacgagacaatagagtcaggctctcagtctcaaggatcattctcgggttacaatccgggatcctctgttccgctaggagggtattatgcattgccgagggaaaatgtgttcccggagagaccaggacaacccgaatgccaattctacatgaagacaggtgactgcaaatttggcacagtttgcaaatttcaccatcctagagacagacaagctcctcctcctgattgtctcttaagctccattggcctccccttacgcccgggagaaccgttgtgtgtgttctatacacgctatggaatctgcaaatttggtccaagctgtaaatttgatcacccaatgcgagtattcacatacgacaacacagcttcagagacagatgaggtagtggaaacatcaacagggaaatctagaagactctctgtgtctgaaacaagacaagcagcaacaacatcctctggtaaagacactaccattgataatacacagcagtga

SEQ ID NO: 1454 - DNA, 1194 bp, Arabidopsis thaliana
  misc_feature: Ceres SEEDLINE ID no.ME19304
  misc_feature: Inplanta Sequence
  misc_feature: Predicted Sequence
  misc_feature: Encodes the peptide sequence at SEQ ID NO. 1457
atggattttaatgccggagttcccatgtcttctctttcacctttgatgaatcaagatgcaatgtggcaaatgaatttgagttcagatgaaacaatggaaactggttcttaccctgaacgaccaggagagcctgattgttcttattacataagaactggtctttgtagatttggctctacttgtcggttcaaccatcctcgtgatcgggaactggttatagctactgcaaggatgagaggagaataccctgaaaggattggtcagcctgaatgcgagtactatttgaagacaggaacctgcaagtttggagtaacatgtaagtttcatcatccaaggaacaaagctgggattgctggaagagtctctctcaatatgttaggctatcctctacgctcgaatgaggttgattgtgcttatttcctaagaaccggacactgtaaatttggtggtacttgtaaattcaaccaccctcagcctcaaccaaccaacatgatggttcctacctcagggcaacagtcttatccttggtcaagagcttcttttattgccagccctcgttggcaagatccgtctagctacgcttccttaatcatgcctcgaggagttgtcccggttcaaggatggaacccttacagtggtcagctcggctcagtttctccttcaggtaccggaaatgatcaaaactacagaaatttacagcagaacgagacaatagagtcaggctctcagtctcaaggatcattctcgggttacaatccgggatcctctgttccgctaggagggtattatgcattgccgagggaaaatgtgttcccggagagaccaggacaacccgaatgccaattctacatgaagacaggtgactgcaaatttggcacagtttgcaaatttcaccatcctagagacagacaagctcctcctcctgattgtctcttaagctccattggcctctccttacgcccgggagaaccgttgtgtgtgttctatacacgctatggaatctgcaaatttggtccaagctgtaaatttgatcacccaatgcgagtattcacatacgacaacacagcttcagagacagatgaggtagtggaaacatcaacagggaaatctagaagactctctgtgtctgaaacaagacaagcagcaacaacatcctctggtaaagacactaccattgataatacacagcagtga

SEQ ID NO: 1455 - DNA, 2274 bp, Arabidopsis thaliana
  misc_feature: Ceres SEEDLINE ID no.ME19304
  misc_feature: Genomic Sequence
  misc_feature: Expected Sequence
  misc_feature: Encodes the peptide sequence at SEQ ID NO. 1457
acctctctgtttacacgattcttcttcttcttcttcttcttctttagatgtcttcttcctccattgtcatctacctctctacacttcattttcttgttggaagaagatcgattaccggtgactcattcttagtgatgacagtataatgtctgatgcttattatcatcatcatcatcatcggagacattcttcctcttcacgtctatggattttaatgccggagttcccatgtcttctctttcacctttgatgaatcaaggtcctatcaatttcttctttcttttctctgttttgatcggcaaattttggttatttgttttgtttttaaacggattgggtttaatctcagtttcttcttcttggtttgggttgtggtttatgatcagatgcaatgtggcaaatgaatttgagttcagatgaaacaatggaaactggttcttaccctgaacgaccaggagagcctgattgttcttattacataagaactggtctttgtagatttggctctacttgtcggttcaaccatcctcgtgatcgggaactggtacgttatggtttttgtgttcctctctgtgattttggagtttagagatctgtctggtcggattataatgtcaaagcttttgccttttggaattttgtttttgagctcttctctctcattgtccaatttctaggttatagctactgcaaggatgagaggagaataccctgaaaggattggtcagcctgaatgcgaggtaagaatctttggtttgtccagttgtagatgaacattttgtcaaggtttggtaattgagtcatcttcttacacaaactaacttaacattttgtggtgttgtatgttttggttgcgcagtactatttgaagacaggaacctgcaagtttggagtaacatgtaagtttcatcatccaaggaacaaagctgggattgctggaagagtctctctcaatatgttaggctatcctctacgctcggtatatttgactttttgacttgctgatttcattacttctcattgtttcatcatcttagtgattctctgtaatgtcatatatgcagaatgaggttgattgtgcttatttcctaagaaccggacactgtaaatttggtggtacttgtaaattcaaccaccctcagcctcaaccaaccaacatgatggttcctacctcagggcaacagtcttatccttggtcaagagcttcttttattgccagccctcgttggcaagatccgtctagctacgcttccttaatcatgcctcaaggagttgtcccggttcaaggatggaacccttacagtgtaagttttctaaacaacattgcttatactcttcagactttatatgacttggttttgatttctgtcgagtgtttctcggggtttccatttcgttagggtcagctcggctcagtttctccttcaggtaccggaaatgatcaaaactacagaaatttacagcagaacgagacaatagagtcaggctctcagtctcaaggatcattctcgggttacaatccgggatcctctgttccgctaggagggtattatgcattgccgagggaaaatgtgttcccggagagaccaggacaacccgaatgccaattctacatgaagacaggtgactgcaaatttggcacagtttgcaaatttcaccatcctagagacagacaagctcctcctcctgattgtctcttaagctccattggcctccccttacgcccggtaagctcaaagacttgtgcataattacttggttctcttcgattaaatctctgcattgtttgattttttttctttctcaaaatgatagggagaaccgttgtgtgtgttctatacacgctatggaatctgcaaatttggtccaagctgtaaatttgatcacccaatgcgagtattcacatacgacaacacagcttcagagacagatgaggtagtggaaacatcaacagggaaatctagaagactctctgtgtctgaaacaagacaagcagcaacaacatcctctggtaaagacactaccattgataatacacagcagtgaagaaacaaaggaagaagaagaagagcttttaaacaagaagaaaaacaaaagctttttgatttttcaaaagaggaatctgtaaattctcattttcatttagtctctcaagcatttattaataatgtatagaggtgatttatacaactgatcttgatcttgatctgatcgccattgttgtaatattcttttggcgaatcaggttcaataaaattgaaagtaatttccctc

SEQ ID NO: 1456 - DNA, 1842 bp, Arabidopsis thaliana
  misc_feature: Ceres SEEDLINE ID no.ME19304
  misc_feature: Genomic Sequence
  misc_feature: Inplanta Sequence
  misc_feature: Encodes the peptide sequence at SEQ ID NO. 1457
atggattttaatgccggagttcccatgtcttctctttcacctttgatgaatcaaggtcctatcaatttcttctttcttttctctgttttgatcggcaaattttggttatttgttttgtttttaaacggattgggtttaatctcagtttcttcttcttggtttgggttgtggtttatgatcagatgcaatgtggcaaatgaatttgagttcagatgaaacaatggaaactggttcttaccctgaacgaccaggagagcctgattgttcttattacataagaactggtctttgtagatttggctctacttgtcggttcaaccatcctcgtgatcgggaactggtacgttatggtttttgtgttcctctctgtgattttggagtttagagatctgtctggtcggattataatgtcaaagcttttgccttttggaattttgtttttgagctcttctctctcattgtccaatttctaggttatagctactgcaaggatgagaggagaataccctgaaaggattggtcagcctgaatgcgaggtaagaatctttggtttgtccagttgtagatgaacattttgtcaaggtttggtaattgagtcatcttcttacacaaactaacttaacattttgtggtgttgtatgttttggttgcgcagtactatttgaagacaggaacctgcaagtttggagtaacatgtaagtttcatcatccaaggaacaaagctgggattgctggaagagtctctctcaatatgttaggctatcctctacgctcggtatatttgactttttgacttgctgatttcattacttctcattgtttcatcatcttagtgattctctgtaatgtcatatatgcagaatgaggttgattgtgcttatttcctaagaaccggacactgtaaatttggtggtacttgtaaattcaaccaccctcagcctcaaccaaccaacatgatggttcctacctcagggcaacagtcttatccttggtcaagagcttcttttattgccagccctcgttggcaagatccgtctagctacgcttccttaatcatgcctcgaggagttgtcccggttcaaggatggaacccttacagtgtaagttttctaaacaacattgcttatactcttcagactttatatgacttggttttgatttctgtcgagtgtttctcggggtttccatttcgttagggtcagctcggctcagtttctccttcaggtaccggaaatgatcaaaactacagaaatttacagcagaacgagacaatagagtcaggctctcagtctcaaggatcattctcgggttacaatccgggatcctctgttccgctaggagggtattatgcattgccgagggaaaatgtgttcccggagagaccaggacaacccgaatgccaattctacatgaagacaggtgactgcaaatttggcacagtttgcaaatttcaccatcctagagacagacaagctcctcctcctgattgtctcttaagctccattggcctctccttacgcccggtaagctcaaagacttgtgcataattacttggttctcttcgattaaatctctgcattgtttgattttttttctttctcaaaatgatagggagaaccgttgtgtgtgttctatacacgctatggaatctgcaaatttggtccaagctgtaaatttgatcacccaatgcgagtattcacatacgacaacacagcttcagagacagatgaggtagtggaaacatcaacagggaaatctagaagactctctgtgtctgaaacaagacaagcagcaacaacatcctctggtaaagacactaccattgataatacacagcagtga

SEQ ID NO: 1457 - protein, 397 aa, Arabidopsis thaliana
  misc_feature: Ceres SEEDLINE ID no.ME19304
  misc_feature: Bit score of 856.4 for HMM based on sequences of FIGURE 17.
  misc_feature (275)..(301): Pfam Name: zf-CCCH Pfam Description: Zinc finger C-x8-C-x5-C-x3-H type
MDFNAGVPMSSLSPLMNQDAMWQMNLSSDETMETGSYPERPGEPDCSYYIRTGLCRFGSTCRFNHPRDRELVIATARMRGEYPERIGQPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPRGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLSLRPGEPLCVFYTRYGICKFGPSCKFDHPMRVFTYDNTASETDEVVETSTGKSRRLSVSETRQAATTSSGKDTTIDNTQQ

SEQ ID NO: 1458 - protein, 397 aa, Arabidopsis thaliana
  misc_feature: Ceres SEEDLINE ID no.ME19304
  misc_feature: Ceres LOCUS ID no.At3g02830
  misc_feature: Expected Sequence
  misc_feature: Bit score of 856.4 for HMM based on sequences of FIGURE 17.
  misc_feature (275)..(301): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MDFNAGVPMSSLSPLMNQDAMWQMNLSSDETMETGSYPERPGEPDCSYYIRTGLCRFGSTCRFNHPRDRELVIATARMRGEYPERIGQPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPQGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLPLRPGEPLCVFYTRYGICKFGPSCKFDHPMRVFTYDNTASETDEVVETSTGKSRRLSVSETRQAATTSSGKDTTIDNTQQ

SEQ ID NO: 1459 - DNA, 1803 bp, Gossypium hirsutum
  misc_feature: Ceres CLONE ID no.1924904
  misc_feature: Encodes the peptide sequence at SEQ ID NO. 1460
aagaagagctctcttttttagtatttctataattttgtttctgttggcaaaggaggaaggagagggaagaggttttttttttttctttttttttgtggttaggtgacagcgcggttttggaacgtggaatgagaattggtgcgtggaggtggttctaacgtgacaacgttgagtgatggtgatggaggaagatgactgttgaatgggattctcattcgatgctggaattcctatgtcacgaacagcaacggcggccgtgcctgtcactgaaggatcctcgctttcaccttcgttgaatcaagatgccatgtggcaaatgaacttgagatccagtgaaacgatggaatctagtccctatcctgagcgtcctggagaacctgattgttcttattatatcaggacaggcctttgtagatttggggcgacatgtcattttaatcatcctcctaaccggaaactggctatcgctgctgcaagaatgaaaggagagtttccaggaagagtaggacaacctgaatgtcagtactacctgaaaacaggaacttgcaaatttggagctacatgcaagtttcatcatcctagagacaaagctgggatagctggcagagtttccttaaatattttgggctatcctcttcgcccaaatgagactgagtgtgcttattatctaagaactggacaatgcaagttcgggagcacttgtaaatttcaccatcctcaaccaactaatatgatggtttcattgcgtggctctcctatttatcaaactgtcccttctccggccactcctggtcagcagtcacatccaggaggaattacaaattggtcaagagcatctttcattcccagccctcgttggcaaggtccttcaagttatgcatccttgattttaccacaagggatggtatcagttccaggctggaatgcttatagtggtcaactggcatcagtctcttcttcagagaacctgcagcagacaaatgtaaatcaccagattcatggaacctctcgccagaatgaatcagcaactgcaggatcccaagcatccttttctgagttacgctccggttccgtccctgtaggtgtttatgcattgcagagagagaatgtattcccggagagacctggcgagcctgagtgccaattttacatgaagactggtgattgtaaatttggtgcagtttgtaagttccatcacccaagagagagagttcttcctgcccctgattgtgtgttgagtcctataggccttcctttacgcccgggtgaacctctatgcatattctattctcgatatggaatttgcaaatttggtccaagttgcaagtttaaccatcctatgggaattttcacatacagttactcaccatcatctccatctgatgccccagttcactgtttcttgggttcgtcgtcaggaactgctgggttaaacctgtcatcagagggacttgttgaagcagtccctacaaagcccaggcgactatcactgtccgaaaatagacagttgtctcccagtgatgatattgacgctgagggataagagcggcaacaagatatgggctgactacatttgacaatggtttttgtgtatgagaaagagtaatctgtaaattcatttccattgttggagatgtacagagttcatgtcaagctgattctgttctttaaaagatgtgcaattcagtcaacagttgcatcttctgaatttcatattcctgcattgtataaatctgaaaattgtcacatttggtaaaacccaatgtgaacagttcatctgtcccaaagctcatttttctttcc

SEQ ID NO: 1460 - protein, 446 aa, Gossypium hirsutum
  misc_feature: Ceres CLONE ID no.1924904
  misc_feature: Bit score of 1030.3 for HMM based on sequences of FIGURE 17.
  misc_feature (354)..(380): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MGFSFDAGIPMSRTATAAVPVTEGSSLSPSLNQDAMWQMNLRSSETMESSPYPERPGEPDCSYYIRTGLCRFGATCHFNHPPNRKLAIAAARMKGEFPGRVGQPECQYYLKTGTCKFGATCKFHHPRDKAGIAGRVSLNILGYPLRPNETECAYYLRTGQCKFGSTCKFHHPQPTNMMVSLRGSPIYQTVPSPATPGQQSHPGGITNWSRASFIPSPRWQGPSSYASLILPQGMVSVPGWNAYSGQLASVSSSENLQQTNVNHQIHGTSRQNESATAGSQASFSELRSGSVPVGVYALQRENVFPERPGEPECQFYMKTGDCKFGAVCKFHHPRERVLPAPDCVLSPIGLPLRPGEPLCIFYSRYGICKFGPSCKFNHPMGIFTYSYSPSSPSDAPVHCFLGSSSGTAGLNLSSEGLVEAVPTKPRRLSLSENRQLSPSDDIDAEG

SEQ ID NO: 1461 - DNA, 1338 bp, Populus balsamifera subsp. trichocarpa
  misc_feature: Ceres ANNOT ID no.1543346
  misc_feature: Encodes the peptide sequence at SEQ ID NO. 1462
atggattttgatgccggaattccgatgtctcgtagtggtgttggtctaccagctgtaaccgagggaacttctatgtcaccgtctttaagcgaagatgcaatgtggcaaatgaacctgagatcgagtgaaacaatggaagctgggccatatcctgagcgtcctggagagccagattgttcatattatataagaacaggcctctgtagatttggggctacatgccgatttaatcacccccctaatcggaagctggcaattgcagcagccaggatgaagggggaatttccagaaagaataggacaaccagaatgccagtactacttgaagacaggaacttgcaagtttggggccacgtgcaagtttcatcaccctagagacaaggctgggatttctggaagagtgtctttaaatattttgggctatccactccaaccgaatgagatcgagtgtgcttattacttaagaacaggacagtgcaagtttggtagcacttgtaaatttcaccatcctcagccaactaatatgatggttccactgcgtggctctcctatttaccctactgtcagctctccaactacccctggtcaacaatcctatccaggaggacttgcaacaacctggtcaagggcatcttttattactagcccacgctggcaagctccttcaagttatacacctttgattctacctcagggagtcgtgtcagtccctggctggaatgcatacagtggtcagcttgggtcggtatcatctccagagagtcagcaacaaacaggaaacagtcagatatatggaacctcacgccacagtgaatcagttaatgcaggatctcaagggacattttccccataccgttctggctctgcccccttgggattttatgccttgcaaagagagagtgtttttcctgagagacctggtcagcctgaatgccagttttacatgaagactggagactgtaagttcggtgcagtttgtagattccatcatccaagggagagactaattcctgctccagactgtgtcttgagtccaattgggctgcctttacgtccaggagaacctctatgcatcttctactctcgttacggtatctgcaagtttggtccaagttgcaagtttgaccaccccatgggggttttcacatacaatctcacagcatcatcttcagctgatgccccagttcgacggctattggggtcctcatcaggatcccccggattaactttgtcatcagaagggcttgttgaagcaggcccgacaaagccaaggcgactttcactatcagagcctagacaaatgcccccgggtgatgataatattgacacgggcgggtga

SEQ ID NO: 1462 - protein, 445 aa, Populus balsamifera subsp. trichocarpa
  misc_feature: Ceres ANNOT ID no.1543346
  misc_feature: Bit score of 1034.6 for HMM based on sequences of FIGURE 17.
  misc_feature (352)..(378): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MDFDAGIPMSRSGVGLPAVTEGTSMSPSLSEDAMWQMNLRSSETMEAGPYPERPGEPDCSYYIRTGLCRFGATCRFNHPPNRKLAIAAARMKGEFPERIGQPECQYYLKTGTCKFGATCKFHHPRDKAGISGRVSLNILGYPLQPNEIECAYYLRTGQCKFGSTCKFHHPQPTNMMVPLRGSPIYPTVSSPTTPGQQSYPGGLATTWSRASFITSPRWQAPSSYTPLILPQGVVSVPGWNAYSGQLGSVSSPESQQQTGNSQIYGTSRHSESVNAGSQGTFSPYRSGSAPLGFYALQRESVFPERPGQPECQFYMKTGDCKFGAVCRFHHPRERLIPAPDCVLSPIGLPLRPGEPLCIFYSRYGICKFGPSCKFDHPMGVFTYNLTASSSADAPVRRLLGSSSGSPGLTLSSEGLVEAGPTKPRRLSLSEPRQMPPGDDNIDTGG

SEQ ID NO: 1463 - DNA, 1338 bp, Populus balsamifera subsp. trichocarpa
  misc_feature: Ceres ANNOT ID no.1532932
  misc_feature: Encodes the peptide sequence at SEQ ID NO. 1464
atggattttgatgccggaatcccgatgtctcgtggtggtggtggtctaccagctgtgaccgaggaaacttctctgtcaccgtctttaagcgaagatgcaatgtggcaaatgaacctgagatcgagtgagacaatggaagctgggccgtatcccgagcgtcctggagagccggattgttcttattacataagaacaggcctctgtagatttgggcctacctgccgatttaatcatcctcctaatcggaagctggctattgcagcggccaggatgaagggggaattcccagaaagaataggacaaccagaatgccagtactacttgaagactggaacttgcaagtttggagccacgtgcaagtttcatcaccctagagacaaggctggggtttctggaagagtgtctttaaatattttgggctatccacttcgactgaatgagatggagtgtgcttattacttaagaacaggacagtgcaagtttggtagcacttgtaaatttcatcatcctcaaccaactaatgtgatggttcctttgcgtggctctcctgtttaccctactgtcaattctccaactacccctggtcagcaatcttatccaggaggacttgcaacaaactggtcaagagcatcttttattaccagcccacgctggcaagctccttcaaattatacacctttgattctacctcagggagtcgtatcagtccctggctggaatgcatacagtggtcaggttgggtcggtatcatctccagagagtcagcaacaaacaggaaacagtcagatatatggaacctcacgccagaatgaatcagtcaatgcaggatctcaagggacattttctccataccgttctgattctgtccccatgggattttatgccttgcaaagagagagtgtttttcctgagagacctggtcagcctgaatgccagttttacatgaagaccggagactgtaagtttggtgcagtttgtagattccaccatccaagggagaggctaattcctgctccagactgtgtcttgagtgcaatagggctgcctttacgtccgggagaacctttatgcatcttctactctcgttatggcatctgcaagtttggtccaagttgcaagtttcaccaccctatgggaattttcacatacaatctcacagcatcatcttcagctgatgcccctgttcgacggttattggggtcctcatcaggatctgccgcgttaactttatcatcggaagggcttgttgaagccggatcaacaaagccaaggcgactttcactatcagagcctagacaaatgccacctggtgatgataatattgacacggggggatga

SEQ ID NO: 1464 - protein, 445 aa, Populus balsamifera subsp. trichocarpa
  misc_feature: Ceres ANNOT ID no.1532932
  misc_feature: Bit score of 1015.2 for HMM based on sequences of FIGURE 17.
  misc_feature (352)..(378): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MDFDAGIPMSRGGGGLPAVTEETSLSPSLSEDAMWQMNLRSSETMEAGPYPERPGEPDCSYYIRTGLCRFGPTCRFNHPPNRKLAIAAARMKGEFPERIGQPECQYYLKTGTCKFGATCKFHHPRDKAGVSGRVSLNILGYPLRLNEMECAYYLRTGQCKFGSTCKFHHPQPTNVMVPLRGSPVYPTVNSPTTPGQQSYPGGLATNWSRASFITSPRWQAPSNYTPLILPQGVVSVPGWNAYSGQVGSVSSPESQQQTGNSQIYGTSRQNESVNAGSQGTFSPYRSDSVPMGFYALQRESVFPERPGQPECQFYMKTGDCKFGAVCRFHHPRERLIPAPDCVLSAIGLPLRPGEPLCIFYSRYGICKFGPSCKFHHPMGIFTYNLTASSSADAPVRRLLGSSSGSAALTLSSEGLVEAGSTKPRRLSLSEPRQMPPGDDNIDTGG

SEQ ID NO: 1465 - DNA, 1176 bp, Populus balsamifera subsp. trichocarpa
  misc_feature: Ceres ANNOT ID no.1489955
  misc_feature: Encodes the peptide sequence at SEQ ID NO. 1466
atggattttgatgccggaattccgatgtctcgtagtggtgttggtctaccagctgtaaccgagggaacttctatgtcaccgtctttaagcgaagatgcaatgtggcaaatgaacctgagatcgagtgaaacaatggaagctgggccatatcctgagcgtcctggagagccagattgttcatattatataagaacaggcctctgtagatttggggctacatgccgatttaatcacccccctaatcggaagctggcaattgcagcagccaggatgaagggggaatttccagaaagaataggacaaccagaatgccagtactacttgaagacaggaacttgcaagtttggggccacgtgcaagtttcatcaccctagagacaaggctgggatttctggaagagtgtctttaaatattttgggctatccactccaaccgaggtccttgaaccttgtctttagccagtcaaatttggaaagtttgatactctctatgatcaatgtacttgggccggagcatataattgatgagaagtgcaaaattttgaccaaattatctagatacaattttaacataaattattgcagtccattcaatagggctgacaatgtgaaaacaaaagtgagagattggagtagtgaatgcccgtcgggtcaaacacctagaaacttgtctgatctaacagggggttacttaagtgggccaacaggtgaaatatatgatcgttactgcctgttaagtaccggtgacatcaataatttttatattgatatttccaaagagcatgagtacaagaatctttgtcgtaatgagatcgagtgtgcttattacttaagaacaggacagtgcaagtttggtagcacttgtaaatttcaccatcctcagccaactaatatgatggttccactgcgtggctctcctatttaccctactgtcagctctccaactacccctggtcaacaatcctatccaggaggacttgcaacaacctggtcaagggcatcttttattactagcccacgctggcaagctccttcaagttatacacctttgattctacctcagggagtcgtgtcagtccctggctggaatgcatacagtgctattgggcgtagaccacacaatgaggcacctcccttaatctctcaaatcccgggcatggactggtttttatcctag

SEQ ID NO: 1466 - protein, 391 aa, Populus balsamifera subsp. trichocarpa
  misc_feature: Ceres ANNOT ID no.1489955
  misc_feature: Bit score of 273.2 for HMM based on sequences of FIGURE 17.
  misc_feature (99)..(125): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MDFDAGIPMSRSGVGLPAVTEGTSMSPSLSEDAMWQMNLRSSETMEAGPYPERPGEPDCSYYIRTGLCRFGATCRFNHPPNRKLAIAAARMKGEFPERIGQPECQYYLKTGTCKFGATCKFHHPRDKAGISGRVSLNILGYPLQPRSLNLVFSQSNLESLILSMINVLGPEHIIDEKCKILTKLSRYNFNINYCSPFNRADNVKTKVRDWSSECPSGQTPRNLSDLTGGYLSGPTGEIYDRYCLLSTGDINNFYIDISKEHEYKNLCRNEIECAYYLRTGQCKFGSTCKFHHPQPTNMMVPLRGSPIYPTVSSPTTPGQQSYPGGLATTWSRASFITSPRWQAPSSYTPLILPQGVVSVPGWNAYSAIGRRPHNEAPPLISQIPGMDWFLS

SEQ ID NO: 1467 - protein, 397 aa, Arabidopsis thaliana; identical to SEQ ID NO: 1458
  misc_feature: Public GI ID no.18396338
  misc_feature: Bit score of 856.4 for HMM based on sequences of FIGURE 17.
  misc_feature (275)..(301): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457

SEQ ID NO: 1468 - protein, 424 aa, Arabidopsis thaliana
  misc_feature: Public GI ID no.4928917
  misc_feature: Bit score of 844.7 for HMM based on sequences of FIGURE 17.
  misc_feature (275)..(301): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MDFNAGVPMSSLSPLMNQDAMWQMNLSSDETMETGSYPERPGEPDCSYYIRTGLCRFGSTCRVNHPRDRELVIATARMRGEYPERIGHPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPQGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLPLRPGEPLCVFYTRYGICKFGPSCKFDHPMRVFTYDNTASETDEVVETSTGKSRRLSVSETRQAATTSSGKDTTIDIHSSEGNKGRRRRAFKQEKNKSFLIFQKRNL

SEQ ID NO: 1469 - protein, 377 aa, Arabidopsis thaliana
  misc_feature: Public GI ID no.6728979
  misc_feature: Bit score of 795.4 for HMM based on sequences of FIGURE 17.
  misc_feature (255)..(281): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MWQMNLSSDETMETGSYPERPGEPDCSYYIRTGLCRFGSTCRFNHPRDRELVIATARMRGEYPERIGQPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPQGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLPLRPGEPLCVFYTRYGICKFGPSCKFDHPMRVFTYDNTASETDEVVETSTGKSRRLSVSETRQAATTSSGKDTTIDNTQQ

SEQ ID NO: 1470 - DNA, 1694 bp, Triticum aestivum
  misc_feature: Ceres CLONE ID no.833872
  misc_feature: Encodes the peptide sequence at SEQ ID NO. 1471
cccctctctccctctgtatcctgcacacaccgccaccgatcactcgccggagcccctcccccaatggccgccgccgccgccgcgatcgcgtgatggccgacccagccgctcgccgaagatggacgaagccggaagggcctccgctcccgcggtggtgacggtcacggcctccgccgccgccccctcgcctcctcctcccccgccccccgccacggccaccgccgcggccgccgacccgccatcgcccgacccggacgctctctatgaagagggaatgtggcagcagatggccatgagcagcggcgccactatgcaatctgggccatatcctgtgcggccaggggaaccggactgcacctactacctcaggactggattgtgcaggttcggcatgagctgcaggttcaatcaccctcaggacaggaatacggctattgcctctgccagaatgaaaggagaatatcctgagagggtgggacaacctgaatgtcagtactatctgaagactggaacatgcaagtttgggcctacgtgcaaattccatcaccctagagaaaaggctggaatcgcaggaatggtgcagctaaacacattgggatatccacttcgaccgaatgaaagggagtgtgcatactacttaaaaacgggacagtgtaaatatgggaatacatgtaaatttaaccatccagaaattttcaatgcggtggcttcttcacgtggttcccctatttatcctcctgtacataactctggaagcaccggtccacattcctatactggaacaatggcaagctggacttatccaagaggttctttcattccaagccctagatggcaaagtccttcaaactatacaccgatgattgtaccacagggtcttgttcaagtaccaaactggaactcatatcctggccaaatggtacctgtttcatctcctgagagtcgactacagtctccaggggctcaacaatactatggaacttctcgacaaggtgaagccagtgcaggaaatcagggaatgcaatcaccctacagatccagttcgtttcctgcacctcagtatgcactgcagagagagaatgtatttcctgagagacctgatcagccagaatgcatatactacataaagactggagattgtaaatttggtgcggtttgcaaattccatcatccccgggtgcgctcacagcctcccccagactgtatcttgagcccaatgggtcttccattacgcccaggcgaagagctctgcaagttctactctcgctatggcatctgcaagttcggcgtaaactgcaagttcgaccatccaatggcggctccgatgggggtctacgcgtacggctactctgcctcggcgtcgcccaacgcgcccatgggtcggcgtctcctggagtccccctccgggtctgcgtacgcctcctaaggcaaggctccctggcatttgaccctaccttgattgatctcgatgatgtataaaagccatcgcgagctgtcgtccctccctcgggcgcgccccgcgaatgttctcccccctaactccccggaatcaagttctgtaaaaatcgagtttgctaccagagatgtacagttgttatttttgttaatgcgggtcagtgtttggatggatggagaagccatttgctaccgaatgaaataatgcttgaatgcagtgttgaaaaaaaaaaaaaaaa

SEQ ID NO: 1471 - protein, 435 aa, Triticum aestivum
  misc_feature: Ceres CLONE ID no.833872
  misc_feature: Bit score of 908.8 for HMM based on sequences of FIGURE 17.
  misc_feature (373)..(399): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MDEAGRASAPAVVTVTASAAAPSPPPPPPPATATAAAADPPSPDPDALYEEGMWQQMAMSSGATMQSGPYPVRPGEPDCTYYLRTGLCRFGMSCRFNHPQDRNTAIASARMKGEYPERVGQPECQYYLKTGTCKFGPTCKFHHPREKAGIAGMVQLNTLGYPLRPNERECAYYLKTGQCKYGNTCKFNHPEIFNAVASSRGSPIYPPVHNSGSTGPHSYTGTMASWTYPRGSFIPSPRWQSPSNYTPMIVPQGLVQVPNWNSYPGQMVPVSSPESRLQSPGAQQYYGTSRQGEASAGNQGMQSPYRSSSFPAPQYALQRENVFPERPDQPECIYYIKTGDCKFGAVCKFHHPRVRSQPPPDCILSPMGLPLRPGEELCKFYSRYGICKFGVNCKFDHPMAAPMGVYAYGYSASASPNAPMGRRLLESPSGSAYAS

SEQ ID NO: 1472 - DNA, 1630 bp, Zea mays subsp. mays
  misc_feature: Ceres CLONE ID no.285780
  misc_feature: Encodes the peptide sequence at SEQ ID NO. 1473
cttcgtccattccgatcactcgctgctcccctctctcgccggagcgagccccgggccggatggcggcggcagcagcagctcctcccgcctccgcgatcgcgtgatggacgccgacgccgacgccgccgcgatccgccgatggacgacgccggaagggcaccaccacccgcgccagcggcggtgaccgtctccgccaccgccgcacccgcgcctaccccgccctccgccacggccgccgccgacaagtcctccctcgaccccgacgcgctttatgaagaggggatgtggcaacagatggccatgaacagcggtgccacaatgcaacctgggtcatatcctgagcgaccaggtgaaccggactgcacttactacctcaggactggattgtgtcgatttggcatgagctgcaggttcaatcatcctccggataggaatctggctattgcctctgccagaatgaagggagaatatcctgagagagtgggacagccagagtgtcagtattatctgaagaccggaacatgcaagtttggtcctacatgcaaatttcaccatcccagggaaaaggccggaattgcagggagggtgcagctaaacacattaggatatccacttctcccgaatgaaaaggagtgtgcgtattatttaaaaacaggacaatgtaaatatgcaaatacttgtaaattccaccacccagaacttttcaatgtggtgccttcgtcacgtggttcacctatttatacttctgtacattcctctgcaagcgctggtccacagtcatatactggaactatgtcaagctggacttttccacgagcttcttttataccaagccctaggtggcaaagtccttcaaattatgcaccaatggttgtacctcatggccttgtccaagtgccgagctggaattcatatcctggtcagctgcagtcacctggggctcaacaaacttatggaagttcacaacaaggcgaagctagtgcaggaaatcagggaatgctatcaccctatagatccagttcatttcctgtgcctcaatatgcgttgcagagagataatgtatttcctgagagacccgatgaaccagaatgccaatattacatgaagacaggagattgtaaatttggtgcagtgtgcaagttccatcatccccgtgtgagatcacagccccctccggattgtgtcttaagtccaatgggtcttccaatacgtccaggtgaagaactttgcaaattctattctcgttatggcatctgcaagttcggcgccaactgtaaatttgatcatcctacaatggctgctccaatgggagtttatgcatatggtttctctgggtctgcttctgtcgcacccgcttcaactaakgcacctatgacgcgacatcttcttggatctccatcaggttctggatatatgtcttaggtgtcttttttttcagttgacctactttgatgtataaaatccacggcatcgcctcaggcgctgtgaatgtttctcctaacttcccgccgggatgaagttctgtaaattgagttgctgctggagatgtacagcccccccccccccccccccctcccmaattaatccagaactttgggaataactgttggaacctaataaacttcagatt

SEQ ID NO: 1473 - protein, 427 aa, Zea mays subsp. mays
  misc_feature: Ceres CLONE ID no.285780
  misc_feature: Bit score of 802.1 for HMM based on sequences of FIGURE 17.
  misc_feature (359)..(385): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
  misc_feature (409)..(409): Xaa is any aa, unknown, or other
MDDAGRAPPPAPAAVTVSATAAPAPTPPSATAAADKSSLDPDALYEEGMWQQMAMNSGATMQPGSYPERPGEPDCTYYLRTGLCRFGMSCRFNHPPDRNLAIASARMKGEYPERVGQPECQYYLKTGTCKFGPTCKFHHPREKAGIAGRVQLNTLGYPLLPNEKECAYYLKTGQCKYANTCKFHHPELFNVVPSSRGSPIYTSVHSSASAGPQSYTGTMSSWTFPRASFIPSPRWQSPSNYAPMVVPHGLVQVPSWNSYPGQLQSPGAQQTYGSSQQGEASAGNQGMLSPYRSSSFPVPQYALQRDNVFPERPDEPECQYYMKTGDCKFGAVCKFHHPRVRSQPPPDCVLSPMGLPIRPGEELCKFYSRYGICKFGANCKFDHPTMAAPMGVYAYGFSGSASVAPASTXAPMTRHLLGSPSGSGYMS

SEQ ID NO: 1474 - DNA, 2020 bp, Zea mays subsp. mays
  misc_feature: Ceres CLONE ID no.1579587
  misc_feature: Encodes the peptide sequence at SEQ ID NO. 1475
aggttcctctcattccccttccacctctctctttctttccactactcgccctctctctcttgcgcgcgcgtgacaacatccctccacgggcgcgcggcgcgggagcacccaccgacttatcgccggtggggcggggcgggggcgatctgatgccggcgcggcggtgatggcagcgccgtccggcggtgggggcggcggtgcgggggagggctcctcctcggccgccgcagctatgacgatcggggcccacggggtggaccaagtcacagaagcgatgtggcagatgaatttaggagatgccatggaactggggccatacccagagcgtgttggtgatccagactgtagctattacatgaggactggcatgtgcaggtttgggatgacctgtaaatttaatcacccagcagacagaaagctggctgttgctgctgcaagaatgaagggagaatatcctcaaagaattggacagcctgaatgtcaatactatctgaagactggcacatgcaagtttggagcaacttgcaagtttcatcatccccgagaaaaggctgcaatggcaactcgagttcagctgaatgaactgggctacccactccgcctgaatgaaaaggaatgtgcttattatttaagaacagggcagtgcaagtttggaagcacatgtaagtttcaccatccacaaccatccactatgatggttgccgtacgtggctctgtttattcacctggacagtctgcaacttctcctggccatcatgcttaccagggggctgtaacaagctggcccttgtcgagatctgcttctttcattgcaagtccaaggtggccaggtcattcaagttatgcacaagttattgttcctcctgggcttgttcaggtcccagggtggagtccttatgctgcgcagattggttcttcatcctcggatgaccaacaacggacacctggagctgcccaatactatactggctcacgccagagtggaacacctggcataggcgatcgaggaatgttttcatcctaccaagcaggttctgttcccgttggactttatgcagtacagacggagaatgtatttccagagagacctgaccaacctgaatgtcagttctatatgaagaccggagactgtaagtttggttctgtatgcaagttccatcatcccagggagcgaataattcctactcccaattgtgcactaagtccattaggcctacctttgcgcccgggagaaccaatatgcagtttctataatcgctatggcatgtgcaagtttggtccaaattgcaaatttcatcatccgatgggaaaccctatgtatggccatgcttcatcaccgacaagtgaggcccaaacatctcggcgtatgctggcacatgtaccatcgcatccagaagtatcacctgacagtggctcgggaaggtctaggaggattgttcattcagattcccagcaaataccctctgttgaaaggatcaccgagagagaggcgtcctaagccatcctcggtgtcttcgttcatgctgcctcccctcccctcccctcccattcttgacgagtaattaaatgcaacaacatctgagaatccgaagctgtacaggtcttttgcctcatctttgagctttacataccggagcttgcttcaacatgtattgcatccaggcatgaaaaagttcttgccggttcgggatgctcatttgcccccataaaaacgggaacaaacctaccttatttaaacatatgtatgaaactcactcacctctggacattcaaacccattcgagtaatggtcccggtgttgtagtttatagagctgtgtttcagtggacaaacctttgcgaaactgactggggatgcgcaagcatagcctcctttattaattattatctcgtttttttcctagcatctctcttttcataagggcaacccaaagtgttggaataatagattgccaccataatgctctgtattacccaccatatttaaacctggttacttgtgagcaaaaaaaaaaaaaaaa

SEQ ID NO: 1475 - protein, 443 aa, Zea mays subsp. mays
  misc_feature: Ceres CLONE ID no.1579587
  misc_feature: Bit score of 998.3 for HMM based on sequences of FIGURE 17.
  misc_feature (308)..(334): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MAAPSGGGGGGAGEGSSSAAAAMTIGAHGVDQVTEAMWQMNLGDAMELGPYPERVGDPDCSYYMRTGMCRFGMTCKFNHPADRKLAVAAARMKGEYPQRIGQPECQYYLKTGTCKFGATCKFHHPREKAAMATRVQLNELGYPLRLNEKECAYYLRTGQCKFGSTCKFHHPQPSTMMVAVRGSVYSPGQSATSPGHHAYQGAVTSWPLSRSASFIASPRWPGHSSYAQVIVPPGLVQVPGWSPYAAQIGSSSSDDQQRTPGAAQYYTGSRQSGTPGIGDRGMFSSYQAGSVPVGLYAVQTENVFPERPDQPECQFYMKTGDCKFGSVCKFHHPRERIIPTPNCALSPLGLPLRPGEPICSFYNRYGMCKFGPNCKFHHPMGNPMYGHASSPTSEAQTSRRMLAHVPSHPEVSPDSGSGRSRRIVHSDSQQIPSVERITEREAS

SEQ ID NO: 1476 - DNA, 1878 bp, Panicum virgatum
  misc_feature: Ceres CLONE ID no.1786411
  misc_feature: Encodes the peptide sequence at SEQ ID NO. 1477
attccccttccacctcgctctctctctctctcctcgcactgccctctctctctctcttacgcgcgcgtgacacctccacgggcgcgccgcgcgcgagagcagccgccaccgactgatcgccggctggcgcgggggctggggcgatctgatgctggcgcggcggtgatggctgcgccgtccgccggcgcagggggcgggagcggcggcgcgggggagggctcctcctcctcggccgccgcggctgccgcagccgcgacgatcggggcccacggtgtcgaccaagttgcagaagcgatgtggcagatgaacttaggagaagctgttgaactggggccttacccagagcgtgttggtgagccagattgtagttattacatgaggactggcatgtgtaggtttgggatgacctgtaaatttaaccatccagcagataggaagctggctgttgctgctgcaagaatgaagggagaatatcctcaaagaaatggccagcctgaatgtcaatactatctgaagaccggcacatgcaaatttggagcaacttgcaagtttcaccacccccgagaaaaggctgcaatggcaactcgagtgcagttgaatgaattgggctacccattccgcccgagtgaaaaggaatgtgcctattatttaagaacagggcagtgcaagtttggaagcacatgtaaatttcaccatccacaaccatctaccatgatggttgctgtacgtggctctggttattcacctggacagtctgcaacttctcctggccagcatgcgtaccaaggggctgtaacaagctggcccttgtcaagatctacttctttcattgcaagtccaaggtggccaggtcattcaagctatgcgcaagtgcttgttcctccaggccttgttcaggtcccagggtggaatccttacactgcacagattggttcatcatcctcagaggaccaacaacagacacctggagctgcccaatactatactggttcacgccagagtggaacaccttgcatcggagatcaaggaatgttttcatcataccaagctggttcagttcctgttggactttatgcagtacagagggaaaatgtgtttccagagagacctgaccaacctgaatgtcagttctatatgaaaactggagactgtaaatttggtgttgtatgcaagttccatcatcccagggagcgaataattcctgctcccaattgtgcactgagttcattgggccttcccctgcgtccgggagaacccatttgcagtttctattctcgctatggcatgtgcaagttcggtccaaattgcaaattcgatcatccaataggaacagtcatgtatggccatgtttcatcaccaactagtgaggtcccaacttctcgacgaatgctggcatatgtaccatctcatccagaagtattgcctgacaatggctcgggaaggtcacggaggattacccattcagattcccagcaaataccctcaggtgaaaggagcactgagagagaggcgtcctaagccatcctcggttccatgttcatgctgcctcccattcttgactggagtaattatctgcaacaacatttgaggagctgtacaggtcttttgcgcttttacctcaccttcgagctttacataccggagcttgcttcaacatgtattgcattcaggctggaaaaagttcctagcctgttcgggatgcccatttgcccaatggaaacaggaacaaaccttaccttatttaaaacatatgtatggaaccaactcacctttggacatacgaaccgactcgagtgatgtgtgccgtgatggtgttgttgtagctatagaggtgcattgaaatggacacgcttttgtgaaaaaaaaaaaaaaaaaaaa

SEQ ID NO: 1477 - protein, 450 aa, Panicum virgatum
  misc_feature: Ceres CLONE ID no.1786411
  misc_feature: Bit score of 1009.1 for HMM based on sequences of FIGURE 17.
  misc_feature (315)..(341): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MAAPSAGAGGGSGGAGEGSSSSAAAAAAAATIGAHGVDQVAEAMWQMNLGEAVELGPYPERVGEPDCSYYMRTGMCRFGMTCKFNHPADRKLAVAAARMKGEYPQRNGQPECQYYLKTGTCKFGATCKFHHPREKAAMATRVQLNELGYPFRPSEKECAYYLRTGQCKFGSTCKFHHPQPSTMMVAVRGSGYSPGQSATSPGQHAYQGAVTSWPLSRSTSFIASPRWPGHSSYAQVLVPPGLVQVPGWNPYTAQIGSSSSEDQQQTPGAAQYYTGSRQSGTPCIGDQGMFSSYQAGSVPVGLYAVQRENVFPERPDQPECQFYMKTGDCKFGVVCKFHHPRERIIPAPNCALSSLGLPLRPGEPICSFYSRYGMCKFGPNCKFDHPIGTVMYGHVSSPTSEVPTSRRMLAYVPSHPEVLPDNGSGRSRRITHSDSQQIPSGERSTEREAS

SEQ ID NO: 1478 - protein, 440 aa, Oryza sativa subsp. indica
  misc_feature: Public GI ID no.125528863
  misc_feature: Bit score of 840.8 for HMM based on sequences of FIGURE 17.
  misc_feature (380)..(406): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MDDAGRASAPAVVTVTASAAAPTPPPPPPPPPPPPSQLPATAAATDEPSHDPAALYGEGMWQQMTMSGSGAMQPGPYPERSGEPDCTYYLRTGLCRFGMSCRFNHPQDRNLAIASARMKGEYPERMGQPECQYYLKTGTCKFGPTCKFHHPREKAGIAGRVQLNTLGYPLRPSEKECAYYLKTGQCKYGNTCKFHHPELFNAMASSRGSPIYPSVHSSATAGPPSYTGTMASWAFPRGSFIPSPRWQNPSNYAPMIVPQGLVQVPSWNSYTGQMMPVSSSESRLQSPGAQQTYGTSQQVDASAGNQGMLSPYRSSSYPVPQYALQRENVFPERPDQPECQYYMKTGDCKFGAVCKFHHPRVRSMPTPDCVLSPVGLPLRPGEELCKFYSRYGICKFGANCKFDHPTMAPPMGVYAYGSASTNVPMVRRLLQSPSASAYTS

SEQ ID NO: 1479 - protein, 452 aa, Oryza sativa subsp. indica
  misc_feature: Public GI ID no.125536365
  misc_feature: Bit score of 687.5 for HMM based on sequences of FIGURE 17.
  misc_feature (317)..(343): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MAAGAGAGGGGGEGGSNGGGTSPGGVSAAAAAIGPHHLGVAAAEGGGGVICSVLLCLNLWGKRVSGVRGQRFSTERSHLRDDGLSIPVMPVIVNIFLNDIAEAMWQMTLGGGESMESTPYPERIGEPDCSYYMRTGLCRFGMTCKFNHPPNRKLAVAAARMNGEYPYRVGQPECQYYLKTGTCKFGATCKFHHPREKAALANRVQLNVLGYPMRPNEKECAYYLRTGQCKFASTCYAQVIVPQGLVQVPGWNPYAAQMGSSSPDDQQRTPVTTQYYGSRQSETGGMGDHGMYQSYQGGSVPVGVYTVQGENIFPERPDQPECQFYMKTGDCKFGAVCKFHHPKERLVPAPNCALNSLGLPLRPGEPVCTFYSRYGICKFGPNCKFDHPMGTLMYGSATSPTGDVSSMHYQLSPSPGHPGILLDGGSGRSHRVPQSDSQQIPSGDGNAEREAS

SEQ ID NO: 1480 - protein, 444 aa, Oryza sativa subsp. japonica
  misc_feature: Public GI ID no.108864370
  misc_feature: Bit score of 1037.3 for HMM based on sequences of FIGURE 17.
  misc_feature (310)..(336): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MAAAPSAGGVGEGSSSSAAAAAAAAAATIGPHVVDEEAMWQMNLGEAMEAGPYPERIGEPDCSYYMRTGLCRFGMTCKFNHPADRKMAVAAARMKGEYPQRIGQPECQYYLKTGTCKFGATCKFHHPREKAAIATRVQLNALGYPLRPNEKECAYYLRTGQCKFGSTCKFHHPQPSNTMVAVRGSVYSPGQSVTSPSQHTYPGAVTNWPLSRSASFIASPRWPGHSSYAQVIVPPGLVQVPGWNPYAAQIGSSSSDDQQRTAGGAQYYTGSRHSETPNMGDQGMFSSYQAGSVPLGLYTVQRESIFPERPDQPECQFYMKTGDCKFGAVCKFHHPKERIIPTPNCALSSLGLPLRPGEPICTFYSRYGICKFGPNCKFDHPMGTVMYGLATSPTGDVSARRMLAPVPAHSEVSPDNVSGRSRRITHSDSQQIPSGERGTEREAS

SEQ ID NO: 1481 - protein, 406 aa, Oryza sativa subsp. japonica
  misc_feature: Public GI ID no.108864369
  misc_feature: Bit score of 950.1 for HMM based on sequences of FIGURE 17.
  misc_feature (272)..(298): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MWQMNLGEAMEAGPYPERIGEPDCSYYMRTGLCRFGMTCKFNHPADRKMAVAAARMKGEYPQRIGQPECQYYLKTGTCKFGATCKFHHPREKAAIATRVQLNALGYPLRPNEKECAYYLRTGQCKFGSTCKFHHPQPSNTMVAVRGSVYSPGQSVTSPSQHTYPGAVTNWPLSRSASFIASPRWPGHSSYAQVIVPPGLVQVPGWNPYAAQIGSSSSDDQQRTAGGAQYYTGSRHSETPNMGDQGMFSSYQAGSVPLGLYTVQRESIFPERPDQPECQFYMKTGDCKFGAVCKFHHPKERIIPTPNCALSSLGLPLRPGEPICTFYSRYGICKFGPNCKFDHPMGTVMYGLATSPTGDVSARRMLAPVPAHSEVSPDNVSGRSRRITHSDSQQIPSGERGTEREAS

SEQ ID NO: 1482 - protein, 454 aa, Oryza sativa subsp. japonica
  misc_feature: Public GI ID no.115488274
  misc_feature: Bit score of 907.0 for HMM based on sequences of FIGURE 17.
  misc_feature (319)..(345): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MAAGAGAGGGGGEGDSNGGGTSPGGVSAAAPAIGPHHLGVAAAEEAMWQMTLGGGESMESTPYPERIGEPDCSYYMRTGLCRFGMTCKFNHPPNRKLAVAAARMNGEYPYRVGQPECQYYLKTGTCKFGATCKFHHPREKAALANRVQLNVLGYPMRPNEKECAYYLRTGQCKFASTCKFHHPQPSNTMVAVRNSMYSPGQSATSPGQHTYPGAVTNWTLSRSASFIASPRWPGHSGYAQVIVPQGLVQVPGWNPYAAQMGSSSPDDQQRTPVTTQYYGSRQSETGGMGDHGMYQSYQGGSVPVGVYTVQGENIFPERPDQPECQFYMKTGDCKFGAVCKFHHPKERLVPAPNCALNSLGLPLRPGEPVCTFYSRYGICKFGPNCKFDHPMGTLMYGSATSPRGDVSSMHYQLSPSPGHPGILLDGGSGRSHRVPQSDSQQIPSGDGNAEREAS

SEQ ID NO: 1483 - protein, 494 aa, Oryza sativa subsp. japonica
  misc_feature: Public GI ID no.125577099
  misc_feature: Bit score of 889.8 for HMM based on sequences of FIGURE 17.
  misc_feature (360)..(386): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MAAAPSAGGVGEGSSSSAAAAAAAAAATIGPHVVDEGALCFGHSHNADMFYNVDTLSVIDGMVVITTQNFELQYIKGLWRIWQATPLMGRISFGAAREGLSAAATAVAVAASVIGPHSSDEEAMWQMNLGEAMEAGPYPERIGEPDCSYYMRTGLCRFGMTCKFNHPADRKMAVAAARMKGEYPQRIGQPECQYYLKTGTCKFGATCKFHHPREKAAIATRVQLNALGYPLRPNEKECAYYLRTGQCKFGSTWAVTNWPLSRSASFIASPRWPGHSSYAQVIVPPGLVQVPGWNPYAAQIGSSSSDDQQRTAGGAQYYTGSRHSETPNMGDQGMFSSYQAGSVPLGLYTVQRESIFPERPDQPECQFYMKTGDCKFGAVCKFHHPKERIIPTPNCALSSLGLPLRPGEPICTFYSRYGICKFGPNCKFDHPMGTVMYGLATSPTGDVSARRMLAPVPAHSEVSPDNVSGRSRRITHSDSQQIPSGERGTEREAS

SEQ ID NO: 1484 - protein, 386 aa, Oryza sativa subsp. japonica
  misc_feature: Public GI ID no.125573110
  misc_feature: Bit score of 773.2 for HMM based on sequences of FIGURE 17.
  misc_feature (326)..(352): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MLVAEGMWQQMTMSGSGAMQPGPYPERSGEPDCTYYLRTGLCRFGMSCRFNHPQDRNLAIASARMKGEYPERMGQPECQYYLKTGTCKFGPTCKFHHPREKAGIAGRVQLNTLGYPLRPSEKECAYYLKTGQCKYGNTCKFHHPELFNAMASSRGSPIYPSVHSSATAGPPYTGTMASWAFPRGSFIPSPRWQNPSNYAPMIVPQGLVQVPSWNSYTGQMMPVSSSESRLQSPGAQQTYGTSQQVDASAGNQGMLSPYRSSSYPVPQYALQRENVFPERPDQPECQYYMKTGDCKFGAVCKFHHPRVRSMPTPDCVLSPVGLPLRPGEELCKFYSRYGICKFGANCKFDHPTMAPPMGVYAYGSASTNVPMVRRLLQSPSASAYTS

SEQ ID NO: 1485 - protein, 428 aa, Medicago truncatula
  misc_feature: Public GI ID no.124359159
  misc_feature: Bit score of 858.1 for HMM based on sequences of FIGURE 17.
  misc_feature (335)..(361): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MEYDAIPQEAMWQMSLRPSETMESGPYPEHPGEPDCSYYIRTGLCRFGATCRFNHPPNRKLAIATARMKGEFPERLGQPECQASVNECCIMHYYLKTGTCKFGATCRFHHPKDKAGVAGRVALNILGYPLRPNESECAYYLRTGQCKFGNTCKFHHPQPSNMVLPMRGSPVYPTVQSPTTAGQQSYAAGITNWSTSSYIPSPRWQGPSSYAPLILPQGVVSVPGWSTYNGQMGSDSPQQTMRNDQTYGTSHQGDPENAGLQGVYSQYRSGSVPVGFYALQRENIFPERPDQPECQFYMKTGDCKFGAVCRFHHPRERTIPAPDCVLSPLGLPLRPGEPLCVFYSRYGICKFGPSCKFDHPMGIFTYNVSASPLAEAAGRRLLGSSSGTAALSLSSEGLVESGSVKPRRLSLSETRPNPSGDDDIDDEG

SEQ ID NO: 1486 - protein, 417 aa, Pisum sativum
  misc_feature: Public GI ID no.62901479
  misc_feature: Bit score of 873.2 for HMM based on sequences of FIGURE 17.
  misc_feature (325)..(351): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MEFDTIPQEAMWQMNLRSSETMESGPYPEHPGEPDCSYYIRTGLCRFGATCRFNHPPNRKLAIATARMKGEFPERLGQPECQYYLKTGTCKFGATCRFHHPKDKAGVAGRVALNILGYPLRPNESERAYYLRTGQCKFGNTCKFHHPQPSNMVLSMRGSTVYPTVQSPTTPGQQSYAAGITNWSSSSYVPSPRWQGPSSYAPLILPQGVVSVPGWSTYGGQMGSESPQQTMRNDQTYGTSHQGELENAGLQGAYSQYRSGSVPVGFYALQRDNIFPERPDQPECQFYMKTGDCKFGAVCRFHHPRERQIPAPDCVLSPIGLPLRPGEPLCVFYSRYGICKFGPSCKFDHPMGIFTYNVASPLADTPGRRLLGSSSGTAALSLSSEGLVESGTAKPRRLSLSETRPIPPGDDNIDDEG

SEQ ID NO: 1487 - DNA, 1419 bp, Sorghum bicolor
  misc_feature: Ceres ANNOT ID no.6016783
  misc_feature: Encodes the peptide sequence at SEQ ID NO. 1488
atggacgacgccggaagggcaccaccacccgctcccgcggcggtgaccgtatccgccaccgccgcacccgcgcctcccccgccctccgccacggccgctgccgacaagtcctcgcccgaccccgaagcgctctatgaagaggggatgtggcaacagatggccatgaacagcggtgccactatgcaacctgggtcatatcctgagcgaccaggtgaacctgactgcacttactacctcaggactggattgtgtcgatttggcatgagctgcaggttcaatcatcctccggataggaatctggctattgcctctgccagaatgaaaggagaatatcctgagagagtgggacagccagagtgtcagtattatctgaagactggaacatgcaagtttggccctacatgcaaatttcaccatcccagggaaaaggctggaattgcagggagggtgcagctaaacacattaggatatccactccgcccgaatgaaaaggagtgcgcatattatttaaaaacaggacaatgtaaatatgcaaatacttgtaaatttcaccatccggagcttttcaatgtggtgccttcgtcacgtggttctcctatttatacttccgtacattcctctgcaagcgctggtccacagtcctatactggaactatgccaagctgggcttttccacgagcttcttttataccaagccctaggtggcaaagtccttcaaattatgcaccaatgattgtacctcagggccttgttcaagtgccgagctggaattcatatcctggtcagctgcagtcacctggggctcaacaaacttatggaagttcacaacaaggtgagtctagtgcaggaaatcagggaatgctatcaccctacagatccagttcgtttcctgtgcctcaatatgcgttgcagagagataatgtatttcctgagagacctgatgaaccagaatgccaatattacatgaagacaggagattgtaaatttggtgcagtgtgcaagttccatcatccccgggtgagatcactgccccctccggattgtgtcttaagtccaatgggtcttccaatacgtccaggtgaagaattgtgcaaattctattctcgttatggcatctgcaagttcggcgccaactgtaaatttgaccatccaacaatggctgctccaatgggagtctatgcatatggtttctctgcgtctggttctcctgcatctgcttcaactaatgtacctatggcgcgacaaataccattttcacgcctgcacctatggttcctaacagttgatgaggtaggaaatcccctgaaggacctgaggcctgcaggtgtgcagttgaaattatatcattgcgtcagtttgtttggaacctgtattcagctcgtgttgaggcagatattgggatttctttttatctgttaa

SEQ ID NO: 1488 - protein, 472 aa, Sorghum bicolor
  misc_feature: Ceres ANNOT ID no.6016783
  misc_feature: Bit score of 817.4 for HMM based on sequences of FIGURE 17.
  misc_feature (359)..(385): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MDDAGRAPPPAPAAVTVSATAAPAPPPPSATAAADKSSPDPEALYEEGMWQQMAMNSGATMQPGSYPERPGEPDCTYYLRTGLCRFGMSCRFNHPPDRNLAIASARMKGEYPERVGQPECQYYLKTGTCKFGPTCKFHHPREKAGIAGRVQLNTLGYPLRPNEKECAYYLKTGQCKYANTCKFHHPELFNVVPSSRGSPIYTSVHSSASAGPQSYTGTMPSWAFPRASFIPSPRWQSPSNYAPMIVPQGLVQVPSWNSYPGQLQSPGAQQTYGSSQQGESSAGNQGMLSPYRSSSFPVPQYALQRDNVFPERPDEPECQYYMKTGDCKFGAVCKFHHPRVRSLPPPDCVLSPMGLPIRPGEELCKFYSRYGICKFGANCKFDHPTMAAPMGVYAYGFSASGSPASASTNVPMARQIPFSRLHLWFLTVDEVGNPLKDLRPAGVQLKLYHCVSLFGTCIQLVLRQILGFLFIC

SEQ ID NO: 1489 - DNA, 1173 bp, Sorghum bicolor
  misc_feature: Ceres ANNOT ID no.6020759
  misc_feature: Encodes the peptide sequence at SEQ ID NO. 1490
atggctggcccgccgaaagggttcgacagccgatctcgagcgccagagtcagggatccccagcgagcggtcgaagatcgaggcccgcctcgaggactcgctggcgatgttcaaggctgttgctgctgcaagaatgaagggagaatatcctcaaagaattgggcagcctgaatgtcaaactggcacatgcaagtttggagcaacttgcaagtttcaccatccccgagaaaaggctgcaatggcaactcgagttcagttgaatgaactgggctacccactccgcgcgaatgaaaaggagtgtgcttattatttaagaacagggcagtgcaagttcggaagcacatgtaagtttcaccatccacaaccatccaccatgatggttgctgtacgtggctctgtttattcacctggacagtctgcaacttctcctggccagcatgcttaccaaggggctgtaacaagctggcccttgtcgagatctgcttctttcattgcaagtccaaggtggccaggtcattcaagctatgcacaagtgattgttcctcctgggcttgttcaggtcccagggtggagtccttatactattggttcttcatcctcggatgaccaacaacggacacccggagctgcccaatactatactggctcacgccagagtggaacagctggcataggcgatcaaggaatgttttcatcctaccaagcaggttctgttcccgttggactttatgcagtacagagggagaatgtatttccagagagacctgaccaacctgaatgtcagttctatatgaagaccggagactgcaagtttggtgctgtatgcaagttccatcatcctagggagcgaataattcctactcccaattgtgcactgagtccattaggcctacccttgcgcccgggagaaccaatatgcagtttctataatcgctatggcatgtgcaagtttggtccaaattgcaaattcgatcatccaatgggaagtgctatgtatggccatgcttcatcgccaactagtgaggccccaacttctctgcgtatgctggcacatgtaccatcgcatccagaagtatcacctgacagtggctcgggaaggtctaggaggattgcccattctgattcccagcaaataccctctgttgaaaggagcactgagagagaggcgtcctaa

SEQ ID NO: 1490 - protein, 390 aa, Sorghum bicolor
  misc_feature: Ceres ANNOT ID no.6020759
  misc_feature: Bit score of 738.8 for HMM based on sequences of FIGURE 17.
  misc_feature (255)..(281): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MAGPPKGFDSRSRAPESGIPSERSKIEARLEDSLAMFKAVAAARMKGEYPQRIGQPECQTGTCKFGATCKFHHPREKAAMATRVQLNELGYPLRANEKECAYYLRTGQCKFGSTCKFHHPQPSTMMVAVRGSVYSPGQSATSPGQHAYQGAVTSWPLSRSASFIASPRWPGHSSYAQVIVPPGLVQVPGWSPYTIGSSSSDDQQRTPGAAQYYTGSRQSGTAGIGDQGMFSSYQAGSVPVGLYAVQRENVFPERPDQPECQFYMKTGDCKFGAVCKFHHPRERIIPTPNCALSPLGLPLRPGEPICSFYNRYGMCKFGPNCKFDHPMGSAMYGHASSPTSEAPTSLRMLAHVPSHPEVSPDSGSGRSRRIAHSDSQQIPSVERSTEREAS

SEQ ID NO: 1491 - DNA, 1350 bp, Sorghum bicolor
  misc_feature: Ceres ANNOT ID no.6028676
  misc_feature: Encodes the peptide sequence at SEQ ID NO. 1492
atggagccgtacgcggcggcgaagggcggtggggccgacgccggcaccggcctggaagagtcgatgcggaggctggggctcggcgacgacggggaaccgggggaggagaagcttccggagcggccgggcgaggcggactgcgcctactacctccgcacgggcgcctgcggctacggggagcgctgccgctacaaccacccccgcgatcggccgcctccggttaatggagttggaaagaccgcaggtatggtggagtacccagagcgtcctggacagccactctgtgagtactatgcaaagaatggcacctgtaaatttggttccaattgcaagtttgatcatcccagggaaggtggttttgtacctgtcacattaaacagcagtggattccctctacgtctgggtgaaaaggaatgttcctattacatgaaaactggacattgcaagtttggatctacatgtaaattccatcacccagaagttggttttctttcggagacacctggcatgtacccaccagttcaaccatcacctatttcctcctcacatccatatccgcatcttgccaattggcaaatggggaggcctcctgttgtgccagggtcatttttaccaggctcgtatccaccaatgatgcttccacctacagttatgccaatgcagggatggaacccttatgtttcacctatgaaccaagttacaccagctgggggacagcaagctgttccagcaggggcatcttatggtttgtcacaccagggccctacctctgccatgacttatggcagtcattatgcacaattgtattcttcatctgggacttcaagcagcaacatacaagaatatgcctttccagagcggcctgggcagcctgaatgtgaacattacatgaagaccggaacctgtaaatatggagcagtttgcaaatatcatcatcctcaatacttcagtggaccaaagtctaactacatgctgagccctctgggtcttcccctgcgtcctggttctcagccatgtgcttactatgcacaccatgggttttgcaagtttgggccgacatgcaagtttgatcatccgatgggtactccaaactatagtatttcagcatcatcacttgccgatgtgccagtcgctccatatcctcacagtttccctgttactcctatgcctccatatctgccatcttctgatctgcgtccacaatacactctagtcaaggattcctctgctaatccacctccagcgcctggaactacatatggacctgttgggtctatgtcaaaggtttatgctccccacacgcttatccgatccccagcttctgcagctgctggcatgcaagcgtcgtaa

SEQ ID NO: 1492 - protein, 449 aa, Sorghum bicolor
  misc_feature: Ceres ANNOT ID no.6028676
  misc_feature: Bit score of 353.6 for HMM based on sequences of FIGURE 17.
  misc_feature (90)..(116): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MEPYAAAKGGGADAGTGLEESMRRLGLGDDGEPGEEKLPERPGEADCAYYLRTGACGYGERCRYNHPRDRPPPVNGVGKTAGMVEYPERPGQPLCEYYAKNGTCKFGSNCKFDHPREGGFVPVTLNSSGFPLRLGEKECSYYMKTGHCKFGSTCKFHHPEVGFLSETPGMYPPVQPSPISSSHPYPHLANWQMGRPPVVPGSFLPGSYPPMMLPPTVMPMQGWNPYVSPMNQVTPAGGQQAVPAGASYGLSHQGPTSAMTYGSHYAQLYSSSGTSSSNIQEYAFPERPGQPECEHYMKTGTCKYGAVCKYHHPQYFSGPKSNYMLSPLGLPLRPGSQPCAYYAHHGFCKFGPTCKFDHPMGTPNYSISASSLADVPVAPYPHSFPVTPMPPYLPSSDLRPQYTLVKDSSANPPPAPGTTYGPVGSMSKVYAPHTLIRSPASAAAGMQAS

SEQ ID NO: 1493 - DNA, 1611 bp, Sorghum bicolor
  misc_feature: Ceres ANNOT ID no.6028677
  misc_feature: Encodes the peptide sequence at SEQ ID NO. 1494
atggagccgccgcacgccgccgaggaggccgctgccgctgccgctgcagcaggagcaggaggaggaggaggagagggcggcggcggcggcgcaagcccaggcaccggcctcgaagggccgatgctgaggctggggctggatggcggtggggaggagggggaggatggggagctgggggcgggggaggaggcggacgcgcgcctgccggagcgtcctggcgaggcggactgcggatactacctccgcacgggcgcctgcggcttcggggagcgctgccgctacaaccacccccgcgatcgcggcggcactgagtttggtggaggtgccaagaatggagcagcacaagactttccagaacgacagggtcaacctgtatgcgagtattatttgaagactgggacttgtaaatttggttccaattgcaaatatcaccatcctaagcaagatggatctgtgcagtctgttatattaaacaacaatggattccctctacgcccgggtgagaaagaatgctcctactatatgaagactgggcaatgcaagtttggttctacatgtaaatttcatcatccagaatttggtggtattccggtgacccctggaatatatccaccattacaatcagcgtctgtgccttccccccatacatatgctccaaattggcaaatgggaagatcacctgcagttcctggatcatatataccaggctcatacactccaatgatgctctcatctggaatggttccattgcaaggatggagcccttatccggcatcggtaactcctgtagcatcaggtggagcacagcaaactgttcaagctggaccgttatatggtatagggcaccatggatcttccaccgcaattgcttatggcggtacatacttgccatattcttcctcaactggacaatcgagcaataatcatcaagagcatggatttcctgagcggccagggcagcccgagtgtcaatattttatgaggactggagattgcaaatttggaaatacgtgtaaatataaccatccgcgagattggagcgctcctaagtccaattacatgttcagtcatctctgccttccacttcgtccgggtgctcagccttgtgcgtactatgcccaaaatggatattgcagatatggagttgcatgcaaatatgatcacccaatgggtacactaggctacagttcatctgctttacccctatctgacatgtcaattgctccctaccctatcggcttctctgttgccacgttggctccatcttcatcttccccagaatatatttcaaccaaagatccatctatcaatcaagtagcatcaccagtggcagcacccgaacctgttggagcaatcttgccaaaaggggtattccctccggataccattatgcgaactcagacttctacaagtgtcaggttccatagcatattgggcgcggtggtgaggctcaggtccgttccctcggtaaataattctcgggcaagaaaattttcgttgttatcaagaaaattttcacatgcagagttactgagttcctccacctttcaaatttcttttttctttttgttttctgtatattgtcacatatatattacatatatatcatga

SEQ ID NO: 1494 - protein, 536 aa, Sorghum bicolor
  misc_feature: Ceres ANNOT ID no.6028677
  misc_feature: Bit score of 361.1 for HMM based on sequences of FIGURE 17.
  misc_feature (166)..(192): Pfam Name: zf-CCCH Pfam Description: Zinc finger C-x8-C-x5-C-x3-H type
  misc_feature: Functional Homolog Of Ceres SEEDLINE ID no. ME19304 at SEQ ID NO. 1457
MEPPHAAEEAAAAAAAAGAGGGGGEGGGGGASPGTGLEGPMLRLGLDGGGEEGEDGELGAGEEADARLPERPGEADCGYYLRTGACGFGERCRYNHPRDRGGTEFGGGAKNGAAQDFPERQGQPVCEYYLKTGTCKFGSNCKYHHPKQDGSVQSVILNNNGFPLRPGEKECSYYMKTGQCKFGSTCKFHHPEFGGIPVTPGIYPPLQSASVPSPHTYAPNWQMGRSPAVPGSYIPGSYTPMMLSSGMVPLQGWSPYPASVTPVASGGAQQTVQAGPLYGIGHHGSSTAIAYGGTYLPYSSSTGQSSNNHQEHGFPERPGQPECQYFMRTGDCKFGNTCKYNHPRDWSAPKSNYMFSHLCLPLRPGAQPCAYYAQNGYCRYGVACKYDHPMGTLGYSSSALPLSDMSIAPYPIGFSVATLAPSSSSPEYISTKDPSINQVASPVAAPEPVGAILPKGVFPPDTIMRTQTSTSVRFHSILGAVVRLRSVPSVNNSRARKFSLLSRKFSHAELLSSSTFQISFFFLFSVYCHIYITYIS

SEQ ID NO: 1495 - DNA, 2046 bp, Arabidopsis thaliana
  misc_feature: Ceres SEEDLINE ID no.ME19738
  misc_feature: Predicted Sequence
  misc_feature: Expected Sequence
  misc_feature: Encodes the peptide sequence at SEQ ID NO. 1497
atgtctggttctgtatctggttgtggttctggtggttgtagtattgtatggtttagaagagatcttagggttgaagataatccagctttagcagcagcagtaagagctggtccagtgattgctctgtttgtttgggcaccagaagaagaaggacactatcatccaggtagggtttctaggtggtggctcaagaacagtttggctcagcttgattcttctcttagaagtcttggtacttgtcttatcaccaagagatctactgatagtgttgcttctcttcttgatgttgttaaatccactggtgcttctcagatcttcttcaaccatttgtatgatccattgtctttggtgcgtgatcaccgagctaaagatgttttgacggcgcaaggcatagcggttcgatcattcaacgcagacttgctttatgagccatgggaagtgactgatgaattaggccgtcctttctctatgtttgctgcgttttgggagagatgtcttagtatgccttatgaccctgagtctcctcttcttccacctaagaagatcatttcaggggatgtgtctaaatgtgttgcggatccattggtgtttgaggatgactctgagaaaggaagcaatgcacttctggctcgtgcttggtctcctggatggagtaatggtgataaagctctcacaacgtttataaacggtccattgcttgaatactctaagaaccgcagaaaagccgatagtgctacaacctcgtttctttctccacacttgcattttggggaagtgagtgtgagaaaagtttttcatcttgttcggatcaaacaggtcgcgtgggcaaacgaaggaaacgaggccggggaagaaagcgtgaatcttttcctgaaatctattggtctcagggagtattctaggtacataagttttaaccatccatattcccatgaaagaccacttcttggccatctaaagttcttcccttgggctgtggatgagaactatttcaaggcatggaggcaaggccggactggatatccgttggtcgatgccgggatgagagagttatgggctactggttggttgcatgatcgcataagagtagttgtttcaagcttctttgttaaagtgcttcaattaccatggagatgggggatgaagtatttctgggacacacttcttgatgcggatttagaaagcgatgctcttggttggcaatacattaccggtactctcccggatagccgggagtttgatcgcatagataaccctcagtttgaagggtacaagtttgatccaaatggtgaatacgtaaggcgatggcttcctgaactctctagactcccgacagactggatacatcatccgtggaacgcacctgagtccgttcttcaagctgctggtatcgagcttggatcaaactatcctctaccaattgtaggattagacgaagcaaaagcacggcttcatgaagcgctttcacagatgtggcaactagaagctgcttcaagagctgcaatagagaacggatccgaagaaggacttggagattctgctgaggtagaggaagctcctatagagttcccaagggacattacaatggaagagactgaaccaaccagactcaacccaaacaggagatatgaggatcagatggttccaagcattacttcttctttgatcagacctgaagaagacgaagagtcgtctcttaatttgagaaattcagtaggagatagcagagcagaggttccaaggaacatggttaacaccaaccaagctcagcagcggagagcagaaccggcttcaaaccaagtcactgctatgattccagaatttaatatcagaattgttgcagagagcactgaagactcaacagcggaatcttccagcagcggaaggagagaaagaagcggaggcatagtccccgagtggtctccagggtactcagagcagttccctagtgaagaaaatggtattggaggaggaagtacaacgtctagctacttgcagaatcaccatgaaatactgaactggagacggctttcacaaaccgggtaa

SEQ ID NO: 1496 - DNA, 3021 bp, Arabidopsis thaliana
  misc_feature: Ceres SEEDLINE ID no.ME19738
  misc_feature: Genomic Sequence
  misc_feature: Expected Sequence
  misc_feature: Encodes the peptide sequence at SEQ ID NO. 1497
atattcgtaaagataagctttttttttttttttgccttctcatcaaaaatctttttttttttgttgtctttcttctcgagagagataagtgaccaaagggtttcgatttctggaaatagtttgaataaaaaagtaatttttatgtgattattggcaaagaaaagttttagttttttttagtttgtgagagatgtctggttctgtatctggttgtggttctggtggttgtagtattgtatggtttagaagagatcttagggttgaagataatccagctttagcagcagcagtaagagctggtccagtgattgctctgtttgtttgggcaccagaagaagaaggacactatcatccaggtagggtttctaggtggtggctcaagaacagtttggctcagcttgattcttctcttagaagtcttggtacttgtcttatcaccaagagatctactgatagtgttgcttctcttcttgatgttgttaaatccactggtgcttctcagatcttcttcaaccatttgtatggtctgttgttcctcttctcttctctctttatcttatctttgaatttgcatgataaaaagatttgatttttgtgattggaatcatcttttctcttatgggttatgttttgtttgatgtatttgtggaataagatgatctggaaatgataaagttttgatctttttcagatccattgtctttggtgcgtgatcaccgagctaaagatgttttgacggcgcaaggcatagcggttcgatcattcaacgcagacttgctttatgagccatgggaagtgactgatgaattaggccgtcctttctctatgtttgctgcgttttgggagagatgtcttagtatgccttatgaccctgagtctcctcttcttccacctaagaagatcatttcaggtttgtttctttgccactctctcttgtgggttttcgttttttccaaatctgtatcattcaataatgtttcttttatgttgcaggggatgtgtctaaatgtgttgcggatccattggtgtttgaggatgactctgagaaaggaagcaatgcacttctggctcgtgcttggtctcctggatggagtaatggtgataaagctctcacaacgtttataaacggtccattgcttgaatactctaagaaccgcagaaaagccgatagtgctacaacctcgtttctttctccacacttgcattttggggaagtgagtgtgagaaaagtttttcatcttgttcggatcaaacaggtcgcgtgggcaaacgaaggaaacgaggccggggaagaaagcgtgaatcttttcctgaaatctattggtctcagggagtattctaggtacataagttttaaccatccatattcccatgaaagaccacttcttggccatctaaagttcttcccttgggctgtggatgagaactatttcaaggcatggaggcaaggccggactggatatccgttggtcgatgccgggatgagagagttatgggctactggttggttgcatgatcgcataagagtagttgtttcaagcttctttgttaaagtgcttcaattaccatggagatgggggatgaagtatttctgggacacacttcttgatgcggatttagaaagcgatgctcttggttggcaatacattaccggtactctcccggatagccgggagtttgatcgcatagataaccctcagtttgaagggtacaagtttgatccaaatggtgaatacgtaaggcgatggcttcctgaactctctagactcccgacagactggatacatcatccgtggaacgcacctgagtccgttcttcaagctgctggtatcgagcttggatcaaactatcctctaccaattgtaggattagacgaagcaaaagcacggcttcatgaagcgctttcacagatgtggcaactagaagctgcttcaagagctgcaatagagaacggatccgaagaaggacttggagattctgctgaggtagaggaagctcctatagagttcccaagggacattacaatggaagagactgaaccaaccagactcaacccaaacaggagatatgaggatcagatggttccaagcattacttcttctttgatcagacctgaagaagacgaagagtcgtctcttaatttgagaaattcagtaggagatagcagagcagaggttccaaggaacatggttaacaccaaccaagctcagcagcggagagcagaaccggcttcaaaccaagtcactgctatgattccagaatttaatatcagaattgttgcagagagcactgaagactcaacagcggaatcttccagcagcggaaggagagaaagaagcggaggcatagtccccgagtggtctccagggtactcagagcagttccctagtgaagaaaatggtattggaggaggaagtacaacgtctagctacttgcagaatcaccatgaaatactgaactggagacggctttcacaaaccgggtatgtaactcgcaaatccgactctctcaacaataagttcacataaagattctaaacattttcaaattgaaagtctccaaattttcagtaagtttcaatcttcctacacaattcaaataaatcgtcgatgcgcgttgtgcttggcacacttgtctagccaagtagtatcagttttaaattgaatttagctgaaaagttttgaactgttttcaaatccaagtgtttgcatttacagtagaccacagtaaaaaaattagtgaaagtttctatgtttcacagttcaattggaatttggtacattggtctaaccaagtggcatgaaatttactgtggtatgtttggttttacaggtaaaaagtgcatttggaggtgcaaaaggagaggaacatcataagggctgtaactccggtgaaatctggttggactgtaaaccgagtacatttggtacggtttaatgtaattccggttatggggctggagagaaactatgtaggagtttgtctgatgtacattttttatttatctctggttccatcatg

SEQ ID NO: 1497 - protein, 681 aa, Arabidopsis thaliana
  misc_feature: Ceres SEEDLINE ID no.ME19738
  misc_feature: Bit score of 1854.7 for HMM based on sequences of FIGURE 18.
  misc_feature (12)..(183): Pfam Name: DNA_photolyase Pfam Description: DNA photolyase
  misc_feature (214)..(492): Pfam Name: FAD_binding_7 Pfam Description: FAD binding domain of DNA photolyase
  misc_feature (214)..(492): Pfam Name: FAD_binding_7 Pfam Description: FAD binding domain of DNA photolyase
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENGIGGGSTTSSYLQNHHEILNWRRLSQTG

SEQ ID NO: 1498 - DNA, 2046 bp, Populus balsamifera subsp. trichocarpa
  misc_feature: Ceres ANNOT ID no.1443463
  misc_feature: Encodes the peptide sequence at SEQ ID NO. 1499
atgtcaggtggtggctgtagtatagtttggttcaggagagatctaagggtagaagataacccagcacttgcagctggtgtaagagcaggtgcggttgttgcagtgtttgtatgggcacctgaagaggaaggccattattatcctggtagggtctcaaggtggtggcttaaacaaagtttggctcatcttgactcttctttaaggagtcttggtacttctcttgttactaagagatcaaccgatagtgtttctactcttcttgaggttatcaaatctactggggctactcagctcttcttcaaccacttatatgatcccctgtcgctggttagggatcatcgggcaaaggaggttttgactgctcaaggtattgctgtaagatcttttaatgcagatttactttatgaaccatgggatgttaacgatgcccaaggccgtcccttcacaacctttgctactttctgggatagatgcctcagcatgccttttgatccagaggctccacttctcccgcctaagaggattatttcgggtgatgcatctagatgcccttcagagatgctggtatttgaagatgaattggagaaaggaagcaatgcacttcttgccagagcatggtcacctggatggagcaatgctgatagggctctgaccactttcattaatggaccattaattgagtactctaagaatcgtaggaaggctgatagcgctacaacctcatttctctctccgcacttgcattttggggaggtgagtgtgagaaaagtcttccatcttgttcgcataaagcaggttctgtgggcaaatgaagggaacaaggctggagaagagagtgtaaacttgtttctcaagtcaattggtcttagggaatattcaagatacttgagtttcaaccatccttacagtcatgaaaggcctcttcttgggcaccttaagttcttcccttgggtcgtggacggaggctattttaaggcatggagacaaggtagaacaggttatccattagttgatgctgggatgagagaattgtgggccaccggttggctgcatgatcgtatacgtgtggttgttgcgagtttctttgtgaaggttctacaacttccatggagatggggaatgaagtatttttgggataccctattggatgcagatttagagagtgatgctcttggttggcaatacataaccggcactctcccagatggccgggagtttgatcgcatagataatccacagtttgagggttacaaatttgacccaaatggagaatatgtacgccggtggcttcctgaacttgctaggctaccaactgaatggatacaccacccatggaatgcacctgaatctgtacttcaagctgctggtattgagctgggatcaaattatcctctccctattgtagggatagatgcagcaaaggtcaggttggaagaagcactttcagaaatgtggcagcaagaagctgcttcaagagctgcaattgagaatggaactgaggaagggcttggagactcttctgaatcagctccaattgccttccctcaagacataaatatggaggaaaaccatgagcctgtgagaaacaatcctcctgctacaaatcgccgctatgaggatcagatggtcccaagcatgacctcttcttttctgagaattgaagacgaagaaacttcttcagatgttcgcaattctacaggagatggcagagcagaggtaccaagagatgtaaatgtaaatcaacaaccaagaagagacactttgaaccaggggtttgtgcaaagtgttcataatgacaacagtttgccaccatttaacgttgtgagaggtctggcaaatgttgaagactcaacagcagaatcttcgagcagtagtaggagagagagggatggaggtatagttccagtttggtcccctccagcttctagttactcagagcagtttgttggtgatgaaaatggaattggggcaacttcttcttacttgccgaggcatccacaatctcaccagatactcaattggaggcggctaccccaaaccgggtaa

SEQ ID NO: 1499 - protein, 681 aa, Populus balsamifera subsp. trichocarpa
  misc_feature: Ceres ANNOT ID no.1443463
  misc_feature: Bit score of 1832.0 for HMM based on sequences of FIGURE 18.
  misc_feature (207)..(485): Pfam Name: FAD_binding_7 Pfam Description: FAD binding domain of DNA photolyase
  misc_feature (207)..(485): Pfam Name: FAD_binding_7 Pfam Description: FAD binding domain of DNA photolyase
  misc_feature (5)..(176): Pfam Name: DNA_photolyase Pfam Description: DNA photolyase
  misc_feature: Functional Homolog Of Ceres SEEDLINE ID no. ME19738 at SEQ ID NO. 1497
MSGGGCSIVWFRRDLRVEDNPALAAGVRAGAVVAVFVWAPEEEGHYYPGRVSRWWLKQSLAHLDSSLRSLGTSLVTKRSTDSVSTLLEVIKSTGATQLFFNHLYDPLSLVRDHRAKEVLTAQGIAVRSFNADLLYEPWDVNDAQGRPFTTFATFWDRCLSMPFDPEAPLLPPKRIISGDASRCPSEMLVFEDELEKGSNALLARAWSPGWSNADRALTTFINGPLIEYSKNRRKADSATTSFLSPHLHFGEVSVRKVFHLVRIKQVLWANEGNKAGEESVNLFLKSIGLREYSRYLSFNHPYSHERPLLGHLKFFPWVVDGGYFKAWRQGRTGYPLVDAGMRELWATGWLHDRIRVVVASFFVKVLQLPWRWGMKYFWDTLLDADLESDALGWQYITGTLPDGREFDRIDNPQFEGYKFDPNGEYVRRWLPELARLPTEWIHHPWNAPESVLQAAGIELGSNYPLPIVGIDAAKVRLEEALSEMWQQEAASRAAIENGTEEGLGDSSESAPIAFPQDINMEENHEPVRNNPPATNRRYEDQMVPSMTSSFLRIEDEETSSDVRNSTGDGRAEVPRDVNVNQQPRRDTLNQGFVQSVHNDNSLPPFNVVRGLANVEDSTAESSSSSRRERDGGIVPVWSPPASSYSEQFVGDENGIGATSSYLPRHPQSHQILNWRRLPQTG

SEQ ID NO: 1500 - DNA, 2043 bp, Populus balsamifera subsp. trichocarpa
  misc_feature: Ceres ANNOT ID no.1504954
  misc_feature: Encodes the peptide sequence at SEQ ID NO. 1501
atgtcaggaggtgggtgtagtatagtttggttcagaagagatctaagggtagaagataacccggcacttgcagctggtgtaagagcaggtgctgttgttgctgtgtttgtatgggcacccgaggaggaaggccattattatcccggtagggtctcaaggtggtggcttaaacaaagtttggctcatcttgactcttctttaaggagtcttggtacttctcttgttactaagagatcaactgatagtgtttcttctcttcttgaggttgtcaaatctaccggtgctactcagcttttattcaaccacttatatgaccccttgtcactggttagggatcaccgggcaaaggagattttgactgctcaaggtattactgtaagatcttttaacgcggacttgctttatgaaccatgggatgttaatgatgcccagggccgtccgttcacaacctttgacactttctgggaaagatgcctcagcatgccttttgatccagaggctccacttctcccgcctaagaggattatttcgggtgatgtatccagatgcccttcagtcacgctggtatttgaagatgaatcagagaaaggaagcaatgcacttcttgcaagagcatggtcacctggatggagcaatgctgatagggctttgaccactttcattaacggaccactaattgagtactctatgaatcgtagaaaggctgatagcgccacaacctcatttctctcaccacacttgcattttggggaggtgagtgtgagaaaagtcttccatcttgttcgcatcaagcaggttctgtgggcaaatgaagggaacagggccggcgaagagagtgtaaacttgtttatcaagtcaattggtcttagggaatattcaagatacttgagtttcaaccatccttgcactcatgaaaggcctcttcttgggcaccttaagtttttcccttgggttgtggacgaaggctattttaaggcatggagacaaggtagaacaggttatccattagttgacgctggaatgagagaattgtgggctgctggttggctgcatgatcgtatacgtgtggtagttgctagtttctttgtgaaggttctacaacttccatggagatggggaatgaagtatttttgggataccctattggatgcagatttagagagcgatgctcttgggtggcaatacataaccggcactctcccagacagccgtgagtttgatcgcatagataatccacagtttgagggttacaaatttgacccgaatggagaatatgtacgccggtggcttcctgaacttgctaggctaccaactgaatggatacaccacccatggaatgcacctgaatctgtactccaagctgccggaattgagctgggatcaaattaccctctccctattgtagggatagatgcagcaaaggtcaggttggaagaagcactttcagaaatgtggcagcaagaagctgcttcaagagctgcaattgagaatggaacagaggaagggcttggagactcctctgaatcagccccatttgccttccccgaagacatacatatggaggaaaaccatgagcctgtgagaaacaatcctcctgctacaaatcgtcgctatgaggatcagatggtcccaagcatgacatcttcctttctgagaattgaagacgaagaaacttctgatgtacgcaattctacaggagatggcagagcagaggtgccaagagatgtaaatgtgaatcaagaaccaagaagagacgctttgaaccaggggtttgttcaaactgttcgtaataacactgctttgtcaccatttaatatttcgagaggtctgacaaatgttgaagactcgaccgcagagtcttcaagtagtggtaggagagagagggatggaggtatagttccagtttggtcccctccaacttctagttactcagagcagtttgttggtgatgacaatggaattggagcaacttcttcttacttgcagaggcatccacagtctcaccagataatcaattggaggcggctatctcaaactgggtaa

SEQ ID NO: 1501 - protein, 680 aa, Populus balsamifera subsp. trichocarpa
  misc_feature: Ceres ANNOT ID no.1504954
  misc_feature: Bit score of 1777.5 for HMM based on sequences of FIGURE 18.
  misc_feature (207)..(485): Pfam Name: FAD_binding_7 Pfam Description: FAD binding domain of DNA photolyase
  misc_feature (207)..(485): Pfam Name: FAD_binding_7 Pfam Description: FAD binding domain of DNA photolyase
  misc_feature (5)..(176): Pfam Name: DNA_photolyase Pfam Description: DNA photolyase
  misc_feature: Functional Homolog Of Ceres SEEDLINE ID no. ME19738 at SEQ ID NO. 1497
MSGGGCSIVWFRRDLRVEDNPALAAGVRAGAVVAVFVWAPEEEGHYYPGRVSRWWLKQSLAHLDSSLRSLGTSLVTKRSTDSVSSLLEVVKSTGATQLLFNHLYDPLSLVRDHRAKEILTAQGITVRSFNADLLYEPWDVNDAQGRPFTTFDTFWERCLSMPFDPEAPLLPPKRIISGDVSRCPSVTLVFEDESEKGSNALLARAWSPGWSNADRALTTFINGPLIEYSMNRRKADSATTSFLSPHLHFGEVSVRKVFHLVRIKQVLWANEGNRAGEESVNLFIKSIGLREYSRYLSFNHPCTHERPLLGHLKFFPWVVDEGYFKAWRQGRTGYPLVDAGMRELWAAGWLHDRIRVVVASFFVKVLQLPWRWGMKYFWDTLLDADLESDALGWQYITGTLPDSREFDRIDNPQFEGYKFDPNGEYVRRWLPELARLPTEWIHHPWNAPESVLQAAGIELGSNYPLPIVGIDAAKVRLEEALSEMWQQEAASRAAIENGTEEGLGDSSESAPFAFPEDIHMEENHEPVRNNPPATNRRYEDQMVPSMTSSFLRIEDEETSDVRNSTGDGRAEVPRDVNVNQEPRRDALNQGFVQTVRNNTALSPFNISRGLTNVEDSTAESSSSGRRERDGGIVPVWSPPTSSYSEQFVGDDNGIGATSSYLQRHPQSHQIINWRRLSQTG

SEQ ID NO: 1502 - protein, 681 aa, Arabidopsis thaliana
  misc_feature: Public GI ID no.13605525
  misc_feature: Bit score of 1852.7 for HMM based on sequences of FIGURE 18.
  misc_feature (12)..(183): Pfam Name: DNA_photolyase Pfam Description: DNA photolyase
  misc_feature (214)..(492): Pfam Name: FAD_binding_7 Pfam Description: FAD binding domain of DNA photolyase
  misc_feature (214)..(492): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSGSVSGCGSGGCSIVWFRRDLRVEDNPALAAAVRAGPVNALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENGIGGGSTTSSYLQNHHEILNWRRLSQTG

SEQ ID NO: 1503 - protein, 681 aa, Arabidopsis thaliana
  misc_feature: Public GI ID no.2499553
  misc_feature: Bit score of 1851.5 for HMM based on sequences of FIGURE 18.
  misc_feature (12)..(183): Pfam Name: DNA_photolyase Pfam Description: DNA photolyase
  misc_feature (214)..(492): Pfam Name: FAD_binding_7 Pfam Description: FAD binding domain of DNA photolyase
  misc_feature (214)..(492): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENRIGGGSTTSSYLQNHHEILNWRRLSQTG

SEQ ID NO: 1504 - protein, 681 aa, Arabidopsis thaliana
  misc_feature: Public GI ID no.738308
  misc_feature: Bit score of 1848.5 for HMM based on sequences of FIGURE 18.
  misc_feature (12)..(183): Pfam Name: DNA_photolyase Pfam Description: DNA photolyase
  misc_feature (214)..(492): Pfam Name: FAD_binding_7 Pfam Description: FAD binding domain of DNA photolyase
  misc_feature (214)..(492): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYQPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENRIGGGSTTSSYLQNHHEILNWRRLSQTG

SEQ ID NO: 1505 - protein, 702 aa, Arabidopsis thaliana
  misc_feature: Public GI ID no.4325368
  misc_feature: Bit score of 1784.6 for HMM based on sequences of FIGURE 18.
  misc_feature (12)..(183): Pfam Name: DNA_photolyase Pfam Description: DNA photolyase
  misc_feature (214)..(478): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSGSVSGCGSGGCSIVWFRRDLRVEDNPALAAAVRAGPVIALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENGIGGGSTTSSYLQNHHEILNWRRLSQTGYVKSAFGGAKGEEHHKGCNSGEIWLDCKPSTFGTV

SEQ ID NO: 1506 - protein, 680 aa, Brassica napus
  misc_feature: Public GI ID no.94965681
  misc_feature: Bit score of 1849.7 for HMM based on sequences of FIGURE 18.
  misc_feature (10)..(181): Pfam Name: DNA_photolyase Pfam Description: DNA photolyase
  misc_feature (212)..(490): Pfam Name: FAD_binding_7 Pfam Description: FAD binding domain of DNA photolyase
  misc_feature (212)..(490): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSNSCSGGGGCSIVWFRRDLRVEDNPALAAAVRAGPVIAVFVWAPEEEGHYQPGRVSRWWLKNSLAQLDSSLRSLGTCLITKRSTDSVASLLEVVKSTGASQIFFNHLYDPLSLVRDHRAKDALTAEGIAVKSFNADLLYEPWEVTDELGRPFSMFAAFWERCLSMPYDPESPLLPPKKIISGDVSKCVADTLIFEDESEKGSNALLARAWSPGWSNADKALTTFINGPLIEYSKNRRKADSATTSFLSPHLHFGEVSVRKVFHLLRIKQVAWANEGNQAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTEWIHHPWNAPESVLQAAGIELGSNYPRPIVGLDEAKARLHEALSQMWQLEAASRAAIENGSEEGLGDSTEFVEAPIEFPRDITMEETEPTRLNPVRRYEDQMVPSITTSLIRPEEDQESSLSLRNSGGDSRAEVPRNMVNTNQARQQEARADPVSNQVTAMIPEFNIRIVAENTEESTAESSSSGRRERDGGIVPEWSGYSEQFASEENGIGGGSTTSSYLQNHHEIVNWRRLSQTG

SEQ ID NO: 1507 - DNA, 1667 bp, Triticum aestivum
  misc_feature: Ceres CLONE ID no.919923
  misc_feature: Encodes the peptide sequence at SEQ ID NO. 1508
agaacatcctaatcgaaaaattacatatcgatatatcaccatctcttgccccttggaggttggtgcctgtctcaggtatagaaaacatttgcagtagttcaattgataacctaggtcttgaatcaagtaaggatgaggaatcaagcaatgctttgctaagcagggcttggtctcctggctggcgcaatgcggagaagacacttgaggatttcgtgtctcatggtctcctagattattcaaaagacagaatgaaggttgccggaactacaacatcgttattgtcaccatatcttcattatggtgaggtgagtgtaaggaaaatctatcaacttgtcagggtgcaacagatcaagtgggaaaatgaggggaaatccggagctggggagagtgttaacttgttcctgctgtcaattggtcttcgagaatattcacgttacttgtgtttcaactttccattcacacatgaaaggtcgctgctggggaacttgaaacactacccctggcgagcagacgaggaccggttcaaatcctggagacagggaatgacaggatacccgttagtagatgctggcatgagggagctatgggctactggctggacacataatcgtataagagtaatagtttcaagctttgctgtgaaatttctacaaattccgtggacttgggggatgaagtacttttgggatgtgctgttggatgctgatatagaaagtgatattcttggctggcagtacatatctgggtctttgcctgatggacacgagcttggtcgtcttgataatccagaggttcaaggtcaaaagtatgacccagatggtgaatacgtaagaacttggattccagagctagctagaatgccaggggaatggatccatcatccgtgggatgcaccgagctctatactagaagttgctggtgttgagctaggcttcaactatcctatgcccatagtagaacttcacacggctcgggagtgcttagatgatgccatctccacgatgtggcaattggatacagccgaaaaactagcagaattagatggtgaggttgttgaagacaacttgagccatatcaagagttttgatgtcccaaaagttgttttgaaggaactatctcctcactgtgatagagaagtgcccactgatgatggcaggaatcttgagttacaacctaaggaactgaagggcacaaataaacagaccatttgtgttgatgtaatcaaggcctcaaagatggaagacacaggctccatagcaaactctccgatatcaaggaaaagatccagcagtgggagtgtgtttaatgtcccatcttattcatcttcagtcgaagtgcactcacagaatcagcatcctggtggttatttagttgggtcgtcaaaatatatcctgcagaaagcagagaggaactgtgttggtaaggcagaagatgacgacagtgccgatagtggtacaaacacctcaagagcatccaagagacctgccgcctgacgagggtggttgtggatgacgtacacggctgaacaatggagcggacaagcgcaacactcggatcttcctgcaccccactctcatcctaagaaaaatttgtacattttgctgtctggttatttttgtcaaatctgttatatatatgtaacctataattagttgcaacacttggac

SEQ ID NO: 1508 - protein, 414 aa, Triticum aestivum
  misc_feature: Ceres CLONE ID no.919923
  misc_feature: Bit score of 151.6 for HMM based on sequences of FIGURE 18.
  misc_feature (1)..(253): Pfam Name: FAD_binding_7 Pfam Description: FAD binding domain of DNA photolyase
  misc_feature (261)..(353): Pfam Name: DNA_photolyase Pfam Description: DNA photolyase
  misc_feature: Functional Homolog Of Ceres SEEDLINE ID no. ME19738 at SEQ ID NO. 1497
MKVAGTTTSLLSPYLHYGEVSVRKIYQLVRVQQIKWENEGKSGAGESVNLFLLSIGLREYSRYLCFNFPFTHERSLLGNLKHYPWRADEDRFKSWRQGMTGYPLVDAGMRELWATGWTHNRIRVIVSSFAVKFLQIPWTWGMKYFWDVLLDADIESDILGWQYISGSLPDGHELGRLDNPEVQGQKYDPDGEYVRTWIPELARMPGEWIHHPWDAPSSILEVAGVELGFNYPMPIVELHTARECLDDAISTMWQLDTAEKLAELDGEVVEDNLSHIKSFDVPKVVLKELSPHCDREVPTDDGRNLELQPKELKGTNKQTICVDVIKASKMEDTGSIANSPISRKRSSSGSVFNVPSYSSSVEVHSQNQHPGGYLVGSSKYILQKAERNCVGKAEDDDSADSGTNTSRASKRPAA

SEQ ID NO: 1509 - DNA, 2690 bp, Zea mays
  misc_feature: Ceres CLONE ID no.1659764
  misc_feature: Encodes the peptide sequence at SEQ ID NO. 1510
agaagagtaggggggaaattactactctacgactcgtgcgcccactcctccactgttcttgggaatctcgggggagaagaggaagagagcagtgggtctcagcgcaccactcattcctggctccatggcttcctgacgtcctctcctgtcgatccaaggacaccgggggtttcttggaaacaagttcttggattggtccgccaccagcccaccaccaggcaccatgtcggtctcgccctcgtccctgtgcggcggggacccggcgatgaggatcgtggtgtggttccggagggacctcagggtggaggacaacccggcgctcgcggcggcggcgcgtgccggtggggaggtggtgccggcgtacgtctggtcgccagaggaggagggcccttactaccccggccgcgtatcccggtggtggatcagccagagcctgaaccacctggacgcctcgctccgccgccttggggcgggaaagcttgtcacgcggaggtcggccgacgccgccgtcgcgctgctccagctggtccgcgacaccggcgccacgcacgtctacttcaatcatctatacgacccgatctcactggtcagggaccgccggttgaaggagatgctggcggctgagggcatcgttgtgcaatctttcaattcggatctgctgtacgagccatgggaagttgtcgatgatgaagggcagccattcaccatgttcgacccgttctggaacaggtgcctcagcatgccgtatgacccccctgcaccgcttctgcccccgaagaggatcaattcaggtgacttatcgatgtgcccatcggaggatctgatctttgaggacgagtcagagaggggaagcaacgctcttctggcccgagcgtggacgccagggtggcagaacgcagacaaggcgctgacggccttcctcaacggcccactggccgactactcagtgaaccgcaagaaggccgatagcgcgagcacgtccctgctgtcgcctcacctgcacttcggcgagcttagcgtgcgcaaggtcttccacctagttcgcatgaagcagctcgtgtggagcaacgagggcaaccacgctgccgaggagagctgcaccctgttcctccgttccatcggcctgcgggagtactcccggtacctgagcttcaatcacccgagcagccatgagaggcccctcctggcgcacctcaggttcttcccctgggtggtggacgagagctacttcaagatttggaggcagggaaggaccgggtacccgctcgtcgacgctggcatgagggagctgtgggcgacggggtggctgcatgaccggatacgtgtggtggtggcaagcttcttcgtcaaggtcctccagcttccatggcgatggggcatgaagtacttttgggacacgttactggatgctgatcttgagagcgatgcgctgggctggcagtacatcactggctctcttcctgatggccgggagcttgaccgcatcgacaacccccagtttgaaggctacaagttcgacccgcatggggagtacgtccggcggtggattcctgagctcgcaaggctgccgacggagtggatacaccatccatgggacgcgcctgtctccgtgctgtaagctgcaggaatcgagctgggctccaactaccctctccccatagtggagctggacgcggccaaggccaggctgcaagcggccctgtcagagatgtggcagctggaggcggcgtcgagggccacgatgaacaacgggacggaggaaggcctcggcgactcctcggaggtcctgttccctcaagagctgcagatggaggtcgaccggcagccagccccagccgaggcagcagccaacgtgcacgtgcccgtgccgatgcctgcccggaggcgcggggaccagatggtgcccaccatgacgacctcttcgctgaacagagctggaacagaggtctccgccgatctagtagtagcgaacagcgaggaggaggacaccagggcgcaggttccgttccacgcgcatctccatctccacccccgagccgaagccccgccagctgcgcgtagaaccaacaacggcgctcgccagcacgacgtcttccagcagcgtcggaaccacaggcgagatgctctgcttgctccgtcggcgtcggaggcttcgagcagctggaccggcagagagggcgccgtggtcccggtctggtcgcctcctgcggcgtcgggccattcggacgccttcgctgccgacgaagctgacgtctctagtaggagctatctgggtaggcatccgcagtcgcaccgcctgatgaactggagccaactatcgcagtcatcgtgagctcggatgcacgcagcagaagattctgtgcggccaaacttaatcgagctgaagattctcgtatgtagattgtccactgaactgctcatccatagtctgatgggatggaaaccaggcggcttttcctggttgtggtggctatagctgtgtaaatctctgtcttctagaacgtgtgtggtcgatatagtgcggttggctttacaacaaaaaaaaaaggtcgctattcttgatcagacgacaaaggttttccgtattttttttagccttttttgggggaggtatgtgatgtatgtaaccgtaactgtacattcccttgtgctgaccatattgttagtttccataaaaaaaaaaaaaaaaa

SEQ ID NO: 1510 - protein, 464 aa, Zea mays
  misc_feature: Ceres CLONE ID no.1659764
  misc_feature: Bit score of 933.2 for HMM based on sequences of FIGURE 18.
  misc_feature (15)..(188): Pfam Name: DNA_photolyase Pfam Description: DNA photolyase
  misc_feature (219)..(464): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSVSPSSLCGGDPAMRIVVWFRRDLRVEDNPALAAAARAGGEVVPAYVWSPEEEGPYYPGRVSRWWISQSLNHLDASLRRLGAGKLVTRRSADAAVALLQLVRDTGATHVYFNHLYDPISLVRDRRLKEMLAAEGIVVQSFNSDLLYEPWEVVDDEGQPFTMFDPFWNRCLSMPYDPPAPLLPPKRINSGDLSMCPSEDLIFEDESERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVDESYFKIWRQGRTGYPLVDAGMRELWATGWLHDRIRVVVASFFVKVLQLPWRWGMKYFWDTLLDADLESDALGWQYITGSLPDGRELDRIDNPQFEGYKFDPHGEYVRRWIPELARLPTEWIHHPWDAPVSVL

SEQ ID NO: 1511 - protein, 712 aa, Oryza sativa subsp. indica
  misc_feature: Public GI ID no.125539984
  misc_feature: Bit score of 1595.9 for HMM based on sequences of FIGURE 18.
  misc_feature (11)..(192): Pfam Name: DNA_photolyase Pfam Description: DNA photolyase
  misc_feature (225)..(503): Pfam Name: FAD_binding_7 Pfam Description: FAD binding domain of DNA photolyase
  misc_feature (225)..(503): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSGAGAGEAGVRTVVWFRRDLRVEDNPALAAAARAAGEVVPVYVWAPEEDGPYYPGRVSRWWLSQSLKHLDASLRRLGASRLVTRRSADAVVALIELVRSIGATHLFFNHLYGSIDPEFQIDPLSLVRDHRVKALLTAEGIAVQSFNADLLYEPWEVVDDDGCPFTMFAPFWDRCLCMPDPAAPLLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPESVLQAAGIELGSNYPLPIVELDAAKTRLQDALSEMWELEAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTGREGGVVPVWSPPAASGPSDHYAADEADITSRSYLDRHPQSHTLMNWSQLSQSL

SEQ ID NO: 1512 - protein, 700 aa, Oryza sativa subsp. japonica
  misc_feature: Public GI ID no.28201254
  misc_feature: Bit score of 1891.3 for HMM based on sequences of FIGURE 18.
  misc_feature (18)..(191): Pfam Name: DNA_photolyase Pfam Description: DNA photolyase
  misc_feature (222)..(500): Pfam Name: FAD_binding_7 Pfam Description: FAD binding domain of DNA photolyase
  misc_feature (222)..(500): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSVSSSSMGGGGGGDAGGRTVVWFRRDLRVEDNPALAAAARAGGEVVPAYVWAPEEDGPYYPGRVSRWWLSQSLKHLDASLRRLGAGKLVTRRSADAVVALLQLVRDTGATRLFFNHLYDPISLVRDHRLKEMMAAEGIIVQSFNADLLYEPWEVVDDEGQSFTMFAPFWNRCLSMPYDPAAPLLPPKRINSGDLSMCPSDDLIFEDDSERGSNALLARAWSPGWQNADKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDAANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPATEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 1513 - protein, 693 aa, Oryza sativa subsp. japonica
  misc_feature: Public GI ID no.21740729
  misc_feature: Bit score of 1865.0 for HMM based on sequences of FIGURE 18.
  misc_feature (11)..(184): Pfam Name: DNA_photolyase Pfam Description: DNA photolyase
  misc_feature (215)..(493): Pfam Name: FAD_binding_7 Pfam Description: FAD binding domain of DNA photolyase
  misc_feature (215)..(493): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MGGGGGGDAGGRTVVWFRRDLRVEDNPALAAAARAGGEVVPAYVWAPEEDGPYYPGRVSRWWLSQSLKHLDASLRRLGAGKLVTRRSADAVVALLQLVRDTGATRLFFNHLYDPISLVRDHRLKEMMAAEGIIVQSFNADLLYEPWEVVDDEGQSFTMFAPFWNRCLSMPYDPAAPLLPPKRINSGDLSMCPSDDLIFEDDSERGSNALLARAWSPGWQNADKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDAANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPRTEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 1514 - protein, 700 aa, Oryza sativa subsp. japonica
  misc_feature: Public GI ID no.115458700
  misc_feature: Bit score of 1889.1 for HMM based on sequences of FIGURE 18.
  misc_feature (18)..(191): Pfam Name: DNA_photolyase Pfam Description: DNA photolyase
  misc_feature (222)..(500): Pfam Name: FAD_binding_7 Pfam Description: FAD binding domain of DNA photolyase
  misc_feature (222)..(500): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSVSSSSMGGGGGGDAGGRTVVWFRRDLRVEDNPALAAAARAGGEVVPAYVWAPEEDGPYYPGRVSRWWLSQSLKHLDASLRRLGAGKLVTRRSADAVVALLQLVRDTGATRLFFNHLYDPISLVRDHRLKEMMAAEGIIVQSFNADLLYEPWEVVDDEGQSFTMFAPFWNRCLSMPYDPAAPLLPPKRINSGDLSMCPSDDLIFEDDSERGSNALLARAWSPGWQNADKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDAANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPRTEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 1515 - protein, 697 aa, Oryza sativa subsp. japonica
  misc_feature: Public GI ID no.125590574
  misc_feature: Bit score of 1805.5 for HMM based on sequences of FIGURE 18.
  misc_feature (219)..(497): Pfam Name: FAD_binding_7 Pfam Description: FAD binding domain of DNA photolyase
  misc_feature (219)..(497): Pfam Name: FAD_binding_7 Pfam Description: FAD binding domain of DNA photolyase
  misc_feature (23)..(188): Pfam Name: DNA_photolyase Pfam Description: DNA photolyase
  misc_feature: Functional Homolog Of Ceres SEEDLINE ID no. ME19738 at SEQ ID NO. 1497
MQFLGNRAIYAVLRKTLEQIIGRDLRVEDNPALAAAARAGGEVVPAYVWAPEEDGPYYPGRVSRWWLSQSLKHLDASLRRLGAGKLVTRRSADAVVALLQLVRDTGATRLFFNHLYDPISLVRDHRLKEMMAAEGIIVQSFNADLLYEPWEVVDDEGQSFTMFAPFWNRCLSMPYDPAAPLLPPKRINSGDLSMCPSDDLIFEDDSERGSNALLARAWSPGWQNADKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDAANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPRTEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 1516 - protein, 710 aa, Oryza sativa subsp. japonica
  misc_feature: Public GI ID no.16444957
  misc_feature: Bit score of 1628.9 for HMM based on sequences of FIGURE 18.
  misc_feature (18)..(190): Pfam Name: DNA_photolyase Pfam Description: DNA photolyase
  misc_feature (223)..(501): Pfam Name: FAD_binding_7 Pfam Description: FAD binding domain of DNA photolyase
  misc_feature (223)..(501): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSASPSSMSGAGAGEAGVRTVVWFRRDLRVEDNPALAAAARAAGEVVPVYVWAPEEDGPYYPGRVSRWWLSQSLKHLDASLRRLGASRLVTRRSADAVVALIELVRSIGATHLFFNHLYDPLSLVRDHRVKALLTAEGIAVQSFNADLLYEPWEVVDDDGCPFTMFAPFWDRCLCMPDPAAPLLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPESVLQAAGIELGSNYPLPIVELDAAKTRLQDALSEMWELEAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTGREGGVVPVWSPPAASGPSDHYAADEADITSRSYLDRHPQSHTLMNWSQLSQSL

SEQ ID NO: 1517 - DNA, 2743 bp, Panicum virgatum
  misc_feature: Ceres CLONE ID no.1784494
  misc_feature: Encodes the peptide sequence at SEQ ID NO. 1518
agaagcaccaactgcaagagcaccaacaccgaacaaaaacataatcaaattgcgagcccagaaatacaaggaaaaatattactcctgcaactcgtgcggcgcactcctccactgttcttgggaatcttgggaggaagaaagtagagtctctgagctccctgccagttcgtggcgcgagtggcctcatggtttcttgacgtcatctgctcttgatccaagaactcgggggtttcttggaccggtggttcttggattggccggccatgtcggtctcgtccccgtccatgtgcggcggcggggagaccgggaggatcgtggtgtggttccggagggacctcagggtggaggacaacccggcgctagcggcggcggcgcgcgccggaggggaggtggtgccggcgtacgtgtggtcgccggaggaggacggcccttaccatccggggcgcgtgtcccggtggtggatcagccagagcctgcagcatctggacgcctcgctccgccggctaggggcaggaaagctcgtcacgcggaggtctgccgacgccgtcgtcgctctgctccagctggtccgcgacaccggcgccacgcacgtctacttcaatcatctctacgaccctatctcgctggtcagggaccaccggctgaaggagatgctgacggctgagggcattgtcgtgcgatctttcaatgcggatctgctttatgagccatgggaagttgttgatgatgaagggcagccattcaccatgtttgccccattctggaacaggtgcctcagcatgtcgtacgatccccccgcgccgcttctgcccccgaagaagatcaattcaggtaacttatcaatgtgcccatccgatgatctgatctttgaggatgaatcagagaggggaagcaacgctcttctggcccgagcatggacaccaggatggcagaacgcagacaaggcgctaacggccttcctcaacggtcctctggctgactattcagtgaaccgcaagaaggctgatagcgcaagcacatccctactttcaccgcacctccattttggtgagcttagcgtgcgcaaggtcttccacctagttcgtatgaaacagcttgtgtggagcaacgagggcaaccacgctgctgaggagagctgcacactgttcctgagttccattggcctgcgggagtactcccgctatctgagcttcaaccatccaagcagccatgagaggcccctcttggcacacctcaggttcttcccctgggtggtcaatgagtgctacttcaagatttggaggcagggaaggactggatacccgcttgtggatgctggcatgagggaactgtgggcgacagggtggttgcatgaccggatacgtgtggtggtgtcaagcttctttgtcaaggtccttcaacttccatggcgatggggtatgaagtacttctgggacactttactggatgcagatcttgagagcgatgcactgggctggcagtacatcactggctctctccctgatggtcgagagcttgaccgcattgacaaccctcagtttgaaggctacaagtttgacccgcatggggagtatgttcgacggtggattccggagcttgcaaggctgccgacagaatggatacatcacccatgggatgcacctgtttccgtgctacaagctgcaggaattgagttgggctccaactatcctctccccgtagttgagctagaagcagccaaagccaggctgcaagaagccctgtcagaaatgtggcagctggaggccgcatcaagggccacaatgaacaatggaatggaggaaggcctcggcgactcctcggaggttccgccgattgagtttcctcaagaattacagatggaagtcgatcggccgccagcccaggcaacggccaatgtgccgataactgctcggaggcgtgaggatcagatggtgcctaccatgacgtcttcactgaacagagctgaaacagaggtttctgccgacctggggaatagtgaggacactagagcacaggttccgtttcattcacatttcgaacctcgagttgagagggaagatgcaatccaaaatgcagaaggccctgctcctagaatcaatggagttcaccagcacaacatctttcagcaacctcagcatcgtaggcgagaagctgttgcgccatccgtgtcggaggcttcgagtagctggaccgggagagaaggcgctgtagtcccagtttggtcacctcctgcagcatcaggccattcagaaacttttgctgctgatgaagctgacgtttctagtaggagttatttggataggcatccccagtcgcaccggttgatgaactggagtcagctatcccagtcactgtgagttcggatgcaccgtaacccattgttctcagacaacaggctgggaagtggaaaattccgtgcagccaaatttaatcggttagggttttctaaagatgggattcatatgtaaattttccagtctgttgctcatctatagtctggtgggcatgcaaaccaggctgctcgttcctgtatgtgataatagtcgtgtaaatctaatccgctagaacttgtgtgatcgacatagggtgcttaaaaaaagtcactattattgatcagacaatgaatgttttctgtaattttgacccttttttggaggtgtgctatgcatgtaaatgtacattcccttgtgtctgttgaccattagcgatctttggttactatcaaaaaaaaaaaaaaaaaaaa

SEQ ID NO: 1518 - protein, 697 aa, Panicum virgatum
  misc_feature: Ceres CLONE ID no.1784494
  misc_feature: Bit score of 1711.3 for HMM based on sequences of FIGURE 18.
  misc_feature (15)..(188): Pfam Name: DNA_photolyase Pfam Description: DNA photolyase
  misc_feature (219)..(497): Pfam Name: FAD_binding_7 Pfam Description: FAD binding domain of DNA photolyase
  misc_feature (219)..(497): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSVSSPSMCGGGETGRIVVWFRRDLRVEDNPALAAAARAGGEVVPAYVWSPEEDGPYHPGRVSRWWISQSLQHLDASLRRLGAGKLVTRRSADAVVALLQLVRDTGATHVYFNHLYDPISLVRDHRLKEMLTAEGIVVRSFNADLLYEPWEVVDDEGQPFTMFAPFWNRCLSMSYDPPAPLLPPKKINSGNLSMCPSDDLIFEDESERGSNALLARAWTPGWQNADKALTAFLNGPLADYSVNRKKADSASTSLLSPHLHFGELSVRKVFHLVRMKQLVWSNEGNHAAEESCTLFLSSIGLREYSRYLSFNHPSSHERPLLAHLRFFPWVVNECYFKIWRQGRTGYPLVDAGMRELWATGWLHDRIRVVVSSFFVKVLQLPWRWGMKYFWDTLLDADLESDALGWQYITGSLPDGRELDRIDNPQFEGYKFDPHGEYVRRWIPELARLPTEWIHHPWDAPVSVLQAAGIELGSNYPLPVVELEAAKARLQEALSEMWQLEAASRATMNNGMEEGLGDSSEVPPIEFPQELQMEVDRPPAQATANVPITARRREDQMVPTMTSSLNRAETEVSADLGNSEDTRAQVPFHSHFEPRVEREDAIQNAEGPAPRINGVHQHNIFQQPQHRRREAVAPSVSEASSSWTGREGAVVPVWSPPAASGHSETFAADEADVSSRSYLDRHPQSHRLMNWSQLSQSL

SEQ ID NO: 1519 - protein, 712 aa, Hordeum vulgare subsp. vulgare
  misc_feature: Public GI ID no.77963980
  misc_feature: Bit score of 1721.1 for HMM based on sequences of FIGURE 18.
  misc_feature (16)..(188): Pfam Name: DNA_photolyase Pfam Description: DNA photolyase
  misc_feature (219)..(497): Pfam Name: FAD_binding_7 Pfam Description: FAD binding domain of DNA photolyase
  misc_feature (219)..(497): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSVSSSSMCGGDAGMKCVVWFRRDLRVEDNPALAAAARTAGEVVPAYVWSPEEDGPYFPGRVSRWWLSQSLKHLEASLHRLGAGKLVTRRSADSVAALLQLVRDTGATHLFFNHLYDPISLVRDHRLKEMLTSEGIVVQSFNADLLYDPWEVNDDDGQPFNMFMPFWNRCLSMPYDPPAPLLPPKRINSGDLSMCPSDDLIFEDESERGSNALLARAWSPGWQNADKALSAFLNGPLIDYSVNRKKADSANTSLLSPYLHFGELSVRKVFHLVRMKQLVWSNEGNHAAEESCTLFLRSVGLREYSRYLCFNHPCSHEKPLLAHLRFFPWVVDESTFKFWRQGRTGYPLVDAGMRELWATGWLHDRIRVVVSSFFVKVLQLPWRWGMKYFWDTLLDADLESDALGWQYISGSLPDSRELDHIDNPQLEGYKFDPHGEYVRRWLPELARLPTEWIHHPWDAPASVLQAAGVELGSNYPLPIVELDTAQVRLQEALSEMWQLEAASRAAMDTGMEEGLGDSSEVPPIEFPQDLQMEVHWEPARVAPNVLTTAQRRQDQMVPTMTTSLNRVETEISADLGNSVDSRAEVPFRMHFEPRTEREEIIQSTGNAVGTNGIHHHNNFQQPQHRMRNIFAPSVSEASSSWTGRDGGVVPVWSPPAASGHSETYGADEADVSSRSYLDRHPQSHRIMNWHQLSQSLTTGRDVENSVQPNYIG

SEQ ID NO: 1520 - protein, 679 aa, Medicago truncatula
  misc_feature: Public GI ID no.124361190
  misc_feature: Bit score of 1668.4 for HMM based on sequences of FIGURE 18.
  misc_feature (209)..(487): Pfam Name: FAD_binding_7 Pfam Description: FAD binding domain of DNA photolyase
  misc_feature (209)..(487): Pfam Name: FAD_binding_7 Pfam Description: FAD binding domain of DNA photolyase
  misc_feature (7)..(178): Pfam Name: DNA_photolyase Pfam Description: DNA photolyase
  misc_feature: Functional Homolog Of Ceres SEEDLINE ID no. ME19738 at SEQ ID NO. 1497
MSSSGGGCSIVWFRRDLRVEDNPALAAGVRAGAVVGVFIWAPEEEGQYYPGRVSRWWLKNSLAHLDSSLRNLGTPLVTKRSTDSVSSLLEVVKSTGATQIFFNHLYDPLSLVRDHRAKEILTAQGITVRSFNSDLLYEPWDVNDENGQPFTTFDSFWERCLSMPYDPQAPLLPPKRIIPGDVSKCPSDTLVFEDDLEKASNALLARAWSPGWSNANKALTTFINGPLIEYSKNRRKADSATTSFLSPHLHFGEVSVKKVFHLVRIKQVFWANEGNEAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKCDPNGEYVRRWLPELARLPTEWIHHPWNAPESVLQAAGIELGSNYPLPIVEIDAATVRLEEALIQMWQLEAASRAAAENGTEEGLGDSAESTPIAFPQDIQMEERHEPIRNNAPHGTRRYQDQMVPSMTSSRVRVEEEETSSVRNSAGDSRAEVPTNANAREAMNQGALQNGNRNTRQRHNPTTTFWLRNAAEDSTAESSSSTRRERDGGVVPEWSPQASNFSDQYVDDENGIGATSPYLQRHPQSHQLMSWTRLPQTG

SEQ ID NO: 1521 - protein, 682 aa, Pisum sativum
  misc_feature: Public GI ID no.37725007
  misc_feature: Bit score of 1660.5 for HMM based on sequences of FIGURE 18.
  misc_feature (207)..(485): Pfam Name: FAD_binding_7 Pfam Description: FAD binding domain of DNA photolyase
  misc_feature (207)..(485): Pfam Name: FAD_binding_7 Pfam Description: FAD binding domain of DNA photolyase
  misc_feature (5)..(176): Pfam Name: DNA_photolyase Pfam Description: DNA photolyase
  misc_feature: Functional Homolog Of Ceres SEEDLINE ID no. ME19738 at SEQ ID NO. 1497
MSSGGCSIVWFRRDLRVEDNPALAAGVRAGAVVGVFIWAPEEEGQYYPGRVSRWWLKNSLSQLDSSLRNLGTPLVTKRSTDSISSLLEVVKSTGATQIFFNHLYDPLSLVRDHRAKEILTAQGITVRSYNSDLLYEPWDVNDEHGQPFTTFDSFWERCLSMPYDPQAPLLPPKRIIPGDVSRCPSDTLVFEDELEKSSNALLARAWSPGWSNANKALTTFINGPLIEYSVNRRKADSATTSFLSPHLHFGEVSVKKVFHLVRIKQVFWANEGNKAGEESVNLFLKSIGLREYSRYISFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKCDPNGEYVRRWLPELARLPTEWIHHPWNAPESVLQAAGIELGSNYPLPIVEIDAATVRLEEALIQMWQLEAASRTAAENGTEEGLGDSTESAPIAFPQDIQMEERHEPVRNNPPHGTRRYQDQMVPSMTYSRVRVEDEETSSVRNSAGDSRAEVPTNANTQQNGREPMDQGMLQNVNRNTRQRRNNTTTTFWLRNAAEDSTAESSSSTRRERDGGVVPEWSPQASNFSDQFVDDENGIGATSPYLQRHPQTHQMMSWTRLPQTG

SEQ ID NO: 1522 - protein, 682 aa, Pisum sativum
  misc_feature: Public GI ID no.45935258
  misc_feature: Bit score of 1655.5 for HMM based on sequences of FIGURE 18.
  misc_feature (207)..(485): Pfam Name: FAD_binding_7 Pfam Description: FAD binding domain of DNA photolyase
  misc_feature (207)..(485): Pfam Name: FAD_binding_7 Pfam Description: FAD binding domain of DNA photolyase
  misc_feature (5)..(176): Pfam Name: DNA_photolyase Pfam Description: DNA photolyase
  misc_feature: Functional Homolog Of Ceres SEEDLINE ID no. ME19738 at SEQ ID NO. 1497
MSSGGCSIVWFRRDLRVEDNPALAAGVRAGAVVGVFIWAPEEEGQYYPGRVSRWWLKNSLSQLDSSLRNLGTPLVTKRSTDSISSLLEVVKSTGATQIFFNHLYDPLSLVRDHRAKEILTAQGITVRSYNSDLLYEPWDVNDEHGQPFTTFDSFWERCLSMPYDPQAPLLPPKRIIPGDVSRCPSDTLVFEDELEKSSNALLARAWSPGWSNANKALTTFINGPLIEYSVNRRKADSATTSFLSPHLHFEEVSVKKVFHLVRIKQVFWANEGNKAGEESVNLFLKSIGLREYSRYISFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKCDPNGEYVRRWLPELARLPTEWIHHPWNAPESVLQAAGIELGSNYPLPIVEIDAATVRLEEALIQMWQLEAASRTAAENGTEEGLGDSTESAPIAFPQDIQMEERHEPVRNNPPHGTRRYQDQMVPSMTYSRVRVEDEETSSVRNSAGDSRAEVPTNANTQQNGREPMDQGMLQNVNRNTRQRRNNTTTTFWLRNAAEDSTAESSSSTRRERDGGVVPEWSPQASNFSDQFVDDENGIGATSPYLQRHPQTHQMMSWTRLPQTG

SEQ ID NO: 1523 - protein, 583 aa, Solanum lycopersicum
  misc_feature: Public GI ID no.15559008
  misc_feature: Bit score of 1281.3 for HMM based on sequences of FIGURE 18.
  misc_feature (207)..(485): Pfam Name: FAD_binding_7 Pfam Description: FAD binding domain of DNA photolyase
  misc_feature (207)..(485): Pfam Name: FAD_binding_7 Pfam Description: FAD binding domain of DNA photolyase
  misc_feature (5)..(176): Pfam Name: DNA_photolyase Pfam Description: DNA photolyase
  misc_feature: Functional Homolog Of Ceres SEEDLINE ID no. ME19738 at SEQ ID NO. 1497
MSSGGCSIVWFRRDLRLEDNPALAAAVRAGSVIAVFIWAPEEEGYYCPGRVSRWWIKKSLAHLDSSLKKLGTSLITKRSNDSVSSLLQVVKSTGATRVFFNHLYDPISLVRDNCAKETLSAEGVSVCSFNADLLYEPWEVVDDESRPFSTFSDFWEKCLTMPYDPEAPLLPPKRIISGDASRCPSDNLVFESELEKGSNALLARAWSPGWSNADKALTTFINGPLIEYSKNRSKADSATTSFLSPCLHFGEVSVRKVFHRIRTKQTLWANEGNKAGEESVNLFLKSIGLREFSRYMSFYHPYSHERPLLGQLKYFPWLVDEGYFKAWRQGRTGYPLVDAGMRELWATGWLHDRIRVVVSSFSVKVLQLPWTWGMKYFWDTLLDADLESDALGWQFITGTLPDGCEFLGIDNPQFEGYKFDPNGEYVRRWLPELARLPTEWIHHPWDAPESVLQAAGIELGSNYPFPIVEIVAAKERLEEALSQMWQLEAAARSAIENGMEEGHGDSTDEFVPIAFPQAMQIEMEANNVPVRNNNPTITALRRYGDQIVPSMSSSFFRNEDEETSVDIRNSVVDSRAEVPIISM

SEQ ID NO: 1524 - protein, 679 aa, Orobanche minor
  misc_feature: Public GI ID no.38037416
  misc_feature: Bit score of 1594.9 for HMM based on sequences of FIGURE 18.
  misc_feature (209)..(487): Pfam Name: FAD_binding_7 Pfam Description: FAD binding domain of DNA photolyase
  misc_feature (209)..(487): Pfam Name: FAD_binding_7 Pfam Description: FAD binding domain of DNA photolyase
  misc_feature (7)..(178): Pfam Name: DNA_photolyase Pfam Description: DNA photolyase
  misc_feature: Functional Homolog Of Ceres SEEDLINE ID no. ME19738 at SEQ ID NO. 1497
MGTSGGGCSIVWFRRDLRVEDNPALAAGVRAGAVLPLFIWAPEEEGHYYPGRVSRWWLKQSLSHLDISLRSLGTSLVTRRSTDSVSSLLEVIKLTGAKQIFFNHLYDPISLVRDHRAKEVLTAEGVAVRSFNADLLYEPWEVHDQEGQPFTTFAGFWERCLSMPYDPEAPLLPPKRIISGDLSRCTSDTLVFEDESEKGSNALLARAWSPGWSNADKALTVFTNGPLLEYSKNRRKADSATTSFLSPHLHFGEVSVRKIFHLARIKQVLWANEGNKAGEESINLFLKSIGLREYSRYMSFNHPYSHERPLLGHLKYFPWVIDEGYFKAWRQGRTGYPLVDAGMRELWATGWLHDRIRVVVSSFFVKVLQLPWRWGMKYFWDTLLDADLESDALGWQYISGSLPDGCELDRIDNPQFDGYKCDPNGEYVRRWLPELARLPTEWIHHPWNTPESVLQAAGIELGSNYPLPIVGIDTAKARLQEALSQMWQHETASRAAIENGVEEGLGESSEFTPIAFPPNTQIDMDNEPVRNNPINAITRRYEDQMVPTMTSSLIRVVDEETSIGLDISDNDGRAEVPSNIVNFMEEPRGGPHDDNGVIVDGNDNNGFLQYEFLRGRRHSEDSTAESSSSGRRERDGGVVPVWSPSNSTYPNQFPGEDSGIGTSSSFLPRHPQSASLTSW

SEQ ID NO: 1525 - protein, 694 aa, Hordeum vulgare subsp. vulgare
  misc_feature: Public GI ID no.77963974
  misc_feature: Bit score of 1570.0 for HMM based on sequences of FIGURE 18.
  misc_feature (16)..(189): Pfam Name: DNA_photolyase Pfam Description: DNA photolyase
  misc_feature (219)..(497): Pfam Name: FAD_binding_7 Pfam Description: FAD binding domain of DNA photolyase
  misc_feature (219)..(497): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSASLSMSGGAGEAATRTVVWFRRDLRVEDNPALAAAARTAGEVVPAYVWAPEEDGPYYPGRVSRWWLSQSLKHLDASLRRLGASRLVTRRSTDTVAALLELVRSTGATHLFFNHLYDPLSLVRDHRVKQVLAAEGISVQSFNSDLLYEPWEVLDDHGSPFTMFTSFWNKCLCMVDPPAPMLPPKRINSGDLTRCSSDDLIFEDDSERGSNALLARAWSPGWQNADKAFTAFINGPLIDYSVNRKKADSANTSLLSPYLHFGELSVRKVFHQVRMKQLTWSNESNRDGEEGCSLFLRSIGLREYSRYLAFNHPCSHEKPLLAHLRFFPWVVNEVYFKVWRQGRTGYPLVDAGMRELWATGWLHDRIRVVVSSFFVKVLQLPWRWGMKYFWDTLLDADLESDALGWQYISGSLPDGRELDRIDNPQFEGYKFDPYGEYVRRWLPELARLPTEWIHHPWDAPESVLQAAGIELGSNYPLPIVELDEAKSRLQDALSEMWELEAASRAEIENGMEEGLGDSSDEPPIAFPQELQHMEVDRATSHTPATAGPARRRADQMVPSITSSLVRAETETELSAVFESEVSRPEVPSQVHFQAQPRMESREQVASDGTAARYNQQYTLHRVQGGGIAPSTSEASSSWTGREGGVVPVWSPPAASGHSDPYAADETDISSRSYLDRNPQSHNRLMNWNQLSQSS

SEQ ID NO: 1526 - DNA, 2085 bp, Sorghum bicolor
  misc_feature: Ceres ANNOT ID no.6112581
  misc_feature: Encodes the peptide sequence at SEQ ID NO. 1527
atgtcggcctcgtcctcgtccctgtgcggcggggacccggcgatgaggagcgtggtgtggttccggagggacctcagggtggaggacaacccggcgcttgcggcggcggcgcgtgccggtggggaggtagtgccggcgtacgtctggtcgccagaggaagagggcccttattaccccgggcgtgtgtcccggtggtggatcagccagagtctgaagcacctggacgcctcgctccgccgcctaggtgcaggaaagctcgtcacgcggaggtcggccgacgccgtcgttgcgctcctccagctggtccgcgacaccggcgccacgcacgtctacttcaatcatctatacgacccgatctcactagtcagggatcaccggttgaaggagatgctggcggctgagggcatcgttgtgcaatctttcaatgcggatctgctgtatgagccatgggaagttgtcgatgatgaagggcaaccattcaccatgttcactgcattctggaacaggtgcctcagcatgcagtatgatccccctgcaccacttctgcccccgaagaagatcaattcaggtgacttatcgatgtgtccatcggaagatctgatctttgaggatgattcagagaggggaagcaacgctcttctggcccgagcatggacaccagggtggcagaacgcagacaaggcactgacagccttcctcaatggtccattggctgactactcagtgaaccgtaagaaggctgatagtgcgagcacatccctactctcacctcacctgcatttcggtgagcttagtgtgcgcaaggttttccacctagttcgtatgaagcagcttgtgtggagtaacgagggcaaccacgctgctgaggagagctgcaccttgtttctccgttccattggcctgcgggagtactctcggtacctgagcttcaatcacccaagcagccatgagaggcccctcttggcgcatctcaggtttttcccctgggtggtcaatgagagctactttaagatttggaggcagggaaggactgggtacccgctcgttgatgctggcatgagggaactgtgggcgacaggatggttgcatgaccggatacgtgtggtggtttcaagcttctttgtcaaggtccttcaacttccatggcgatggggtatgaagtacttctgggacacattactggatgctgatcttgaaagcgatgcactgggctggcagtacatcactggctctcttcctgatagtcgagagcttgaccgcatcgacaatccgcagtttgaaggctacaagttcgacccgcatggggagtatgtccgacggtggattcctgagctcgtaaggctgccgacagaatggatacatcatccatgggatgcacctgtttccgtgctgcaagctgcaggaattgagctgggatccaactatcccctccccatagttgagctagacgcggccaaagccagactgcaagaagccctatcagaaatgtggcagctggaggcagcatcaagggccaccatgaacaatggaatggaggaaggcctcggtgattcctcagaggttccatttcctgaagaattacagatggaagtcgatcggcagcgagcccaggcaacagccaatgtggtgatgactgttcggaggcgtgaggatcagatggtgcctaccatgacctcttcattgaacagagctgaaacagaggtttccgccgatctagggaacagtgaggacactagggcacaggttccgtttcatgcacatttccatccccgagttgagagggaagacatgatccagaatactgaaggccctgcacttagaatcaatggcactcaccaacacaacatctttcagcaacctcagaatcataggcgagaagctcttgctccatcagtgtcggaggcttcaagtagctggaccggcagagagggcgctgtggtcccagtttggtcacctcctgcagcatcaggccattcagaaacttttgctgctgatgaagctgacgtttctagtaggagttatttggataggcatccacagtcgcaccggttgatgaactggagtcaattatcacagtcattgtga

SEQ ID NO: 1527 - protein, 694 aa, Sorghum bicolor
  misc_feature: Ceres ANNOT ID no.6112581
  misc_feature: Bit score of 1688.0 for HMM based on sequences of FIGURE 18.
  misc_feature (15)..(188): Pfam Name: DNA_photolyase Pfam Description: DNA photolyase
  misc_feature (219)..(497): Pfam Name: FAD_binding_7 Pfam Description: FAD binding domain of DNA photolyase
  misc_feature (219)..(497): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSASSSSLCGGDPAMRSVVWFRRDLRVEDNPALAAAARAGGEVVPAYVWSPEEEGPYYPGRVSRWWISQSLKHLDASLRRLGAGKLVTRRSADAVVALLQLVRDTGATHVYFNHLYDPISLVRDHRLKEMLAAEGIVVQSFNADLLYEPWEVVDDEGQPFTMFTAFWNRCLSMQYDPPAPLLPPKKINSGDLSMCPSEDLIFEDDSERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVNESYFKIWRQGRTGYPLVDAGMRELWATGWLHDRIRVVVSSFFVKVLQLPWRWGMKYFWDTLLDADLESDALGWQYITGSLPDSRELDRIDNPQFEGYKFDPHGEYVRRWIPELVRLPTEWIHHPWDAPVSVLQAAGIELGSNYPLPIVELDAAKARLQEALSEMWQLEAASRATMNNGMEEGLGDSSEVPFPEELQMEVDRQRAQATANVVMTVRRREDQMVPTMTSSLNRAETEVSADLGNSEDTRAQVPFHAHFHPRVEREDMIQNTEGPALRINGTHQHNIFQQPQNHRREALAPSVSEASSSWTGREGAVVPVWSPPAASGHSETFAADEADVSSRSYLDRHPQSHRLMNWSQLSQSL

SEQ ID NO: 1528 - protein, 690 aa, Sorghum bicolor
  misc_feature: Public GI ID no.56553448
  misc_feature: Bit score of 1670.4 for HMM based on sequences of FIGURE 18.
  misc_feature (15)..(188): Pfam Name: DNA_photolyase Pfam Description: DNA photolyase
  misc_feature (219)..(497): Pfam Name: FAD_binding_7 Pfam Description: FAD binding domain of DNA photolyase
  misc_feature (219)..(497): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSASSSSLCGGDPAMRSVVWFRRDLRVEDNPALAAAARAGGEVVPAYVWSPEEEGPYYPGRVSRWWISQSLKRLDASLRRLGAGKLVTRRSADAVVALLQLVRDTGATHVYFNHLYDPISLVRDHRLKEMLAAEGIVVQSFNADLLYEPWEVVDDEGQPFTMFTAFWNRCLSMQYDPPAPLLPPKKINSGDLSMCPSEDLIFEDDSERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVNESYFKIWRQGRTGYPLVDAGMRELWATGWLHDRIRVVVSSFFVKVLQLPWRWGMKYFWDTLLDADLESDALGWQYITGSLPDSRELDRIDNPQFEGYKFDPHGEYVRRWIPELVRLPTEWIHHPWDAPVSVLQAAGIELGSNYPLPIVELDAAKARLQEALSEMWQLEAASRATMNNGMEEGLGDSSEVPFPEELQMEVDRATANVVMTVRRREDQMVPTMTSSLNRAETEVSADLGNSEDTRAQVPFHAHFHPRVEREDMIQNTEGPALRINGTHQHNIFQQPQNHRREALAPSVSEASSSWTGREGAVVPVWSPPAASGHSETFAADEADVSSRSYLDRHPRSYRLMNWSQLSQSL

SEQ ID NO: 1529 - protein, 691 aa, Sorghum bicolor
  misc_feature: Public GI ID no.23506659
  misc_feature: Bit score of 1670.8 for HMM based on sequences of FIGURE 18.
  misc_feature (16)..(189): Pfam Name: DNA_photolyase Pfam Description: DNA photolyase
  misc_feature (220)..(498): Pfam Name: FAD_binding_7 Pfam Description: FAD binding domain of DNA photolyase
  misc_feature (220)..(498): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSAVSSSSLCGGDPAMRSVVWFRRDLRVEDNPALAAAARAGGEVVPAYVWSPEEEGPYYPGRVSRWWISQSLKHLDASLRRLGAGKLVTRRSADAVVALLQLVRDTGATHVYFNHLYDPISLVRDHRLKEMLAAEGIVVQSFNADLLYEPWEVVDDERQPFTMFTAFWNRCLSMQYDPPAPLLPPKKINSGDLSMCPSEDLIFEDDSERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVNESYFKIWRQGRTGYPLVDAGMRELWATGWLHDRIRVVVSSFFVKVLQLPWRWGMKYFWDTLLDADLESDALGWQYITGSLPDSRELDRIDNPQFEGYKFDPHGEYVRRWIPELVRLPTEWIHHPWDAPVSVLQAAGIELGSNYPLPIVELDAAKARLQEALSEMWQLEAASRATMNNGMEEGLGDSSEVPFPEELQMEVDRATANVVMTVRRREDQMVPTMTSSLNRAETEVSADLGNSEDTRAQVPFHAHFHPRVEREDMIQNTEGPALRINGTHQHNIFQQPQNHRREALAPSVSEASSSWTGREGAVVPVWSPPAASGHSETFAADEADVSSRSYLDRHPQSHRLMNWSQLSQSL

SEQ ID NO: 1530 - DNA, 2124 bp, Sorghum bicolor
  misc_feature: Ceres ANNOT ID no.6118060
  misc_feature: Encodes the peptide sequence at SEQ ID NO. 1531
atgtcagcatcgcagtcctcgatgagcggcgccgccggggagccggggatgcggacggtggtctggttcaggcgagacctgcgcgtggaggacaacccggcgctggcggcagccgctcggacggccggagaggtcgtgccggcgtacgtgtgggcgcccgaggaggacgggccctactaccccggcagggtgtcccggtggtggctcagccaaagcctcaagcacctggacgcctcgctccgccggctcggcgccggccgcctcgtcacccgccgctccaacgacgctgtcgtcgcgctgctcgacctcgtccgcagcaccggcgccacccacctctttttcaaccacctctacgacccgctgtcgctggtccgggaccaccgcgtgaaggagcagctgacggccgagggcatcactgtgcagtccttcaacgcggatctgctgtacgagccgtgggaggtcctcgacgacgacggctgccccttcaccatgttcgcgccattctggaacaggtgcctgtgcatgccggaccccgccgcaccactgctgccgcccaagaggatcaattcaggtgacctgtcgaggtgtccgtgggacgagctgatctttgaagacgagtccgagaggggcagcaacgcgctgcttgcgcgggcgtggtcaccagggtggcagaatgctgacaaggcactgacggccttcctcaatggtccgctgatggactactccgtgaaccgcaagaaggccgacagtgccagcacgtccctgttgtctccgtacctgcacttcggcgagctcagcgtccgcaaggtcttccaccaggtccggatgaagcagctgatgtggagcaacgacggtaaccacgctggcgaggagagctgcaccctgttcctgcgctccatcggcctgcgggagtactcgaggtacctcaccttcaaccacccctgcagccacgagaagccccttctgtcgcacctcaggttcttcccctgggtcgtcaatgaggtgtacttcaaggtttggagacaagggaggactggctaccctctcgtcgacgctggcatgagggagctctgggccaccgggtgggtccatgaccggatacgtgtcgtcgtctctagcttctttgtcaaggtactccagctgccatggcgctgggggatgaagtacttctgggacaccttgctggatgctgaccttgagagtgatgcactaggctggcagtacatttctgggtctctccctgatggccgtgagcttgaccgcatcgacaaccctcagtttgaagggtacaagtttgatccgcacggggagtacgtacggcgatggctaccggagttggcgaggctgccaacagaatggatacaccacccctgggatgcacctgagtctgtgcttcaggctgcaggagttgagctaggctccaactatccacgccccattgttgagttagatgctgccaattccaggttgcaggatgccctgtcagagatgtgggagcttgaggcagcctctcgtgctgcgatggagaatggaatggaagaaggccttggcgattccacagatgagccgctgatcgacttccctcaggaattacggatggaagtggaccgacaaccggctcaacctgctatccacacaccggcagtggctggtcggagacgagaagatcagatggtgcctagcatgacttcctcattcattagagctgaaaccgaactcactgcagattttggcaacaccagtgaggacagtaggccagaagtcccgtcaaacattcatttgcaggctcgggcggagagggaagaaacagttgacggtggcactggcaatactgtcaggatgaatggcaaccatcagcagcagaatcttcagaacaacatgcaccgtgtgctaggtattgctccatcagtttcagaggcatcgagcagctggacgggcagggaaggtggagtggtaccggtctggtcacctccggcagcttcgggacattctgatccttatgctgccgatgaggctgacatttccagtaggagttatttggacaggcatccacaatcacatacgatgatgaactggagtcaactctctcagtcattgacaacagggtgggaagtggataattag

SEQ ID NO: 1531 - protein, 707 aa, Sorghum bicolor
  misc_feature: Ceres ANNOT ID no.6118060
  misc_feature: Bit score of 1643.4 for HMM based on sequences of FIGURE 18.
  misc_feature (17)..(189): Pfam Name: DNA_photolyase Pfam Description: DNA photolyase
  misc_feature (220)..(498): Pfam Name: FAD_binding_7 Pfam Description: FAD binding domain of DNA photolyase
  misc_feature (220)..(498): Pfam Name: FAD_binding_7 Pfam Description: FAD binding domain of DNA photolyase
  misc_feature: Functional Homolog Of Ceres SEEDLINE ID no. ME19738 at SEQ ID NO. 1497
MSASQSSMSGAAGEPGMRTVVWFRRDLRVEDNPALAAAARTAGEVVPAYVWAPEEDGPYYPGRVSRWWLSQSLKHLDASLRRLGAGRLVTRRSNDAVVALLDLVRSTGATHLFFNHLYDPLSLVRDHRVKEQLTAEGITVQSFNADLLYEPWEVLDDDGCPFTMFAPFWNRCLCMPDPAAPLLPPKRINSGDLSRCPWDELIFEDESERGSNALLARAWSPGWQNADKALTAFLNGPLMDYSVNRKKADSASTSLLSPYLHFGELSVRKVFHQVRMKQLMWSNDGNHAGEESCTLFLRSIGLREYSRYLTFNHPCSHEKPLLSHLRFFPWVVNEVYFKVWRQGRTGYPLVDAGMRELWATGWVHDRIRVVVSSFFVKVLQLPWRWGMKYFWDTLLDADLESDALGWQYISGSLPDGRELDRIDNPQFEGYKFDPHGEYVRRWLPELARLPTEWIHHPWDAPESVLQAAGVELGSNYPRPIVELDAANSRLQDALSEMWELEAASRAAMENGMEEGLGDSTDEPLIDFPQELRMEVDRQPAQPAIHTPAVAGRRREDQMVPSMTSSFIRAETELTADFGNTSEDSRPEVPSNIHLQARAEREETVDGGTGNTVRMNGNHQQQNLQNNMHRVLGIAPSVSEASSSWTGREGGVVPVWSPPAASGHSDPYAADEADISSRSYLDRHPQSHTMMNWSQLSQSLTTGWEVDN

SEQ ID NO: 1532 - protein, 471 aa, Parachlamydia sp. UWE25
  misc_feature: Public GI ID no.46446306
  misc_feature: Bit score of 164.4 for HMM based on sequences of FIGURE 18.
  misc_feature (204)..(471): Pfam Name: FAD_binding_7 Pfam Description: FAD binding domain of DNA photolyase
  misc_feature (3)..(175): Pfam Name: DNA_photolyase Pfam Description: DNA photolyase
  misc_feature: Functional Homolog Of Ceres SEEDLINE ID no. ME19738 at SEQ ID NO. 1497
MTNPSIVWFRQDFRLEDNPALNAATQKGGPVIPVFNWVFNPEKEWQLGGASQWWLYYSLISLKNDLSELGLSLIIRKEDPLKSLLEIAHETGADTVYWNRRYEPMLIQDDAKIKTELQKQGIKAHSFNGNLLFEPWTIANKQGKPFQVFTPFWNQCLKLNDPEVPLPVPHSLKKFVGQLQTESIDSLNLLPKIKWDKGLKEVWSPGAKSAKALLKKGLTGVIDQYLDIRDLPDHDGTSLLSPYLHFGEISPRMIWQAVKENSTSKGAEGYLRQIGWREFAHHLLYHFPETPQKPLRSQFNSFSWKNDKQNLKAWQKGQTGYPIIDAGMRQLWKIGWMHNRVRLIVGSFLVKDLMIHWIEGAKWFWDTLVDADLANNTMGWQWIAGCGADAAPYFRIFNPITQGEKFDPEGNYVKKWVPELINLPKEWLHQPWEAPEEILRQSGIELGINYPKPIVNHAKAREEALQAYSRL

SEQ ID NO: 1533 - protein, 479 aa, Alkalilimnicola ehrlichei MLHE-1
  misc_feature: Public GI ID no.114321405
  misc_feature: Bit score of 103.9 for HMM based on sequences of FIGURE 18.
  misc_feature (204)..(478): Pfam Name: FAD_binding_7 Pfam Description: FAD binding domain of DNA photolyase
  misc_feature (3)..(169): Pfam Name: DNA_photolyase Pfam Description: DNA photolyase
  misc_feature: Functional Homolog Of Ceres SEEDLINE ID no. ME19738 at SEQ ID NO. 1497
MGDATLVWLRRDLRLTDNPALDQAARRGGPVIAVYLHAPEETPQYPPGAASHWYLHHSLKALGPALAQAGIPLVLRRGPALATLRALIRATGAGAVYWNRLYEPDAVARDRTVKQALRTEGLDCRSFPTALLHEPWAVRNQADRPYRAFTPFWRACRRQPPPAAPLPAPDLRDRPVPAVEGLDLAALGLLPRTPWDTGLRNTWQAGESAALARLEAFAADRLARYAQDRDRPAEPGTSGLSPALHFGELSPRQVWWQVMAAREAGVPEDACETFLSELGWREFAHHLLWSHPDLGDAPVDDRFGAFPWRPDPGDGWLHAWQAGRTGIPLVDAGMHELWQTGWMHNRVRMVTGSFLVKHLRLPWQRGERWFRDTLVDWDAASNAMGWQWVAGCGADAAPYFRIFNPVRQGERFDPQGRYVRRWLPALANLPDKYIHAPWTAPEAVLRRAGVTLGSDYPCPLIDLRLGREQALSAFQAIKG

SEQ ID NO: 1534 - protein, 480 aa, Oceanicaulis alexandrii HTCC2633
  misc_feature: Public GI ID no.83858274
  misc_feature: Bit score of 106.6 for HMM based on sequences of FIGURE 18.
  misc_feature (207)..(477): Pfam Name: FAD_binding_7 Pfam Description: FAD binding domain of DNA photolyase
  misc_feature (207)..(477): Pfam Name: FAD_binding_7 Pfam Description: FAD binding domain of DNA photolyase
  misc_feature (6)..(176): Pfam Name: DNA_photolyase Pfam Description: DNA photolyase
  misc_feature: Functional Homolog Of Ceres SEEDLINE ID no. ME19738 at SEQ ID NO. 1497
MADPNPPVIVWFRQDLRLADNPALQAAAATGAPVIPVYILDDDAPGDWRPGGASRWWLHHSLASLASDLQQLGGELALMKGEAQEQLDALIEQTGADTVFWNRLYEPWARKRDEAIKSSLKDRGVRARSFNGSLIVEPWDIATKTGNPYKVFTPFWKSLKADHTPAEPTGRPDALQLHAHEGGLSLDDLDLLPTKPDWSGGLQENWTPGEAAAHGRLGQFLKAAVSDYSDRRDLPGQSGTSRLSPHLHFGEISPRQVWHAVKQSDHARTGGADTYLSEIAWREFSYNLLYHFPDLPEANFQSKFDAFEWDECEDKLKAWQKGQTGYPIVDAGMRELWATGWMHNRVRMIVASFLIKDLFIHWRRGEDWFWDTLVDADLASNAASWQWTAGSGADAAPYFRVFNPVGQSEKFDPKGDYLRKWIPELADLPDKVIHAPWTAEKSVLSRAGVTLGETYPEPIVDHGEARKRALAAFEKIKDAG

SEQ ID NO: 1535 - protein, 475 aa, Parvibaculum lavamentivorans DS-1
  misc_feature: Public GI ID no.154250969
  misc_feature: Bit score of 90.2 for HMM based on sequences of FIGURE 18.
  misc_feature (199)..(472): Pfam Name: FAD_binding_7 Pfam Description: FAD binding domain of DNA photolyase
  misc_feature (4)..(168): Pfam Name: DNA_photolyase Pfam Description: DNA photolyase
  misc_feature: Functional Homolog Of Ceres SEEDLINE ID no. ME19738 at SEQ ID NO. 1497
MSASPAILWFRRDLRLDANPALAAAMARGPVIPLFILDPADRPGAASRWWLHGSLEALGESLARLGAPLILRRGSPSEILPALTAETDARAIFWNRLYEPHLIGRDKALKSALTAQGIEVESFNGSLLAEPWQVRTQSGDPYKVFTPFWRSLAQMPFPAPHPAPKKCAGLSPLPSDDLASWSLRPSKPDWAGGLRATWQPGERAAQSRLAAFIDDAMVGYREARDIPAAEGTSRLSPHLHWGEVSPHRIWSAVEAATAAHPSGAEAGRAFLRELAWRDFAHHLLFHWPDIARENWKSQFDAFPWKEDTAAFTAWTKGETGYPIVDAGMRQLWQTGWMHNRVRMIAASFLVKHLMVDWRRGAEWFENTLVDADLAVNRASWQWVAGSGADAAPYFRIFNPVLQGEKFDGDGAYVRAFVPELAKLDARFIHKPWAAPDAELSKAGIALGRTYPKPLVDHGHARARALAAYEQIRNES

SEQ ID NO: 1536 - protein, 478 aa, Rhodospirillum rubrum ATCC 11170
  misc_feature: Public GI ID no.83594235
  misc_feature: Bit score of 70.9 for HMM based on sequences of FIGURE 18.
  misc_feature (206)..(477): Pfam Name: FAD_binding_7 Pfam Description: FAD binding domain of DNA photolyase
  misc_feature (3)..(173): Pfam Name: DNA_photolyase Pfam Description: DNA photolyase
  misc_feature: Functional Homolog Of Ceres SEEDLINE ID no. ME19738 at SEQ ID NO. 1497
MTIPVLVWFRDDLRLADNPALCAALDSGAPVIPFYLLDDSTSDGHRPLGGATRWWLGRSLTSLAESIAQRGGRLVLRRGEALSAVPELAAETDAAALFANRLYGMDSLRDDDLFMVLRVAGLTVRLFDSGLLHRPEAVTTKTGRPFRVFTPFWKTLSATLDPGLPLAAPDSFPPVDDPPPASDSLADWSLEPTTPDWAGGLRDTWQPGEAGAQARLEAFFNGPVADYASGRDRPDKPLTSKLSPHLRFGEISPRQVWTAARHHPPGGGMDAFLRELGWREFCHHLLFQAPTMAEEPLKAEFLAFPWTEAKEIGPALAAWQSGETGYPIVDAGMRELWHTGWMHNRVRMIAASFLIKDLLIPWQHGERWFWDTLVDACPANNAAGWQWVAGCGADAAPFFRIFNPVTQGERFDPEGAYVRRWLPELADLPSSLIHRPWEAPPLILRQAGVTLGKTYPPPLIDHAHARVRALEALAVVNR

SEQ ID NO: 1537 - DNA, 3344 bp, Arabidopsis thaliana
  misc_feature: Ceres SEEDLINE ID no.ME19971
  misc_feature: Genomic Sequence
  misc_feature: Expected Sequence
  misc_feature: Encodes the peptide sequence at SEQ ID NO. 1540
gtgtctgtctctctctctttctctttgatagaaattctctaatgtaactttccttttgcagcttgagatgatcatgaaacacgtgcatcctcagatctctatcaatccaggttcttcatcttttataatattcattttttctttcaatttctaactctattattttattattttattttcaatcatgattatgtcttaatttccatatccttcaatctctctttctcataatccataattcatcccttcttcttcgtcttcttgatgtgatcacgattctttttttcttcgcttcaactgtatatatatacagatctatattaaacttatagtggttttgtttttgctcctttttcatacttttgtttgtttttctatgatatcaatcagcttggtgaaagaaggtcaagaattgaaagagaatcaaagaaaacgacgtcgtttcattcgtgtgtaacaactactaattatacatagatggctgcttactttcacggaaacccaccggagatctctgccggatccgacggtggtcttcaaacgttgatcctcatgaatccaactacttacgttcagtacacccaacaagacaacgactcgaacaacaacaacaacagcaacaatagcaacaacaacaacacaaacacaaacacaaacaacaacaacagtagtttcgttttcctcgattcccacgcgccgcagccaaacgcgagccagcagttcgtcggaataccactctcaggtcacgaagctgcttccattacagccgccgacaacatctccgtacttcacggttatcctccgcgcgtgcagtacagtctctacggtagccaccaagtggatcccactcaccagcaagccgcgtgtgagacgccacgcgcgcagcaaggcctctctttaaccctctcgtctcaacagcagcagcaacagcaacatcatcaacaacaccagcctattcacgtcggattcgggtccggacatggagaagatatccgggtcgggtctggctctacaggatcgggggtaacaaacggtatagctaatcttgttagctccaagtacttgaaggcagcacaagagcttcttgacgaagtagtcaacgctgattccgatgacatgaacgctaaatcccaactattctcatcgaaaaagggtagttgcggaaatgataaacctgtcggagaatcatcggccggcgctggaggagaaggttccggtggcggagcagaagcagccgggaaacgtccggtggagctaggcacggcagagagacaagaaatacagatgaagaaagcaaaacttagtaacatgcttcatgaggtaacaacaatacgtattatatacaataagcctacatatactgagtgctctcttatatcacacatgaagtggacttaaaagttctgtccctaagattttcagtcattttcacaattcattttatatgtatattaagctatccttttttttttttgctcttccgatttctcaaattgacaacttacaagattgatgaaatctttttttttttgtccctctcttagtaaagactaacaacttttatagattatatttatgtagaccgtacacttatgttcataagactcacgttactttgttggttgaaaaatgaaaaggtggagcagagatatagacagtaccaccagcagatgcagatggtgatctcttcgttcgagcaagcggcagggataggatcagcgaagtcatacacgtcgctagcattgaaaaccatatcaagacagttccgttgcttgaaagaggcgatcgctggtcagataaaagcggccaacaagagtcttggggaggaagattcagtgtctggtgttgggaggtttgaggggtcgaggctcaagttcgtggaccaccacttgagacagcaaagagctcttcaacaactgggaatgattcaacatccttccaataatgcttggagacctcaacgtggtctcccagaacgagccgtctcagttctccgtgcttggctcttcgaacactttcttcatccgtaagtaacccactatacacacatgcactacttttcatcactggaacacaaactcagtctctaagttgtctttcttttaattagataccctaaggattcggacaagcacatgctagctaagcaaacaggactcactcgtagccaggtacgtttcaaaatgattctttcttgtgttattaggttacttaagaaagcgtttttaagtaaatttattttctttaattatttaggtgtcgaactggtttataaacgcgagagttcggttatggaaaccaatggtggaggagatgtacatggaggaaatgaaggagcaggcaaagaacatgggatccatggaaaagactcctttggatcaaagcaacgaagattctgcttcaaagtcaacaagtaaccaagaaaagagcccaatggcggacactaattaccatatgaatcccaatcacaacggtgacctagaaggcgtcactggaatgcaaggaagccccaagagactaagaaccagcgacgagacaatgatgcagccaataaatgcggatttcagctccaacgagaagctcacgatgaagattctagaagaacggcaagggataagatcagatggtggctaccctttcatgggtaatttcgggcaataccaaatggatgagatgtcaagatttgatgtagtctcagaccaggagctcatggcgcaaaggtactcaggaaacaacaatggcgtgtccctcacgttaggtttacctcattgtgatagcttgtcgtccacgcaccatcagggtttcatgcagacccaccatgggattcctatagggagaagagtgaaaataggagaaacagaggaatatggacccgccaccatcaatggtggtagctcgaccacaaccgcacattcatcagcggcagctgccgcggcttacaatgggatgaacatacagaaccagaagagatatgtggctcagttattgcccgacttcgttgcataaacccatctctctagaaggagaaaccgaaacaggttattatatacgtttctagtttttaattagtatatagtttctcataccattgaaccaaaacaaagaacaaaatttaattttagtctttggttatatatggccgacggttgtatatcgattttgtaatttttttttttcgtttctattgggggatggatagggttatatatgtatatggattagttacgtgtaatagcttgcattgggtgtataccaaaatatatttttacttttattacaatgtaataattaataagatagtgaactgatctatcaaatatggaatgatgattacagattagatc

SEQ ID NO: 1538 - DNA, 2043 bp, Arabidopsis thaliana
  misc_feature: Ceres SEEDLINE ID no.ME19971
  misc_feature: Predicted Sequence
  misc_feature: Encodes the peptide sequence at SEQ ID NO. 1540
atggctgcttactttcacggaaacccaccggagatctctgccggatccgacggtggtcttcaaacgttgatcctcatgaatccaactacttacgttcagtacacccaacaagacaacgactcgaacaacaacaacaacagcaacaatagcaacaacaacaacacaaacacaaacacaaacaacaacaacagtagtttcgttttcctcgattcccacgcgccgcagccaaacgcgagccagcagttcgtcggaataccactctcaggtcacgaagctgcttccattacagccgccgacaacatctccgtacttcacggttatcctccgcgcgtgcagtacagtctctacggtagccaccaagtggatcccactcaccagcaagccgcgtgtgagacgccacgcgcgcagcaaggcctctctttaaccctctcgtctcaacagcagcagcaacagcaacatcatcaacaacaccagcctattcacgtcggattcgggtccggacatggagaagatatccgggtcgggtctggctctacaggatcgggggtaacaaacggtatagctaatcttgttagctccaagtacttgaaggcagcacaagagcttcttgacgaagtagtcaacgctgattccgatgacatgaacgctaaatcccaactattctcatcgaaaaagggtagttgcggaaatgataaacctgtcggagaatcatcggccggcgctggaggagaaggttccggtggcggagcagaagcagccgggaaacgtccggtggagctaggcacggcagagagacaagaaatacagatgaagaaagcaaaacttagtaacatgcttcatgaggtggagcagagatatagacagtaccaccagcagatgcagatggtgatctcttcgttcgagcaagcggcagggataggatcagcgaagtcatacacgtcgctagcattgaaaaccatatcaagacagttccgttgcttgaaagaggcgatcgctggtcagataaaagcggccaacaagagtcttggggaggaagattcagtgtctggtgttgggaggtttgaggggtcgaggctcaagttcgtggaccaccacttgagacagcaaagagctcttcaacaactgggaatgattcaacatccttccaataatgcttggagacctcaacgtggtctcccagaacgagccgtctcagttctccgtgcttggctcttcgaacactttcttcatccataccctaaggattcggacaagcacatgctagctaagcaaacaggactcactcgtagccaggtgtcgaactggtttataaacgcgagagttcggttatggaaaccaatggtggaggagatgtacatggaggaaatgaaggagcaggcaaagaacatgggatccatggaaaagactcctttggatcaaagcaacgaagattctgcttcaaagtcaacaagtaaccaagaaaagagcccaatggcggacactaattaccatatgaatcccaatcacaacggtgacctagaaggcgtcactggaatgcaaggaagccccaagagactaagaaccagcgacgagacaatgatgcagccaataaatgcggatttcagctccaacgagaagctcacgatgaagattctagaagaacggcaagggataagatcagatggtggctaccctttcatgggtaatttcgggcaataccaaatggatgagatgtcaagatttgatgtagtctcagaccaggagctcatggcgcaaaggtactcaggaaacaacaatggcgtgtccctcacgttaggtttacctcattgtgatagcttgtcgtccacgcaccatcagggtttcatgcagacccaccatgggattcctatagggagaagagtgaaaataggagaaacagaggaatatggacccgccaccatcaatggtggtagctcgaccacaaccgcacattcatcagcggcagctgccgcggcttacaatgggatgaacatacagaaccagaagagatatgtggctcagttattgcccgacttcgttgcataa

SEQ ID NO: 1539 - DNA, 2527 bp, Arabidopsis thaliana
  misc_feature: Ceres SEEDLINE ID no.ME19971
  misc_feature: Inplanta Sequence
  misc_feature: Encodes the peptide sequence at SEQ ID NO. 1540
atggctgcttactttcacggaaacccaccggagatctctgccggatccgacggtggtcttcaaacgttgatcctcatgaatccaactacttacgttcagtacacccaacaagacaacgactcgaacaacaacaacaacagcaacaatagcaacaacaacaacacaaacacaaacacaaacaacaacaacagtagtttcgttttcctcgattcccacgcgccgcagccaaacgcgagccagcagttcgtcggaataccactctcaggtcacgaagctgcttccattacagccgccgacaacatctccgtacttcacggttatcctccgcgcgtgcagtacagtctctacggtagccaccaagtggatcccactcaccagcaagccgcgtgtgagacgccacgcgcgcagcaaggcctctctttaaccctctcgtctcaacagcagcagcaacagcaacatcatcaacaacaccagcctattcacgtcggattcgggtccggacatggagaagatatccgggtcgggtctggctctacaggatcgggggtaacaaacggtatagctaatcttgttagctccaagtacttgaaggcagcacaagagcttcttgacgaagtagtcaacgctgattccgatgacatgaacgctaaatcccaactattctcatcgaaaaagggtagttgcggaaatgataaacctgtcggagaatcatcggccggcgctggaggagaaggttccggtggcggagcagaagcagccgggaaacgtccggtggagctaggcacggcagagagacaagaaatacagatgaagaaagcaaaacttagtaacatgcttcatgaggtaacaacaatacgtattatatacaataagcctacatatactgagtgctctcttatatcacacatgaagtggacttaaaagttctgtccctaagattttcagtcattttcacaattcattttatatgtatattaagctatcctttttttttttgctcttccgatttctcaaattgacaacttacaagattgatgaaatcttttttttttgtccctctcttagtaaagactaacaacttttatagattatatttatgtagaccgtacacttatgttcataaaactcacgttactttgttggttgaaaaatgaaaaggtggagcagagatatagacagtaccaccagcagatgcagatggtgatctcttcgttcgagcaagcggcagggataggatcagcgaagtcatacacgtcgctagcattgaaaaccatatcaagacagttccgttgcttgaaagaggcgatcgctggtcagataaaagcggccaacaagagtcttggggaggaagattcagtgtctggtgttgggaggtttgaggggtcgaggctcaagttcgtggaccaccacttgagacagcaaagagctcttcaacaactgggaatgattcaacatccttccaataatgcttggagacctcaacgtggtctcccagaacgagccgtctcagttctccgtgcttggctcttcgaacactttcttcatccgtaagtaacccactatacacacatgcactacttttcatcactggaacacaaactcagtctctaagttgtctttcttttaattagataccctaaggattcggacaagcacatgctagctaagcaaacaggactcactcgtagccaggtacgtttcaaaatgattctttcttgtgttattaggttacttaagaaagcgtttttaagtaaatttattttctttaattatttaggtgtcgaactggtttataaacgcgagagttcggttatggaaaccaatggtggaggagatgtacatggaggaaatgaaggagcaggcaaagaacatgggatccatggaaaagactcctttggatcaaagcaacgaagattctgcttcaaagtcaacaagtaaccaagaaaagagcccaatggcggacactaattaccatatgaatcccaatcacaacggtgacctagaaggcgtcactggaatgcaaggaagccccaagagactaagaaccagcgacgagacaatgatgcagccaataaatgcggatttcagctccaacgagaagctcacgatgaagattctagaagaacggcaagggataagatcagatggtggctaccctttcatgggtaatttcgggcaataccaaatggatgagatgtcaagatttgatgtagtctcagaccaggagctcatggcgcaaaggtactcaggaaacaacaatggcgtgtccctcacgttaggtttacctcattgtgatagcttgtcgtccacgcaccatcagggtttcatgcagacccaccatgggattcctatagggagaagagtgaaaataggagaaacagaggaatatggacccgccaccatcaatggtggtagctcgaccacaaccgcacattcatcagcggcagctgccgcggcttacaatgggatgaacatacagaaccagaagagatatgtggctcagttattgcccgacttcgttgcataa

SEQ ID NO: 1540 - protein, 680 aa, Arabidopsis thaliana
  misc_feature: Ceres SEEDLINE ID no.ME19971
  misc_feature: Bit score of 1402.2 for HMM based on sequences of FIGURE 21.
  misc_feature (188)..(333): Pfam Name: POX Pfam Description: Associated with HOX
  misc_feature (410)..(445): Pfam Name: Homeobox Pfam Description: Homeobox domain
MAAYFHGNPPEISAGSDGGLQTLILMNPTTYVQYTQQDNDSNNNNNSNNSNNNNTNTNTNNNNSSFVFLDSHAPQPNASQQFVGIPLSGHEAASITAADNISVLHGYPPRVQYSLYGSHQVDPTHQQAACETPRAQQGLSLTLSSQQQQQQQHHQQHQPIHVGFGSGHGEDIRVGSGSTGSGVTNGIANLVSSKYLKAAQELLDEVVNADSDDMNAKSQLFSSKKGSCGNDKPVGESSAGAGGEGSGGGAEAAGKRPVELGTAERQEIQMKKAKLSNMLHEVEQRYRQYHQQMQMVISSFEQAAGIGSAKSYTSLALKTISRQFRCLKEAIAGQIKAANKSLGEEDSVSGVGRFEGSRLKFVDHHLRQQRALQQLGMIQHPSNNAWRPQRGLPERAVSVLRAWLFEHFLHPYPKDSDKHMLAKQTGLTRSQVSNWFINARVRLWKPMVEEMYMEEMKEQAKNMGSMEKTPLDQSNEDSASKSTSNQEKSPMADTNYHMNPNHNGDLEGVTGMQGSPKRLRTSDETMMQPINADFSSNEKLTMKILEERQGIRSDGGYPFMGNFGQYQMDEMSRFDVVSDQELMAQRYSGNNNGVSLTLGLPHCDSLSSTHHQGFMQTHHGIPIGRRVKIGETEEYGPATINGGSSTTTAHSSAAAAAAYNGMNIQNQKRYVAQLLPDFVA

SEQ ID NO: 1541 - protein, 880 aa, Gnetum gnemon
  misc_feature: Public GI ID no.31746344
  misc_feature: Bit score of 337.1 for HMM based on sequences of FIGURE 21.
  misc_feature (370)..(537): Pfam Name: POX Pfam Description: Associated with HOX
  misc_feature (611)..(641): Pfam Name: Homeobox Pfam Description: Homeobox domain
  misc_feature: Functional Homolog Of Ceres SEEDLINE ID no. ME19971 at SEQ ID NO. 1540
MPLYDASMIPGSEMFNFSAEAELLSFQSKNLSSQQSASSEDAVSCRPVAAGPFTSFGHTVSKDSVVSNVTSWKNYSAQGSEEWPGRVILNSVGYEGGQDSLATPLMLGGSVKEVAAQADAMRLYLMNPGYDAYSEASTAAHSSNNIANQIHDVHKQIVEVPAHFQSYIQNHAVSVVGETSHSSGSQWVSGTNELALLPSYSDIQNGHYLPSSRYYGIGSWANRHNALQDSYQGAFVEGKVGVEVRPQQLSIGRDGCGPSGQGLSLSLSPHQPSEVPLHQIDAVCNRTNILQLSADQLKGKSEDVQSRNEGAHGPQGHPSPYSRRVLSRVGAPMDLQMNVGPLGPFTGYATILKGSKYLKPAQQLLEEFCNVGKGLNYQCNPSKQKLLGHHLSAEKSLPDAVIPPISTTVKGEVDGRKASACAASSSMSVVDKTSSEPAMGEQLVISGARFEMHKKRTRLLALLDELQRRYRQYNDQMQMIITSFESVGGLGAAAPYTSLALKAMSRHFKCLKDAIGDQLKVISKALGNESSLPGVSVGETPRLRLVDQGIRNQRSVHHLGMLEQHAWRPQRGLPERAVSVLRAWLFEHFLHPYPTDADKHMLARQTGLSRSQVSNWFINARVGLWKPMVEEMYELETREASQVDAPPGKTDREERDTSKGGISTEKNASGRGKVLMETISEMQSVSGCGSSSKLEQTTSTSQNGHENCGTSVSIPLESSYLHAHEADAARETAVNVNRHFSGQTQGMPTSHSAISGVESDSGYADSSGFSYEQATKRLRQGLGNTIDFSSYMGGRISHESLNPRPTGNASVSLTLGLRHSGAQEKYTGALYLPREDTLQGCNSRYEIHEIHDGHNQACVGGFETHDIQFRKHLIGTQLLQ

SEQ ID NO: 1542 - DNA, 2628 bp, Gossypium hirsutum
  misc_feature: Ceres CLONE ID no.1943265
  misc_feature: Encodes the peptide sequence at SEQ ID NO. 1543
gtgtcaattattatttatgaaaacagcttgatatatacacatatcatatctcacactttttttttttgtttcacagaagaagaaaaaataaaagaaaggttggtttgtatagtttatgaaaagggagggtcaaattacacaagttccctttgttttgttgtattgcaggtacttcacctaattaaaaacccattaaagagaaaggtgaagaagagtaattgaagtgaagatgatgatgaagcacgtgtatactcaaattaccatcacaccaggatccacttgatcatcccaagatcatcaataccccatttttcccagaaagttctggaatgggttaatttaaagtctgcggatttattgtggagaataagtgaagtgaaagcatagaaaacaacaatagaattaagcaaagaaaacaacatccgatgtcgacgtactttcatgggaaccctgaaatccaagcaagtactgacggccttcaaacccttgtacttatgaaccctgcctatgttcagtattccgatacccctccaccacctccggccaacaacctccttttcttcaaccctaactccctctctccgccccaaactcagcaactcgtcggcatccccctccccgctacctcagccgccaatcaaggccctacctcacacgatatctcccccttgcatggcctcgtccagcgcgtccattacaacttgtacaaccctattgacccttccggatcggcgcgtgaaactcctcgctctcaacaaggactctctttgaccctttcttccctgcagcagccgggttatggatcgcaggctcaagcagtttcagatgggtcggcttcttcaggttcaggcgtgcacaatagggtgtcgggtgtgcaaagtgtgtttttgagctctaaatacttgaaggctgctcaagagcttcttgatgaggttgttaatgttaacactactgggattacaaagagtgaattattggctaagaagggtggtggtggaaataatcatagcaatagcagtagtaaggctgtgggagagtcgtcggtggtggccggggatggctctggtggtggggaggcaggtgagaaacacgccgcagagctgaccacggctgagaaacaggaaattcagatgaagaaagcaaagctaattaacatgcttgatgaggtggaacaaaggtataggcaataccatcatcagatgcagattgtaacatcctcatttgagcaagcagctggcattgggtctgcaaaaacatacacagctcttgcattaaagaccatttcaaagcaatttcggtgtttgaaagatgcaatatctgaccaaatccgagcagccaacaagagtttaggggaagaagaagatggtgtaggcggagcagccaaaatcgagggatccagacttaagttcgtggatcatcatcttcgacagcaaagggcacttcagcagttgggaatgatccagcacaatgcttggagaccccaaagaggattgcctgaaagatcagtttctgttcttcgagcttggctcttcgaacacttccttcacccgtatcctaaagattcagacaaacacatgcttgcaaaacaaacagggctcactaggagtcaggtgtctaactggttcataaatgcccgagttcggctatggaagccaatggtggaagagatgtatttagaggaaatcaaggagcaagaacagaatggtacttcagatgacaaaacaagcaagaccgaaaaccatgaagattcagcatccaaatccacagctccaagctgccaaaatcctggggagaaccagaaagtttcattaatgtccatttccactgcttcaacgtctccccttgcaggaaatgcacaccagcagtcgcgtttctccctcattggatcatccgaattagaagggatcacccaaggaagtccaaagaaaccaaggagcaatgaactgttgcagtccccaactagtgtcccatccatgaacatggacatgaatcaaagtgaggcaagcaatgacgtttccatgaagttcagcaaagatgggtactcattcatggggaccaacaccgatttcatgggaggtttagggcagtatcctatcggagaaatcggacggttcgatgcagaacagttcgctcctaggtttcctggtaatggtgtttccctcacactcggtcttccgcactgtgaaaacctttccttatctggaacccatcagaactttctcccaaaccaaacaatgcaaatggggagaaggctagacattgatgaaccaaatgagtttggtgccataaaccctcccacacctcattcttcggctgcgtatgagagcatcaaccttcagaacagaaaaaggtttgtagcccaattattacctgacttcgtcgcctgaagaacgtgattcgaaccagacaaacatatatctttcactattttcatttctatccattagggaacaagggaaatgcatggtatagtgtaaagaagaaatttctcctagtataggctttatactttgcatagcacaatttgagtccttcaaacatttcaggatctcgccatatatattttagaggattgtatattaattttataagttttggggattggtttaaaaaaaaaaaaaaaaaaaa

SEQ ID NO: 1543 - protein, 653 aa, Gossypium hirsutum
  misc_feature: Ceres CLONE ID no.1943265
  misc_feature: Bit score of 1515.5 for HMM based on sequences of FIGURE 21.
  misc_feature (152)..(299): Pfam Name: POX Pfam Description: Associated with HOX
  misc_feature (374)..(409): Pfam Name: Homeobox Pfam Description: Homeobox domain
  misc_feature: Functional Homolog Of Ceres SEEDLINE ID no. ME19971 at SEQ ID NO. 1540
MSTYFHGNPEIQASTDGLQTLVLMNPAYVQYSDTPPPPPANNLLFFNPNSLSPPQTQQLVGIPLPATSAANQGPTSHDISPLHGLVQRVHYNLYNPIDPSGSARETPRSQQGLSLTLSSLQQPGYGSQAQAVSDGSASSGSGVHNRVSGVQSVFLSSKYLKAAQELLDEVVNVNTTGITKSELLAKKGGGGNNHSNSSSKAVGESSVVAGDGSGGGEAGEKHAAELTTAEKQEIQMKKAKLINMLDEVEQRYRQYHHQMQIVTSSFEQAAGIGSAKTYTALALKTISKQFRCLKDAISDQIRAANKSLGEEEDGVGGAAKIEGSRLKFVDHHLRQQRALQQLGMIQHNAWRPQRGLPERSVSVLRAWLFEHFLHPYPKDSDKHMLAKQTGLTRSQVSNWFINARVRLWKPMVEEMYLEEIKEQEQNGTSDDKTSKTENHEDSASKSTAPSCQNPGENQKVSLMSISTASTSPLAGNAHQQSRFSLIGSSELEGITQGSPKKPRSNELLQSPTSVPSMNMDMNQSEASNDVSMKFSKDGYSFMGTNTDFMGGLGQYPIGEIGRFDAEQFAPRFPGNGVSLTLGLPHCENLSLSGTHQNFLPNQTMQMGRRLDIDEPNEFGAINPPTPHSSAAYESINLQNRKRFVAQLLPDFVA

SEQ ID NO: 1544 - DNA, 493 bp, Gossypium hirsutum
  misc_feature: Ceres CLONE ID no.1926640
  misc_feature: Encodes the peptide sequence at SEQ ID NO. 1545
atctttatataaacactaaaactttctcccctatactcccttttttccttccctcacccccatccttttcttcatcttctcctcctactattcccatgtcttcaagctctagacttgttcccaaaccttgacgagccagccaatcatatttacttatatacgtgtattaattgtggaggattatcactcctttcctttccactgaattctcaggatccacttgatcatcccaagatcatcaataccccatttttcccagaaagttctggaatgggttaatttaaagtctgcggatttattgtggagaataagtgaagtgaaagcatagaaaacaacaatagaattaagcaaagaaaacaacatccgatgtcgacgtactttcatgggaaccctgaaatccaagcaagtactgacggccttcaaacccttgtacttatgaaccctgcctatgttcagtattccgatacccctccaccacctccggccaacaacc

SEQ ID NO: 1545 - protein, 461 aa, Gossypium hirsutum
  misc_feature: Ceres CLONE ID no.1926640
  misc_feature: Bit score of 838.3 for HMM based on sequences of FIGURE 21.
  misc_feature (152)..(299): Pfam Name: POX Pfam Description: Associated with HOX
  misc_feature (374)..(409): Pfam Name: Homeobox Pfam Description: Homeobox domain
  misc_feature: Functional Homolog Of Ceres SEEDLINE ID no. ME19971 at SEQ ID NO. 1540
MSTYFHGNPEIQASTDGLQTLVLMNPAYVQYSDTPPPPPANNLLFFNPNSLSPPQTQQLVGIPLPATSAANQGPTSHDISPLHGLVQRVHYNLYNPIDPSGSARETPRSQQGLSLTLSSLQQPGYGSQAQAVSDGSASSGSGVHNRVSGVQSVFLSSKYLKAAQELLDEVVNVNTTGITKSELLAKKGGGGNNHSNSSSKAVGESSVVAGDGSGGGEAGEKHAAELTTAEKQEIQMKKAKLINMLDEVEQRYRQYHHQMQIVTSSFEQAAGIGSAKTYTALALKTISKQFRCLKDAISDQIRAANKSLGEEEDGVGGAAKIEGSRLKFVDHHLRQQRALQQLGMIQHNAWRPQRGLPERSVSVLRAWLFEHFLHPYPKDSDKHMLAKQTGLTRSQVSNWFINARVRLWKPMVEEMYLEEIKEQEQNGTSDEKQARPKTMKIQHPNPQLQAAKILGRTRKFH

SEQ ID NO: 1546 - DNA, 2037 bp, Populus balsamifera subsp. trichocarpa
  misc_feature: Ceres ANNOT ID no.1454522
  misc_feature: Encodes the peptide sequence at SEQ ID NO. 1547
atggcgacatactttcatgggaatcctgaaatccaagcagctgctgcatcagcggaaggtcttcaaactcttgtgcttatgaaccctacttatgtccaatactctgaaacccctccaccaccacaatccaacaaccttgtattccttaacgccgctgcttctgctgctgccaacagcctctctcctccgccgcacctctcgggccacgcgccatcgaacacccaacaattcgtcggtatccctttggaccctaactcccatgaggcttctactttgcatggacttattccccgtgtccattacaatttttataatccaattgactctacatcgactgcgcgtgaaacaccacgcgcccaacaaggcctgtctttgagcctctcctcacaacagcaaggcggttttggatcacaggctcaagctgtgtctggtgaagatataagggtgtctggtgggttggtgtcaccaggttcgggtgtgacaaatggggtaccgggtatgcaaggggtcttgttgagctcaaagtacttgaaggccactgaagagctacttgatgaggttgttaatgtgaatagtaatggaatcaagagtgaattgtcaaagaagagtaacgggattagtagtaataatagcaataaggtgattggagagtcatcaaccggagaagggtctggcgaaggagaagcaagtgggaagcgcggaccggagctttccactgcagagaggcaggaaattcatatgaagaaggctaagcttatgagcatgctcgatgaggtggagcagaggtacaggcagtatcatcaccagatgcagatagtgatttcctcgtttgagcaagcagcaggaattggttcagcaaagacatacacagcccttgcattgaaaacaatctccaagcagtttaggtgcttgaaagatgcaataacaggtcaaattaaagctgcaaacaaaagcttaggtgaagaggattgcttaggaggaaagattgaaggttcaaggctcaaatttgtcgatcatcaccttcgacaacagcgtgcacttcagcagttgggaatgatccagcacaatgcttggagaccccagagaggattgcctgaaagatcagtttcagttctccgtgcttggctcttcgaacactttctccacccctatcccaaggattcagacaaacacatgctcgcaaaacaaacagggctcacgaggagccaggtgtctaattggttcataaatgctcgagttcgactttggaagccaatggtagaagaaatgtacatggaggaaattaaggaacaagaacagaatggatcagaggacaaaacaagcaagagcgaacacaatgaagatgctgcttcaaggtcagttctgcaagagaaaggttcagttaacggaaatctaactagaagcttcaagtccttggacaattcaccggatgctccttctgcaatctcaatacccacatcttcaacatctcctgttgggggaaatctccgaaaccagtctggattttcctttatggggtcatcagaattagacgggatcacacaagggagcccaaagaaaccaagaagccatgatttgatacaatccccaactagtgtgccatccattaacatggatatcaagcctggcgaggcaaacaatgagcaggtttctatgaaattcggcgatgagaggcagagtagggatggctactcattcataggaggccaaaccaacttcattggaggttttgggcaatatccaatgggggaaattgggaggtttgatggagagcagttcacgccaaggttttctggcaatggtgtctctctcactcttgggctacctcattgtgaaaacctctccttatcaggtactcatcaaacttttcttccaaaccaaaacattcaactgggaagaagagtagagatcggcgaaccaaatgagtatggagcccttaacacatccacgcctcactcttcaactgcatatgagagcattgacattcagaaccgaaagaggtttatagcacaactgttgccagactttgtggcctga

SEQ ID NO: 1547 - protein, 678 aa, Populus balsamifera subsp. trichocarpa
  misc_feature: Ceres ANNOT ID no.1454522
  misc_feature: Bit score of 1616.6 for HMM based on sequences of FIGURE 21.
  misc_feature (169)..(310): Pfam Name: POX Pfam Description: Associated with HOX
  misc_feature (382)..(417): Pfam Name: Homeobox Pfam Description: Homeobox domain
  misc_feature: Functional Homolog Of Ceres SEEDLINE ID no. ME19971 at SEQ ID NO. 1540
MATYFHGNPEIQAAAASAEGLQTLVLMNPTYVQYSETPPPPQSNNLVFLNAAASAAANSLSPPPHLSGHAPSNTQQFVGIPLDPNSHEASTLHGLIPRVHYNFYNPIDSTSTARETPRAQQGLSLSLSSQQQGGFGSQAQAVSGEDIRVSGGLVSPGSGVTNGVPGMQGVLLSSKYLKATEELLDEVVNVNSNGIKSELSKKSNGISSNNSNKVIGESSTGEGSGEGEASGKRGPELSTAERQEIHMKKAKLMSMLDEVEQRYRQYHHQMQIVISSFEQAAGIGSAKTYTALALKTISKQFRCLKDAITGQIKAANKSLGEEDCLGGKIEGSRLKFVDHHLRQQRALQQLGMIQHNAWRPQRGLPERSVSVLRAWLFEHFLHPYPKDSDKHMLAKQTGLTRSQVSNWFINARVRLWKPMVEEMYMEEIKEQEQNGSEDKTSKSEHNEDAASRSVLQEKGSVNGNLTRSFKSLDNSPDAPSAISIPTSSTSPVGGNLRNQSGFSFMGSSELDGITQGSPKKPRSHDLIQSPTSVPSINMDIKPGEANNEQVSMKFGDERQSRDGYSFIGGQTNFIGGFGQYPMGEIGRFDGEQFTPRFSGNGVSLTLGLPHCENLSLSGTHQTFLPNQNIQLGRRVEIGEPNEYGALNTSTPHSSTAYESIDIQNRKRFIAQLLPDFVA

SEQ ID NO: 1548 - DNA, 2040 bp, Populus balsamifera subsp. trichocarpa
  misc_feature: Ceres ANNOT ID no.1475125
  misc_feature: Encodes the peptide sequence at SEQ ID NO. 1549
atggcgacatactttcatgggaatcctgatttccaagcagctgcagcatcagcagaaggtctccaaactcttgttcttatgaaccctacttatgtccaatattccaacacccctccaccaccaccttccaacaactttgtattcctcaacgccgctgcttctgctgctgcttccaacagcctctctcctcaaccccacctctcgggccacgcgccacccaacacccaacaattcgttggcatccctttggaccctaactcccatgacgcttccactttgcatggacttattccgcgtatccattacaatctttacaatccaattgaccctccaccgaccgcgcgtgatacaccacgcgctcagcaaggtctgtctttgagcctctcctcacaaaagcaaggctgttttggatcgcaggctcaaactgtatctggtgaagatataagggtgtccggtgggtcggtgtcatcaggctcgggtgtgacaaatggggttctgggtatgcaaggggtgttgctgagctcaaagtacttgaaggctgctcaagagctacttgatgaggttgttagcgtgaataataatgatattaagagtgaattgtcaaagaggagtaatgggattggtagtaacactagtaacaaagtggttggagaatcattagccggagaagggtctggtggaggagaagtaagtgggaagcgtggaccggagctttccactgccgagaggcaggaaattcagatgaagaaggctaaacttatcagcatgcttgatgaggtggagcaaaggtacaggcagtatcatcaccagatgcagattgtgatttcctcgtttgagcaagcagcaggaattggttctgctaagacatatacagcccttgcgctgaaaacaatctccaagcagtttaggtgcttgaaggatgcaataacaggtcaaattaaagctgcaaacaaaagcttaggtgaagaggattgcttgggaggaaagattgaaggttcaaggctcaaatttgtcgatcatcaccttaggcaacagcgtgcacttcagcagttgggaatgatccagcacaatgcttggagaccacagagaggattgcctgaaagatcagtttcacttctccgtgcttggctcttcgaacactttctccacccctatcccaaggattcagacaagcacatgctcgcaaaacaaacaggactcacgaggagccaggtgtctaattggttcataaacgctcgagttcgactttggaagccgatggtagaagaaatgtacacggaggaaattaaggaacaagaacaggatggatcagaggacaaaacaagcaagagtgatcacaatgaagattctgcttctcggtcagttcttcaagagaaaggttcggcgagcgaaaatcaaactagaaatttcaagtccttggacaattcaccagatgctccttctgagatctcaatgccgacagcttcaacatctcctgttggaggaaatgtccgaaaccagtctgggttttcctttataggatcatcagaattagaagggatcacacaaaggagcccgaagaaacgaagaagcaatgatttcatacagtcctcaactagtgtgccatccataaacatggacatcaagcctggtgaggcaaatgatgagcaggtttctgtaaaattcggcagtgagaggcagagtagggatggctactcattcatgggaggtcaaaccaacttcattggaggttttgggcaatacccaattggtgaaattgggaggtttgatggcgagcagtttacaccaaggttttctggcaatggtgtttctctctctctcgggttaccacattgtgaaaacctctccttatcaggcactcaccaaacttttcttcctaaccaaaacattcaactgggaagaagagtagaaattggtgagccaaatgagtttggagccataaacacatccacgcctcactcttcaactgcatacgagagcatcgacattcagaaccgaaagaggtttttagcacaactgttgccagactttgtggcctga

SEQ ID NO: 1549 - protein, 512 aa, Populus balsamifera subsp. trichocarpa
  misc_feature: Ceres ANNOT ID no.1475125
  misc_feature: Bit score of 1050.4 for HMM based on sequences of FIGURE 21.
  misc_feature (216)..(251): Pfam Name: Homeobox Pfam Description: Homeobox domain
  misc_feature (3)..(144): Pfam Name: POX Pfam Description: Associated with HOX
  misc_feature: Functional Homolog Of Ceres SEEDLINE ID no. ME19971 at SEQ ID NO. 1540
MQGVLLSSKYLKAAQELLDEVVSVNNNDIKSELSKRSNGIGSNTSNKVVGESLAGEGSGGGEVSGKRGPELSTAERQEIQMKKAKLISMLDEVEQRYRQYHHQMQIVISSFEQAAGIGSAKTYTALALKTISKQFRCLKDAITGQIKAANKSLGEEDCLGGKIEGSRLKFVDHHLRQQRALQQLGMIQHNAWRPQRGLPERSVSLLRAWLFEHFLHPYPKDSDKHMLAKQTGLTRSQVSNWFINARVRLWKPMVEEMYTEEIKEQEQDGSEDKTSKSDHNEDSASRSVLQEKGSASENQTRNFKSLDNSPDAPSEISMPTASTSPVGGNVRNQSGFSFIGSSELEGITQRSPKKRRSNDFIQSSTSVPSINMDIKPGEANDEQVSVKFGSERQSRDGYSFMGGQTNFIGGFGQYPIGEIGRFDGEQFTPRFSGNGVSLSLGLPHCENLSLSGTHQTFLPNQNIQLGRRVEIGEPNEFGAINTSTPHSSTAYESIDIQNRKRFLAQLLPDFVA

SEQ ID NO: 1550 - DNA, 2199 bp, Populus balsamifera subsp. trichocarpa
  misc_feature: Ceres ANNOT ID no.1439653
  misc_feature: Encodes the peptide sequence at SEQ ID NO. 1551
atggcaacgtactttcatggaagctcagaaatccaagcagcagctgcaccatctgatgggatccagacactttatctcatgaaccctaactacctctcatcttactctgacgctactcaacagcagcaccaacaacagtctccaaatatgatcttcttcaaccacagtaacactgttaacaatagcctttcccatggaccgccgcagaatcaccactttgtcggcatcccccttcctgtaccctcttccaacatcacttcctcagttcccgacaatcacagccgtccatcgtccctacacggggttgtccctagtgttcactataacatctggggttcaatagatcagaattcggtcgcatcagctgctacagctagtgagtctagtggggcccatgatgtcatgtcgtcccaggtgggttttcggaggccggtggtggtgtctccaggaaggcaaggattatctctaagcctttcgtctcagcaagcaccggcaccaccgacaccctatagtagagctataagcaatgagcatgagattcaagcattgcatcctcatgtttcggttgtgtcttcaggtgatgaaatcagactttctgggaactctccgccgtctgtttcggcagtgtcgaatggggtttcctgtatgcaaaacatggttttgggatccaagtacctgagagctacacaggagttgcttgatgaagttgctaatgtggggaaagacctgataaagagtggcattatagcaaggactaaagagaaaatgaagatgactaaagaatctataactggagatggttctgatggtagtggtgaagctgttggtgaaactagtgctaagcgtggagctgaccttactacagcccataggcaggagctgcaaatgaagaaggcaaagcttgtaaccatgcttgatgaggtggaccaaagatacaggcaataccaccaccaaatgcaagtagtagtttcctcattcgagcaagcagcaggatacggtgcagcgaaatcatacactgccctagcattacagactatctcaaggcaattcaggagtcttaaagacacaatcgcttcacaaatcagggccacgagcaagagcttgggtgaagaggattgcattggagcaaaggttgaaggttcaagactaaggtatgtggatcatcagcttcgacaacagcgagcactacaacaacttggaatggtccaacacaatgcttggagaccccagagaggattgcctgaacgtgctgtttcagttcttcgcgcttggctcttcgagcacttccttcacccttatcccaaggattctgataagcacatgcttgcaaaacaaacagggcttactaggagccaggtgtctaattggtttataaatgctcgagttcggctgtggaagcctatggttgaggaaatgtacttggaggaaatcaaggagcgagagaaggatggttctgaggagagtggaggtaaaaatgagaacaaagagtctgggtcccattctagtgcaccaggagagagcagtacacatcacatggatcaacttaagggagtagtacttcaatcaaaacaacctgaaaaacccaccaaccagaatggttctcctactagattttcaaacccaacaatctcaatgtctcccatgggagcatcctttcaacagcaagctggttttacacttattgggccagctgaaatggaaggaattgctcaaagttcaaagaaaccaaggagcggtgacatgcagaattctccaagtagtatcctctccatggacatggacgtgaaacatggtgagacaagtagggaaatcggtgtgaattttggtggtgacaggttgaccaaggatggttatcctctaataactggcagcaatggatcttttggagcatatccaatgggagatcttggaaggtttaacattgagcagttgaccccaagatttagtggaaatagtgtctccctcactcttggcttaccacactgtgagaacctttctctttcaggaactcagcaaaactacctctccagccagaacattcagctgggtggaagaagaatagaaattggaaccagtgaacctgacttttctgggattaacacctcacaaaattctcactccagctctggttttgagagtgttgacattcaaaacagaaagaggtttcctgctcaactattaccagattttgtggcctga

SEQ ID NO: 1551 - protein, 732 aa, Populus balsamifera subsp. trichocarpa
  misc_feature: Ceres ANNOT ID no.1439653
  misc_feature: Bit score of 1143.6 for HMM based on sequences of FIGURE 21.
  misc_feature (218)..(359): Pfam Name: POX Pfam Description: Associated with HOX
  misc_feature (431)..(466): Pfam Name: Homeobox Pfam Description: Homeobox domain
  misc_feature: Functional Homolog Of Ceres SEEDLINE ID no. ME19971 at SEQ ID NO. 1540
MATYFHGSSEIQAAAAPSDGIQTLYLMNPNYLSSYSDATQQQHQQQSPNMIFFNHSNTVNNSLSHGPPQNHHFVGIPLPVPSSNITSSVPDNHSRPSSLHGVVPSVHYNIWGSIDQNSVASAATASESSGAHDVMSSQVGFRRPVVVSPGRQGLSLSLSSQQAPAPPTPYSRAISNEHEIQALHPHVSVVSSGDEIRLSGNSPPSVSAVSNGVSCMQNMVLGSKYLRATQELLDEVANVGKDLIKSGIIARTKEKMKMTKESITGDGSDGSGEAVGETSAKRGADLTTAHRQELQMKKAKLVTMLDEVDQRYRQYHHQMQVVVSSFEQAAGYGAAKSYTALALQTISRQFRSLKDTIASQIRATSKSLGEEDCIGAKVEGSRLRYVDHQLRQQRALQQLGMVQHNAWRPQRGLPERAVSVLRAWLFEHFLHPYPKDSDKHMLAKQTGLTRSQVSNWFINARVRLWKPMVEEMYLEEIKEREKDGSEESGGKNENKESGSHSSAPGESSTHHMDQLKGVVLQSKQPEKPTNQNGSPTRFSNPTISMSPMGASFQQQAGFTLIGPAEMEGIAQSSKKPRSGDMQNSPSSILSMDMDVKHGETSREIGVNFGGDRLTKDGYPLITGSNGSFGAYPMGDLGRFNIEQLTPRFSGNSVSLTLGLPHCENLSLSGTQQNYLSSQNIQLGGRRIEIGTSEPDFSGINTSQNSHSSSGFESVDIQNRKRFPAQLLPDFVA

SEQ ID NO: 1552 - DNA, 2214 bp, Populus balsamifera subsp. trichocarpa
  misc_feature: Ceres ANNOT ID no.1461995
  misc_feature: Encodes the peptide sequence at SEQ ID NO. 1553
atggcaacgtactttcatggaagctcagaaatccaagcagcagctgcaccatctgatgggatccagacactatatcttatgaaccctaactacctctcttcttactctgactcgactcaacagcagcaccaacaacagccccctaacatgatcttttttaaccccagtagtagtactgccgcttccaataatggccttcacaccggaaaccttcctcatggccccccgcagaaccaccactttgtcggcatcccacttgctgcaccctcctccaatatcacttctcttactccagacagtcacagccgtccgtccctacatggggttgtccctagtcatgttcactataacatttggggttcaatagatcagaattcggtcgcaacagcctgcgagtccagtgcggccaatgatgtcgtgtcgccgcaggtgggttttcggaggccggtggcggtgtctcctggaaggcaagggttatctctaagcctttcgtctcagcaagcaccgacaccaccgacaccgtataatagggctataggcaataaacatcatgagattcaagcattgcatcctcatgtttcggttgtgtcttcaggtgatgaaatcagagtttctgggaactctccgtcgtctgtttcggcagtgtcgaatggggtttccggtttgcaaaacatggttttgggatccaggtacctgagagctacacaggagttgcttgatgaagctgttaatgttggaaaagacctaataaagagtggcttgatagaagggagttctaaagagaagatgaagatgactaaagaatctataactggagatggatctagtggtggtgaagcttatgctgctaatcgtggagctgagctgacgacagcccataggcaggagctgcaaatgaagaagggaaagcttgtaaacatgctcgacgaggtggaacaaagatacaggcaataccaccaccaaatgcaagtagtagtttcctcgttcgagcaagcatcaggatttggtgcagcgaaatcatacactgccctggcattacagactatctcaaagcaattcaggagtcttaaagacacaatttcttcgcaaatcagagccgcaagcaagagtttgggtgaagaggattgcataggagcaaaggttgaaggttcaagactaaggtacgtggatcatcagcttcgacaacagcgagcactacaacaattgggaatggtccaacataatgcttggagaccccagagaggattgccggaacgtgctgtttccgttcttcgcgcctggctctttgagcacttccttcacccatatcccaaagattctgataagcacatgcttgcaaaacaaacagggcttactaggagccaggtgtctaattggtttataaatgctcgggttcggctgtggaagccaatggttgaggaaatgtacgccgaggaaatcaaggagcaagagaaaactggttctgaggagaatgcaaataaaaatgagaacaaggagtcgaggtctcattctagcgcaccaggagagagcagtacacttcaaatggatcaacgtaagggagtacttcactcgaaacaacccgaaaaacccaggaaccagaatgcttctcctccaagattttcataccccgcaatctcaatgtctcccatgggagcaccccttcaacagcaagctggttttacccttattggaccagctgaaatggcaggcgccatttctcatagaagctcaaagaaaccgagtagtcatgacatgcagaattctccaagcagtatcctctccatggacatggacgtgaaacaaggtgagacaagtagggaaatcagtgcgaattttggtggtgaaaggttaatcaaggatggctatcctttaataactagcagtggtggatttggagcatatccaatgggagatcttgggaggtttaaccttgagcagatggcaccaagatttagtggaaacagtgtttcccttagtcttggtctaccacattgtgagaacctttctctttcaggaactcaacaaaactaccactcgaaccagaacattaatcagctcggtggaagaagactagaaattggaagcggtactgaacctgacttttctgggattaacacctcacaaaattctcactccagcactggttttgagagcattgaaatgcaaaacagaaagaggtttcctgcacaattattgccagattttgtggcctga

SEQ ID NO: 1553 - protein, 737 aa, Populus balsamifera subsp. trichocarpa
  misc_feature: Ceres ANNOT ID no.1461995
  misc_feature: Bit score of 1115.2 for HMM based on sequences of FIGURE 21.
  misc_feature (224)..(362): Pfam Name: POX Pfam Description: Associated with HOX
  misc_feature (434)..(469): Pfam Name: Homeobox Pfam Description: Homeobox domain
  misc_feature: Functional Homolog Of Ceres SEEDLINE ID no. ME19971 at SEQ ID NO. 1540
MATYFHGSSEIQAAAAPSDGIQTLYLMNPNYLSSYSDSTQQQHQQQPPNMIFFNPSSSTAASNNGLHTGNLPHGPPQNHHFVGIPLAAPSSNITSLTPDSHSRPSLHGVVPSHVHYNIWGSIDQNSVATACESSAANDVVSPQVGFRRPVAVSPGRQGLSLSLSSQQAPTPPTPYNRAIGNKHHEIQALHPHVSVVSSGDEIRVSGNSPSSVSAVSNGVSGLQNMVLGSRYLRATQELLDEAVNVGKDLIKSGLIEGSSKEKMKMTKESITGDGSSGGEAYAANRGAELTTAHRQELQMKKGKLVNMLDEVEQRYRQYHHQMQVVVSSFEQASGFGAAKSYTALALQTISKQFRSLKDTISSQIRAASKSLGEEDCIGAKVEGSRLRYVDHQLRQQRALQQLGMVQHNAWRPQRGLPERAVSVLRAWLFEHFLHPYPKDSDKHMLAKQTGLTRSQVSNWFINARVRLWKPMVEEMYAEEIKEQEKTGSEENANKNENKESRSHSSAPGESSTLQMDQRKGVLHSKQPEKPRNQNASPPRFSYPAISMSPMGAPLQQQAGFTLIGPAEMAGAISHRSSKKPSSHDMQNSPSSILSMDMDVKQGETSREISANFGGERLIKDGYPLITSSGGFGAYPMGDLGRFNLEQMAPRFSGNSVSLSLGLPHCENLSLSGTQQNYHSNQNINQLGGRRLEIGSGTEPDFSGINTSQNSHSSTGFESIEMQNRKRFPAQLLPDFVA

SEQ ID NO: 1554 - protein, 680 aa, Arabidopsis thaliana
  misc_feature: Public GI ID no.13877517
  misc_feature: Bit score of 1397.9 for HMM based on sequences of FIGURE 21.
  misc_feature (188)..(333): Pfam Name: POX Pfam Description: Associated with HOX
  misc_feature (410)..(445): Pfam Name: Homeobox Pfam Description: Homeobox domain
  misc_feature: Functional Homolog Of Ceres SEEDLINE ID no. ME19971 at SEQ ID NO. 1540
MAAYFHGNPPEISAGSDGGLQTLILMNPTTYVQYTQQDNDSNNNNNSNNSNNNNTNTNTNNNNSSFVFLDSHAPQPNASQQFVGIPLSGHEAASITAADNISVLHGYPPRVQYSLYGSHQVDPTHQQAACETPRAQQGLSLTLSSQQQQQQQHHQQHQPIHVGFGSGHGEDIRVGSGSTGSGVTNGIANLVSSKYLKAAQELLDEVVNADSDDMNAKSQLFSSKKGSCGNDKPVGESSAGAGGEGSGGGAEAAGKRPVELGTAERQEIQMKKAKLSNMLHEVEQRYRQYHQQMQMVISSFEQAAGIGSAKSYTSLALKTISRQFRCLKEAIAGQIKAANKSLGEEDSVSGVGRFEGSRLKFVDHHLRQQRALQQLGMIQHPSNNAWRPQRGLPERAVSVLRAWLFEHFLHPYPKDSDKHMLAKQTGLTRSQVSNWFINARVRLWKPMVEEMYMEEMKEQAKNMGSMEKTPLDQSNEDSASKSTSNQEKSPMADTNYHMNPNHNGDLEGVTGMQGCPKRLRTSDETMMQPINADFSSNEKLTMKILEERQGIRSDGGYPFMGNFGQYQMDEMSRFDVVSDQELMAQRYSGNNNGVSLTLGLPHCDSLSSTDHQGFMQTHHGIPIGRRVKIGETEEYGPATINGGSSTTTAHSSAAAAAAYNGMNIQNQKRYVAQLLPDFVA

SEQ ID NO: 1555 - protein, 809 aa, Malus x domestica
  misc_feature: Public GI ID no.7239157
  misc_feature: Bit score of 316.6 for HMM based on sequences of FIGURE 21.
  misc_feature (362)..(505): Pfam Name: POX Pfam Description: Associated with HOX
  misc_feature (558)..(616): Pfam Name: Homeobox Pfam Description: Homeobox domain
  misc_feature: Functional Homolog Of Ceres SEEDLINE ID no. ME19971 at SEQ ID NO. 1540
MGIVTLPPLPPPPPKGNLHHRHHSIDSENYSNPPNSMSQDYHQGIFTFSNGFERSAMTTHQEQQQQQQHHLAQQIRREKLRVQGFETPPPPPLVGLNEEESSGLPAYETAGMLSEMFNYPPGGGPVGAAELLEHPMSANYRMMPRPQQAAAVSAAADWYGRVGGGGLGPLGDSKNQHHHQISTINADSAAAMQLFLMNPSQPRSPSPPPSHTTSSTLHMLLPNPSTTTNSLQGFAAASGGGAFGQFTWVPESHQGHEAGGNTAGGGGEIGGVVEGQGLSLSLSTSLQHLEAAKAEEFRMGSDSASGLLYYNNQGDHQHQGSNPQYKNLGSHHHQALHSLQQGGVVGGHHVSFGSSSSFGVVNVLRNSKYVKAAQELLEEFCSVGRGQLKKNKFGGSTSGRQNTTTNPSSNPASGGGGDGGASSSSSKDVPPLSAADRIEHQRRKVKLLSMIDEVDRRYNHYCEQMQMVVNAFDLVMGFGAAVPYTALAQKAMSRHFRCLKDAIAAQLKHSCELIGEKDGAGTSGITKGETPRLKLLEQSLRQQRAFHQMGMMEQEAWRPQRGLPERSVNILRAWLFEHFLHPYPSDADKHLLARQTGLSRNQVSNWFINARVRLWKPMVEEMYQQEANEEEEVGEGGVGGATSAAADQERERNSNAGLAAQTPTPTTTTTTTTKNSPASKRSDINASENDPSLVAINRHQQQQHHHPMMATTTSTTVASPAYQCFPAAASDDTCRSYGTTSANANIAAHHDHQNSSNIDSSTTLISFGTTTAAGDVSLTLGLRHAGGGGGNNMPDKTSSSFSIRDFGGC

SEQ ID NO: 1556 - protein, 699 aa, Solanum lycopersicum
  misc_feature: Public GI ID no.31323447
  misc_feature: Bit score of 1326.4 for HMM based on sequences of FIGURE 21.
  misc_feature (212)..(357): Pfam Name: POX Pfam Description: Associated with HOX
  misc_feature (429)..(464): Pfam Name: Homeobox Pfam Description: Homeobox domain
  misc_feature: Functional Homolog Of Ceres SEEDLINE ID no. ME19971 at SEQ ID NO. 1540
MYYQGTSDNNIQADHHQQQHNNLGNSNNNIQTLYLMNPNSYMQGYTTTDTQQHLQQQQNQHQLLFLNSAPAGGNALSHANIQHAPLQQQHFVGVPLPAVSLHDQINHHGLLQRMWNNQDQSQQVIVPSSTVVSATSCGGTTTDLASQLAFQRPIVVSPTPQHRQQQQQQGGLSLSLSPQQQQQISFNNNISSSSPRTNNVTIRGTMDGCSSNMILGSKYLKAAQELLDEVVNIVGKSNKGDDQKKDNSMNKELIPLVSDVNTNSSGGGGGESSSRQKNEVAIELTTAQRQELQMKKAKLLAMLEEVEQRYRQYHHQMQIIVSSFEQVAGVGSAKSYTQLALHAISKQFRCLKDAISEQVKATSKSLGEDEGLGGKIEGSRLKFVDHHLRQQRALQQLGMMQPNAWRPQRGLPERAVSVLRAWLFEHFLHPYPKDSDKIMLAKQTGLTRSQVSNWFINARVRLWKPMVEEMYLEEVKNQEQNSSNTSGDNKNKETNISAPNEEKQPIITSSLLQDGTTQAEISTSTISTSPTAGASLHHAHNFSFLGSFNMENTTTTVDHIENNAKKPRNHDMHKFSPSSILSSVEMEAKARESTNKGFTNPLMAAYAMGDFGRFDPHDQQMTANFHGNNGVSLTLGLPPSENLAMPVSQQNYLSNELGSRPEIGSHYNRMGYENIDFQSGNKRFPTQLLPDFVTGNLGT

SEQ ID NO: 1557 - protein, 568 aa, Solanum tuberosum
  misc_feature: Public GI ID no.22652125
  misc_feature: Bit score of 1120.7 for HMM based on sequences of FIGURE 21.
  misc_feature (261)..(296): Pfam Name: Homeobox Pfam Description: Homeobox domain
  misc_feature (49)..(189): Pfam Name: POX Pfam Description: Associated with HOX
  misc_feature: Functional Homolog Of Ceres SEEDLINE ID no. ME19971 at SEQ ID NO. 1540
MQGLSLSLSSSQQPGFGNFTAARELVSSPSGSASASGIQQQQQQQQSISSVPLSSKYMKAAQELLDEVVNVGKSMKSTNSTDVVVNNDVKKSKNMGDMDGQLDGVGADKDGAPTTELSTGERQEIQMKKAKLVNMLDEVEQRYRHYHHQMQSVIHWLEQAAGIGSAKTYTALALQTISKQFRCLKDAIIGQIRSASQTLGEEDSLGGKIEGSRLKFVDNQLRQQRALQQLGMIQHNAWRPQRGLPERAVSVLRAWLFEHFLHPYPKDSDKMMLAKQTGLTRSQVSNWFINARVRLWKPMVEEMYLEEIKEHEQNGLGQEKTSKLGEQNEDSTTSRSIATQDKSPGSDSQNKSFVSKQDNHLPQHNPASPMPDVQRHFHTPIGMTIRNQSAGFNLIGSPEIESINITQGSPKKPRNNEMLHSPNSIPSINMDVKPNEEQMSMKFGDDRQDRDGFSLMGGPMNFMGGFGAYPIGEIARFSTEQFSAPYSTSGTVSLTLGLPHNENLSMSATHHSFLPIPTQNIQIGSEPNHEFGSLNTPTSAHSTSSVYETFNIQNRKRFAAPLLPDFVA

SEQ ID NO: 1558 - protein, 688 aa, Solanum tuberosum
  misc_feature: Public GI ID no.22652115
  misc_feature: Bit score of 1228.9 for HMM based on sequences of FIGURE 21.
  misc_feature (202)..(345): Pfam Name: POX Pfam Description: Associated with HOX
  misc_feature (417)..(452): Pfam Name: Homeobox Pfam Description: Homeobox domain
  misc_feature: Functional Homolog Of Ceres SEEDLINE ID no. ME19971 at SEQ ID NO. 1540
MYYQGTSDNTNIQADHQQRHNHGNSNNNNIQTLYLMNPNNYMQGYTTSDTQQQQQLLFLNSSPAASNALCHANIQHAPLQQQHFVGVPLPAVSLHDQINHHGLLQRMWNNQDQSQQVIVPSSTGVSATSCGGITTDLASQLAFQRPIPTPQHRQQQQQQGGLSLSLSPQLQQQISFNNNISSSSPRTNNVTIRGTLDGSSSNMVLGSKYLKAAQELLDEVVNIVGKSIKGDDQKKDNSMNKESMPLASDVNTNSSGGGESSSRQKNEVAVELTTAQRQELQMKKAKLLAMLEEVEQRYRQYHHQMQIIVLSFEQVAGIGSAKSYTQLALHAISKQFRCLKDAIAEQVKATSKSLGEEEGLGGKIEGSRLKFVDHHLRQQRALQQIGMMQPNAWRPQRGLPERAVSVLRAWLFEHFLHPYPKDSDKIMLAKQTGLTRSQVSNWFINARVRLWKPMVEEMYLEEVKNQEQNSTNTSGDNKNKETNISAPNEEKHPIITSSLLQDGITTTQAEISTSTISTSPTAGASLHHAHNFSFLGSFNMDNTTTTVDHIENNAKKQRNDMHKFSPSSILSSVDMEAKARESSNKGFTNPLMAAYAMGDFGRFDPHDQQMTANFHGNNGVSLTLGLPPSENLAMPVSQQNYLSNDLGSRSEMGSHYNRMGYENIDFQSGNKRFPTQLLPDFVTGNLGT

SEQ ID NO: 1559 - protein, 535 aa, Solanum tuberosum
  misc_feature: Public GI ID no.22652117
  misc_feature: Bit score of 631.2 for HMM based on sequences of FIGURE 21.
  misc_feature (266)..(301): Pfam Name: Homeobox Pfam Description: Homeobox domain
  misc_feature (56)..(194): Pfam Name: POX Pfam Description: Associated with HOX
  misc_feature: Functional Homolog Of Ceres SEEDLINE ID no. ME19971 at SEQ ID NO. 1540
MTFRSSLPLDLREISTTNHQVGILSSSPLPSPGTNTNNINHTRGLGASSSFSISNGMILGSKYLKVAQDLLDEVVNVGKNIKLSDGLESGAKEKHKLDNELISLASDDVESSSQKNSGVELTTAQRQELQMKKAKLVSMLDEVDQRYRQYHHQMQMIATSFEQTTGIGSSKSYTQLALHTISKQFRCLKDAISGQIKDTSKTLGEEENIGGKIEGSKLKFVDHHLRQQRALQQLGMMQTNAWKPQRGLPERAVSVLRAWLFEHFLHPYPKDSDKIILAKQTGLTRSQVSNWFINARVRLWKPMVEEMYMEEVKKNNQEQNIEPNNNEIVGSKSSVPQEKLPISSNIIHNASPNDISTSTISTSPTGGGGSIPTQTVAGFSFIRSLNMENIDDQRNNKKARNEMQNCSTSTILSMEREIINKVVQDETIKSEKFNNTQTRECYSLMTPNYTMDDQFGTRFNNQNHEQLATTTTFHQGNGHVSLTLGLPPNSENQHNYIGLENHYNQPTHHPNISYENIDFQSGKRYATQLLQDFVS

SEQ ID NO: 1560 - DNA, 2635 bp, Zea mays subsp. mays
  misc_feature: Ceres CLONE ID no.1583941
  misc_feature: Encodes the peptide sequence at SEQ ID NO. 1561
acttgggttttctttctcctctcttctcttcttctcccctctcaacctcttctcctcccaaggctgactggccgtcggctcgggtctggggacagcaatccctgccgtcttgccatgctccccacgaggagcacatcgtcagagtgattctgcagaagtattcattctactggcgtgctgagcaggtgcaggagctctaataagtctagtgcgcacttcagtcatcagccaagtgattgaaaagggcaagtcagctgaaatattggttccgagggctctgtagttgcttatccacgctcgcctatgcctttgcgctgatcttgacaactcaaagcttggatatggctacttattactcgagccctggcagtgaaagagattcacaaacaatgtactcagcagagtcaggcaatgtatcatatcccgtgccatcagccctagggaactttctttatacgaacaatgcatcttctgggccttatacagaatttagtggaattgtccagcctcagcagaatttcatggaacttactggtcatccttcagcaatgtcacatgattcgtcatccaatgaagctaccaacatgggcagttcactcactgaacagcgctcttttggtcctttgaaagatatgagaaatgagatgttgatgcatttgatggatggagcacacagcagtggcagtgatctcatccacaatgatgctcatagcactgtacagctcgaatttggcatgttaaacaaccacaactcaacaagtgttccattagcaccaggccaagggctgtctctgagcctcaatacacatatcttggcgccttcctatccacactggtctgcaaagcaagacttactaacaccaaattcttaccagggtgatgacaacagaatgaagaatatgcagtctgaggcctcacatgcaatccggaactctaagtatctgaaggcagcacaggagttacttgatgagattgtcagtgtttggaagtgtgttaaacagaaaacagataaaggccctgctgaagcaggaaaggctgatggaaaagagactgatggggggattaaaagtgagggggtatcttccaatccgcaagagtctggtgccaatgcagcagctgagctttcaactgctgagaaacaagagctccagaataagatggcaaaacttatgactatgttggacgaggtggataggaagtacaaacactattatcatcagatgcaacttgtaatgtcatcgtttaatatggttgctggtgctggagctgccaagccttatactgcagttgccctccagacaatctcacggcatttccgatgtctaaaggatgctatcaatgatcaaattagtgttatccggaagaaacttggagaggatgacaatacatccggcaaagagggcaaactaacccgccttcgttatattgatcagcaaataaggcaacagcgagctttccaacagtatggtatgctacagcaaaacgcttggaggccacagagaggactacctgaaaattcagtctcgattctccgggcttggctttttgaacacttccttcacccgtatccaaaagattctgaaaagctaatgttatcgagacaaactgggttgacaagaagtcagatttcaaactggttcatcaatgcccgtgtccggctgtggaagccaatgatcgaagacatgtacaaagaagagattggtgaggcggagctagactccaactcttcctccgacaacgggcagcgaaacaaggacaaagcaccatctcccgaagaaaatgaggacctgcagaccccaacaagccaggcttgccaaaccagccagctcggcgagtccaaagccatcgttggtggagtgatgggctttagtggagtgctagccggcggcttccacaccgaggccaaccccgacgacagcttcatgagcctgatgctgaaggcccagagacctggtgaaaccgaaggcaccggtctcctccacgatgccgtcgctcaccactcggacgacggcgcccggttcatggcctaccacctggcagagttcgggaggtacgggaacagcagcaacgtctcactgacgctgggcttgcagcacgccgagaacagcctcgcagtcccaccaaacactcagccaggcttccccggcgtcagagaccaagacatgtacaacgccacagctcctcctctcaacgtcgcctccacgtcttcagagtatgattcggcgagccaaattgatcaacaacagcaacggcagcggttcgagccgtcacctctgatgcatgatttcgtggcctgaatttcagctcgcccactggaaaacgtgggggaaaactactgccaatttgtagtgtgtgccaggacgaataacttgcctggactgaattttcaggcgtgggactgtagctgtagttaacgattggggatttggggggtacagtacaggaggtatatagcgtaaatgtgatgtaaatttagtgggggtgatagcggtaaagaaatcctgtaaagatggaatgcatttatacgtgtatttaagggccatgctgtaaaaatagatttacctgtaatgagtacttatgatccaggtaatatatatactgtgcacgctgttgaaactaaaaaaaaaaaaaaaaa

SEQ ID NO: 1561 - protein, 651 aa, Zea mays subsp. mays
  misc_feature: Ceres CLONE ID no.1583941
  misc_feature: Bit score of 1356.1 for HMM based on sequences of FIGURE 21.
  misc_feature (193)..(334): Pfam Name: POX Pfam Description: Associated with HOX
  misc_feature (384)..(442): Pfam Name: Homeobox Pfam Description: Homeobox domain
  misc_feature: Functional Homolog Of Ceres SEEDLINE ID no. ME19971 at SEQ ID NO. 1540
MATYYSSPGSERDSQTMYSAESGNVSYPVPSALGNFLYTNNASSGPYTEFSGIVQPQQNFMELTGHPSAMSHDSSSNEATNMGSSLTEQRSFGPLKDMRNEMLMHLMDGAHSSGSDLIHNDAHSTVQLEFGMLNNHNSTSVPLAPGQGLSLSLNTHILAPSYPHWSAKQDLLTPNSYQGDDNRMKNMQSEASHAIRNSKYLKAAQELLDEIVSVWKCVKQKTDKGPAEAGKADGKETDGGIKSEGVSSNPQESGANAAAELSTAEKQELQNKMAKLMTMLDEVDRKYKHYYHQMQLVMSSFNMVAGAGAAKPYTAVALQTISRHFRCLKDAINDQISVIRKKLGEDDNTSGKEGKLTRLRYIDQQIRQQRAFQQYGMLQQNAWRPQRGLPENSVSILRAWLFEHFLHPYPKDSEKLMLSRQTGLTRSQISNWFINARVRLWKPMIEDMYKEEIGEAELDSNSSSDNGQRNKDKAPSPEENEDLQTPTSQACQTSQLGESKAIVGGVMGFSGVLAGGFHTEANPDDSFMSLMLKAQRPGETEGTGLLHDAVAHHSDDGARFMAYHLAEFGRYGNSSNVSLTLGLQHAENSLAVPPNTQPGFPGVRDQDMYNATAPPLNVASTSSEYDSASQIDQQQQRQRFEPSPLMHDFVA

SEQ ID NO: 1562 - DNA, 2650 bp, Panicum virgatum
  misc_feature: Ceres CLONE ID no.1792942
  misc_feature: Encodes the peptide sequence at SEQ ID NO. 1563
gttagtgggtggtgcgagctcagcttcttctcccttttttattttggaaggagggagagctgcctcggacgagctccgagctacagcagcagagggagggaggcagccagggagactagagagagaagggggaagctcctttttctttctggaatcgtttattttaatcctgggatctgattttgtccccatattgggaggattgattatctttctcatctccctctctccccttctcttctcttctcctcccctccccactcagcctcaagaagatcagctttgctgtggaggcaatccctgcctctgccttgttgcctgctcctactctgctccccatgagaggagcacaacctgccctcagattgatcaaactctgttcgtattggtggtacgcctgtgaagcatctttgaggactctcagtttggttgcacaaggcgagctgtaagtgaaaggtttgggtcttctgctaaaacttgatttatcaatcaatatccgaggtgcttctgtgtacacgtatctcttggtgtcattttgatcagttagtagccaaaaactgtatgatggctacttattactcgagcccgggtagtgaaagggactcgcagaacatgtactcaagagacctgggcaatgcatcctatcctatgccatcagctctagggaacttgctgtatctgaacaattctatttcaggaccatacacggaatttagtggtattctgcagtctcagcagaattgcatggagatgcctgaccctggccatccttcagtcatgtcccaagactcatcagcaagggagtctgacatgcttggttcccaccaggggcagcgctctttcggtccagtcaaagatatgaaaaacgagatgttgatgcatatgatggatggatcacaaagtagcactgctgatctcatccatgatgatgaccacaatggtgcacagcttgatttcggtgttctgaacaaccacagttcatcgaacattccctcagtgcaaggccaaggtttatctctgagcctcaacacacaaatcctggcaccttccttaccatactggtctgtcaaaccagatatgttgtcaccacactcttaccatgacagtcttagagttgatgacatccgaatgaagagtatgcagtctgaggcctcacgtgcaatctggaactccaggtatctgaaggcagcacaagaactgcttgatgaggttgtgaacgtatggaaaaatattaagcagaaagctcagaaagaacaagtcgaagctggaaagacagatgccaaggagaccgaaggagggctgaaaagtgagggcgtgtcctctaatccacaggaatctgctgccaatgcagcacctgagctttctactgctgagaggcaagaacttcagaacaagatggcaaagctgatggctatgttggatgaggtggaccggaaatacaagcactactaccaccaaatgcaaagtgtggtttcctcttttgatgtggtagctgggcctggagctgccaagccttacactgcagttgccctccagacaatctcacgacacttccggtgcctgaaggatgctatcaatgatcagatcaatgtcatcagaaagaagcttggagaggaggaaaattcatctggcaaggagggcaaattaactcgtctccggtacattgatcaacagctaaggcaacaacgagctttccaacagtatggcatgattccacaaaatgcctggaggccacagagagggcttcctgaaaactctgttaccattcttcgtgcttggctctttgagcatttccttcacccgtatcctaaagattctgaaaagctgatgctagctaggcaaacaggcttgacaaggagtcagatttcaaattggttcataaatgcccgtgtacgcctttggaaaccaatgattgaggacatgtacaaggaagagattggagatattgagcaagactccaactcttcctccgacaatgcgccaagaagcaagggcaaaatggcatcttctgaagacaaggaggacctgaaaagttctacacctcgggtttgtgagagcagccagctgagcgagtcgagagccagcatagggactatgaacgttggtggagcagctgttggattccagaatgaggccaaccctgacgacagcttcatgaatctgatgctgaaggaccaaagatcaaacgaaggagatggtggcctcctcgtccacaatgctgttgcacatcatcaagatgagaatgcccggttcatggcctaccacttggcagagcttgggagatatggaaatggcaacgtatcactgacacttggcttgcagcactccggcagcagcctctcggttcataatgcccagcagagctttgctggtgtcggagacgatgacatctacaatgctaccgctcctctcggtgtgagcgtcacgtcttcagactatgaatcgatgaaccagatggatcaacggcaaaggttcgagcaatcacctcttctgcatgattttgtggcctgaatgctcatagttcagaagatttttaacacctggcttggctgggtgaataacatatgcctaaaaggagcattgggttgtagcctgtagtttccattcgatacagattggaggtatagcaggaaatgtaatatagtgaggg

SEQ ID NO: 1563 - protein, 649 aa, Panicum virgatum
  misc_feature: Ceres CLONE ID no.1792942
  misc_feature: Bit score of 1373.5 for HMM based on sequences of FIGURE 21.
  misc_feature (199)..(340): Pfam Name: POX Pfam Description: Associated with HOX
  misc_feature (413)..(448): Pfam Name: Homeobox Pfam Description: Homeobox domain
  misc_feature: Functional Homolog Of Ceres SEEDLINE ID no. ME19971 at SEQ ID NO. 1540
MMATYYSSPGSERDSQNMYSRDLGNASYPMPSALGNLLYLNNSISGPYTEFSGILQSQQNCMEMPDPGHPSVMSQDSSARESDMLGSHQGQRSFGPVKDMKNEMLMHMMDGSQSSTADLIHDDDHNGAQLDFGVLNNHSSSNIPSVQGQGLSLSLNTQILAPSLPYWSVKPDMLSPHSYHDSLRVDDIRMKSMQSEASRAIWNSRYLKAAQELLDEVVNVWKNIKQKAQKEQVEAGKTDAKETEGGLKSEGVSSNPQESAANAAPELSTAERQELQNKMAKLMAMLDEVDRKYKHYYHQMQSVVSSFDVVAGPGAAKPYTAVALQTISRHFRCLKDAINDQINVIRKKLGEEENSSGKEGKLTRLRYIDQQLRQQRAFQQYGMIPQNAWRPQRGLPENSVTILRAWLFEHFLHPYPKDSEKLMLARQTGLTRSQISNWFINARVRLWKPMIEDMYKEEIGDIEQDSNSSSDNAPRSKGKMASSEDKEDLKSSTPRVCESSQLSESRASIGTMNVGGAAVGFQNEANPDDSFMNLMLKDQRSNEGDGGLLVHNAVAHHQDENARFMAYHLAELGRYGNGNVSLTLGLQHSGSSLSVHNAQQSFAGVGDDDIYNATAPLGVSVTSSDYESMNQMDQRQRFEQSPLLHDFVA

SEQ ID NO: 1564 - protein, 654 aa, Oryza sativa subsp. indica
  misc_feature: Public GI ID no.125535858
  misc_feature: Bit score of 782.4 for HMM based on sequences of FIGURE 21.
  misc_feature (158)..(291): Pfam Name: POX Pfam Description: Associated with HOX
  misc_feature (378)..(413): Pfam Name: Homeobox Pfam Description: Homeobox domain
  misc_feature: Functional Homolog Of Ceres SEEDLINE ID no. ME19971 at SEQ ID NO. 1540
MAAYFTGGGAGTDVVQAAGTDGLQTLYLMNPSYVGFTDAAAAPGGGAAAANMVFLNSAVSTLTPASFGHHHQPTPAAQHFVGIPLQSGYNLWGPDATGGNDVSPPRHGAQQQAPAAAGTSAAAVSPVLSLSSREAAPPVTVAAAAAAAAVPGGTDQEKVVMRSRYLKAAQELLDEAVSVSKGAATAVKKKEDSEGGVSGGGGGAEDGGGSKSGAAAEMSTAERQELQMKKSKLLNMLDEVEQRYRQYHRQMQGVAAAFEAAAGAGSATTYTSLALRTISRQFRCLRDAIAAQVRAASRGLGEDCGDDEGGGGGGRTTVGSRLRFIDHQLRQQRAMQQLGMVHAAAAGGAAGGGWRPQRGLPERAVSVLRAWLFEHFLHPYPKDSDKVMLAKQTGLTRSQVSNWFINARVRLWKPMVEEMYAEETKAKEEEEEEHDAAAAAAGDRCGVAEQAPSKPDDSAGIGMSSSSPAAAASRSVGVHAGDQHAQASFYGGGGGGDDPFQCRIKKARTTTADEPAAAAAFHVSGEAAVSHRELLMKFTEAGGEGVRTDHPHVNDDDDDVPGGAGGYSLFTAAQYGHQFGSDHFAFAGHGGGGGGGVSLTLGLPHGADQTPASFLIGAGAGSDGGGAPVTTAGYDMNMQSTKSLAAQLMRDFVA

SEQ ID NO: 1565 - protein, 678 aa, Oryza sativa subsp. japonica
  misc_feature: Public GI ID no.77548772
  misc_feature: Bit score of 1329.4 for HMM based on sequences of FIGURE 21.
  misc_feature (168)..(312): Pfam Name: POX Pfam Description: Associated with HOX
  misc_feature (387)..(422): Pfam Name: Homeobox Pfam Description: Homeobox domain
  misc_feature: Functional Homolog Of Ceres SEEDLINE ID no. ME19971 at SEQ ID NO. 1540
MAAYYHGGAGTDIQSGTDGLQTLYLMNPSYAGYGDAAAAAAAPGAAANMMLLNSAVTSMTPVSFGHQPSPSSSSAAQHFVGIPLQAPPASGYNLWTPAAATGAGDMSPPTPQHQHQQAHGGGAAGVSAVLSLSSREAAPPVTVAAVVAAGDEGKYLQAVAQGAASHGQMVMSSKYLKAAQELLDEVVSVSKGVDDVKAAAAAKSPASVKKKEDSEGVSGGGTEDGGGAKSGGAPPPPEMSTAERQELQMKKGKLINMLDEVEQRYRQYHQQMQVVVASFEAVAGGGSARTYTALALRTISRQFRCLRDAIAGQVRAASRALGEAVDADGGCGRTVGSRLRYIDHQLRQQRALQQLGMMQSSAWRPQRGLPERSVSILRAWLFEHFLHPYPKDSDKIMLAKQTGLTRSQVSNWFINARVRLWKPMVEEMYLEETKDQDGGGGAGAGDEGSKPGGSKGGGAGVNGGVVDSAAKMDSKAAHMESGGGVHPSLLELAGDHQAQAGFYDDDDEDGGAAAALQQKLKKARTEEQQQAAFHVSDVATLHAHAAAAAAARHDEVSHRELLMKFMESGSAGAGAGAAARDHHHEHHGGVGYSLFAPAPYGQFATEQFAFAGHGGGGGGGGVSLTLGLPHGAEQTASFLMTSSNGSDGAGHVAGGGGYDMNMQSTKSFAAQLMRDFVA

SEQ ID NO: 1566 - protein, 576 aa, Oryza sativa subsp. japonica
  misc_feature: Public GI ID no.125578581
  misc_feature: Bit score of 625.2 for HMM based on sequences of FIGURE 21.
  misc_feature (301)..(336): Pfam Name: Homeobox Pfam Description: Homeobox domain
  misc_feature (81)..(214): Pfam Name: POX Pfam Description: Associated with HOX
  misc_feature: Functional Homolog Of Ceres SEEDLINE ID no. ME19971 at SEQ ID NO. 1540
MAAYFTGGGAGTDVVQAAGTDGLQTLYLMNPSYQQAPAAAGTSAAAVSPVLSLSSREAAPPVTVAAAAAAAAVPGGTDQEKVVMRSRYLKAAQELLDEAVSVSKGAATAVKKKEDSEGGVSGGGGGAEDGGGSKSGAAAEMSTAERQELQMKKSKLLNMLDEVEQRYRQYHRQMQGVAAAFEAAAGAGSATTYTSLALRTISRQFRCLRDAIAAQVRAASRGLGEDCGDDEGGGGGGRTTVGSRLRFIDHQLRQQRAMQQLGMVHAAAAGGAAGGGWRPQRGLPERAVSVLRAWLFEHFLHPYPKDSDKVMLAKQTGLTRSQVSNWFINARVRLWKPMVEEMYAEETKAKEEEEEEHDAAAAAAGDRGGVAEQAPNKPDDSAGIGMSSSSPAVAASRSVGVHAGNQHAQASFYGGGGGGNNPFQCRDQEGEDDNGGRAAAARRSRLGEAAVSHRELLMKFTEAGGEGVRTGHPHVNDDDDDVPGGAGGYSLFTAAQYGHQFGSDHFAFAGHGGGGGGGVSLTLGLPHGADQTPASFLIGAGAGSDGGGAPVTTAGYDMNMQSTKSLAAQLMRDFVA

SEQ ID NO: 1567 - protein, 651 aa, Trifolium pratense
  misc_feature: Public GI ID no.84453182
  misc_feature: Bit score of 1514.4 for HMM based on sequences of FIGURE 21.
  misc_feature (161)..(300): Pfam Name: POX Pfam Description: Associated with HOX
  misc_feature (372)..(407): Pfam Name: Homeobox Pfam Description: Homeobox domain
  misc_feature: Functional Homolog Of Ceres SEEDLINE ID no. ME19971 at SEQ ID NO. 1540
MATYFHNNSEIQGGSADGLQTLIFMNPSGYINYSDTPQPPPHAGNLVFLNSAATLAGNGNTSIQQQHNLSHAPPQFVGVPLSAEQSVQAHHDISALHGFPPRMQYNMWNAADPNSAAREATRATQGLSLSLHAQGSGEDARVSAGGSCSSASNNGVSGIQSVLLNSKYLKATQELLDEVVNVNGGIKVESVKKSFEKNKVVGESSTAVSGDGGSVGGDGSGKRSTELSTTERQEVQMKKAKLINMLDEVEQRYRQYHNQMQMVISSFEQVAGIGSARTYTALALQTISKQFRCLKDAITGQIRAANKSLGEDDSFGGKIEGSRLKYVDHHLRQQRAIQQLGMMHHNAWRPQRGLPERSVSVLRAWLFEHFLHPYPKDSDKHMLAKQTGLTRSQVSNWFINARVRLWKPMVEEMYTEEMKEQEMNGSEDNKSSKHIDEDTSMKSTTPQQVPTSETESKSFNSKQDIPIVSVSTQSTSPIGVNVRNNNSGFSFTELDGITQASPKRTRNHEILQSPNHVKSNETNNNNNEQISMKFGDDRQSRDGYCFMGNQTNFIAGFGQYPMEEIGRFDAEQFTPRFSGNNNGVSLTLGLPHCDTLSGTHQSFMPNQNIQLGRRLDISEQNEFGDSSAAFESMNMQNPKRFAAQLLPDFVA

SEQ ID NO: 1568 - protein, 759 aa, Hordeum vulgare subsp. vulgare
  misc_feature: Public GI ID no.13752407
  misc_feature: Bit score of 299.1 for HMM based on sequences of FIGURE 21.
  misc_feature (344)..(482): Pfam Name: POX Pfam Description: Associated with HOX
  misc_feature (535)..(593): Pfam Name: Homeobox Pfam Description: Homeobox domain
  misc_feature: Functional Homolog Of Ceres SEEDLINE ID no. ME19971 at SEQ ID NO. 1540
MGIAAPPCQATRQHVSTPKSSAAIQDDGRPATASSMSHSQGFHQGSSGVYGFSSDGFDRPGSSQDQQHQEHDHVAQQSRRDKLRVQGFDPAAAGLLPIDGDQHVEPGAMYDHAAAAGASNMLAEMFNFSAQTPSGPSATELLASQMNANYRFGFRQQAPGAVAGLPGDGGWFGSAGPGRAGVVLGGANLLGETSSPKQQGGMAGLATDPAAAMQLFLMNPQQQQQSRSSPTSPPPSDAQSAIQHHEAFQAYGNAASSFGGGGAGVVEGQGLSLSLSPSLQQLEMAKQAEELRVRDGVLYFNRQQQQQQQQQAASVQQLPMALHGQVGSMGQQLHVGYGPAGVAGVLRNSKYTRAAQELLDEFCSVGRGQTIKGGGRGGSSSNPNASKGGPSSSGAAQSPSSASKEPPQLSPADRFEQQRKKAKLISMLDEVDRRYNHYCDQMQMVVNFFDSVMGFGAATPYTALAQKAMSRHFRCLKDAIAAQLRHTCELLGEKDAGTSSGLTKGETPRLRAIDQSLRQQRAFHHMGMMEQEAWRPQRGLPERSVSILRSWLFEHFLHPYPSDADKHLLARQTGLSRNQVSNWFINARVRLWKPMIEEMYQQETKELEGSSAAAGGGGGVGGPESGNDPSGADDLHSPTTTGSQQQLVIHHGGGRYGQQEHGMSGVHPHKLDPGAGPSVADAAFVGLDPAELLGGDAHVGAADDLYGRFEPGVRMRYGPATTGAVSGDVSLTLGLQHAGAGNQGPDGSGRFSLRDYNGC

SEQ ID NO: 1569 - DNA, 2073 bp, Sorghum bicolor
  misc_feature: Ceres ANNOT ID no.6098817
  misc_feature: Encodes the peptide sequence at SEQ ID NO. 1570
atggcggcgtactaccacggcggcgccggcacggacatccaggccagcaccgacggcctgcagacgctgtacctcatgaacccgagctacgccggctacgcggacgacggcggcgcgtccacggcgccgggggcgaccaacatgatgctcctcaactcggccgtgaccaccatgacgccggcgtccttcgcccaccaccaccagcagcagcagtcgccgtcgtcggccgcgcatcatcagcagcagcagcactttgtcggcatcccgctgcaggcgccgccgtcgggctacaacctgtggaccccggccacggtcgccgcggacatgtcgatgtcgtcgccaacgcaggcgcagactcccggcggcgccgcggcgggtggagtcagcgccgtgctcagcctgtcgtcccgcgaggcagcgccgccgccggtcacggtggccgcggtggccggccccggctgcaccgacgaggcgggcaagtaccacctgggcgtgtcggccacgtcgcaggggcagatggtgatgagctccaagtacctcaaggctgcgcaggagctgctcgacgaggtggtcagcgtcagcaagggcgtcgaggacgccaacaagacgacgaccaagagcctggcggcggtgaagaagaaggaggactcggagggggtgtccggtggcggcaccgaggacggttccggcgcaaagagcggcggcagcggcgcggcggagatgtccaccgcggagcggcaggagctgcagatgaagaagagcaagcttatcaacatgcttgacgaggtggagcagcggtaccggcagtaccacgggcagatgcaggcggtgtcgtcgtcgttcgaggcggcggcgggcgccgggtcggcgcggacgtacacggcgctggcgctgcgcaccatctcgcgtcagttccggtgcctgcgcgacgcgatcgcgtcgcaggtgcgcgccgcgagccgcgcgctgggcgaggacgcggacgccgccgtcgccgccggcggccgcaccgtcggctcccgcctccgctacatcgaccaccagctccggcagcagcgcgcgctccagcagctcggcatgatgcagggcggcgcctggcggccccagcgcggcctccccgagcgctccgtctccatcctccgcgcctggctcttcgaacacttcctgcacccataccccaaggattcggacaagatcatgctcgccaagcaaaccggcctcaccaggagtcaggtgtcgaactggttcatcaacgcgagggtgcggctatggaagcccatggtggaggagatgtacctggaggagaccaaggaccaggacggaggcggcaacgacgaggggaagtccggtggaggagggagcaagagcggggacactgtcgacggcgtcacgccgagggcggacgccatgtcgtccaagtccgcggtggtgcgcgtgggaggcggaggtggggcggcggagagcgcgtccaccaacaagggcatccatggctcctccctgctcgagctcggcggcggtggcgaccaccagcagtctcacgcggggttctacgacgacgatgaagacgacggcgacgacgcgatgggaaggaggctcaagaaggcgcgcggggacgagccgccggcgccggcgttccaccacgtgcacgacatggccgcgctgcacgcgcaggccgcggcggccgcgaggcagcagcacgaggaggtcagccaccgggagctgctcatgaagttcatggagagcggcggcggcggtggcgccggagcgagggaccaccaccaccatcacgacggcggcgggtactcgctgttcgcgccggggccgtacgggcagttcgccgcggagcccgccgcgttcgcgttcgccgggaacggcggggtgtcgctgacgctcggcctcccgcacggcgcggccggaggcagcgccgccgaacagaccgcgtcgttcctcatgggcagcaccacggccggcgccgacagcggcagccacggcgccggcgctggcggctacgacatgaacatgcagagcaccaagtcgttcgcggcgcagctcatgagggacttcgtggcctag

SEQ ID NO: 1570 - protein, 690 aa, Sorghum bicolor
  misc_feature: Ceres ANNOT ID no.6098817
  misc_feature: Bit score of 992.4 for HMM based on sequences of FIGURE 21.
  misc_feature (172)..(314): Pfam Name: POX Pfam Description: Associated with HOX
  misc_feature (390)..(425): Pfam Name: Homeobox Pfam Description: Homeobox domain
  misc_feature: Functional Homolog Of Ceres SEEDLINE ID no. ME19971 at SEQ ID NO. 1540
MAAYYHGGAGTDIQASTDGLQTLYLMNPSYAGYADDGGASTAPGATNMMLLNSAVTTMTPASFAHHHQQQQSPSSAAHHQQQQHFVGIPLQAPPSGYNLWTPATVAADMSMSSPTQAQTPGGAAAGGVSAVLSLSSREAAPPPVTVAAVAGPGCTDEAGKYHLGVSATSQGQMVMSSKYLKAAQELLDEVVSVSKGVEDANKTTTKSLAAVKKKEDSEGVSGGGTEDGSGAKSGGSGAAEMSTAERQELQMKKSKLINMLDEVEQRYRQYHGQMQAVSSSFEAAAGAGSARTYTALALRTISRQFRCLRDAIASQVRAASRALGEDADAAVAAGGRTVGSRLRYIDHQLRQQRALQQLGMMQGGAWRPQRGLPERSVSILRAWLFEHFLHPYPKDSDKIMLAKQTGLTRSQVSNWFINARVRLWKPMVEEMYLEETKDQDGGGNDEGKSGGGGSKSGDTVDGVTPRADAMSSKSAVVRVGGGGGAAESASTNKGIHGSSLLELGGGGDHQQSHAGFYDDDEDDGDDAMGRRLKKARGDEPPAPAFHHVHDMAALHAQAAAAARQQHEEVSHRELLMKFMESGGGGGAGARDHHHHHDGGGYSLFAPGPYGQFAAEPAAFAFAGNGGVSLTLGLPHGAAGGSAAEQTASFLMGSTTAGADSGSHGAGAGGYDMNMQSTKSFAAQLMRDFVA

SEQ ID NO: 1571 - DNA, 1974 bp, Sorghum bicolor
  misc_feature: Ceres ANNOT ID no.6039430
  misc_feature: Encodes the peptide sequence at SEQ ID NO. 1572
atggctacttattactcgagccagggcagtgaaagggactcacagaacatgtattctagagaacccagcaatgcatcctatcctatgtcgtcggctctagggaacttgctttatctgaacaatcctgcttctggaccatacacagagttcagtggcattctacagtcccagcagaattgcatggagatgcctgaacctggccatccttcagtgatgtcccaagactcatctgcaagggagtccgacatgcttggttcccaccagggtcagcgctctttcggcctagtcaaagatatgaagaacgagatgttgatgcatatgatggatgggtcacagagcagtacagctgatctcatccatgatgatgcccaaaatggtatccagcttgattttggtgttctgaacaaccacggctcgtcgaacattccctcagtgcaaggccaaggtttatctctcagcctcaacacacaaatcctggcaccttccttgccatactggtctgtcaaaccagatatgttgtcgccacactcttaccatgacagtcttcgagtcgatgacatccgaatgaagagtatgcagtctgagtcctcacgagcaatccggaactcaaggtatctgaaagcagcacaagagctgcttgatgaagttgtgaacgtttggaagaacattaagcagaaagcccagaaagaacaggtagaagcaggaaagacggatggcaaagagaccgagggagggccgaaaagtgagggtgtgtcctctaatccgcaggaatctggtgccaatgcagcaccggagctttctactgctgagaagcaagagcttcagaacaagatggcaaagctgatggcaatgttggatgaggtggaccggaaatacaagcactactaccatcaaatgcagagtgttgtttcgtcttttgatatggtagctgggcctggagctgccaagccttacactgcagttgctctccagacaatctcacgacacttccggtgcctgaaggatgctatcaatgatcagatcaatgtcatcaggaagaagctcggggaggaggaaagttcatctggcaaggagggcaaactaactcgtctccggtacatcgatcaacagctcaggcaacaacgagctttccaacagtatggcatgatcccacaaaatgcttggaggccacagagagggcttcctgaaaactctgttaccattcttcgtgcttggctctttgagcatttccttcacccgtaccctaaagattctgaaaaattgatgctagcaaggcaaacaggcttgacaaggagccagatttcaaactggttcatcaacgcccgtgtccgtctctggaaaccgatgatcgaggacatgtacaaagaagagattggagatatcgagcaagactccaactcttcctccgacaacacgccaagaagcaagggcaagatggtatcttctgaagacaaggaagacccgaggagttgtacgcctcgggtctgcgagagcagtcagctgagcgagtcaagaggcagcatgaggaccatgaacgccgtcggcggtggagcagccatgggattccagaacgagcccaaccctgacgacaccttcatgaacctgatgctgaaggaccaacgatcaaacggagaagaagatggcggcctcctcctccacaatgccgtggcgcagcatcaagatgagaacgcccggttcatggcgtaccacctggcggaacttgggaggtacgggaacggcaatgtgtcgctcaccctggggctgcagcactccagcagcagcagcctctcggttcccaacgcccagcagagctttcctggtgtcggtgtcggtgtcggagacgatgacatctacaacgccgccgccgctcccctcggtgtcagcgtggcgtcgtcggactacgagacgatgaaccagatggatcaacggcaacggttcgagcagtcaccccttctgcatgattttgtggcctga

SEQ ID NO: 1572 - protein, 657 aa, Sorghum bicolor
  misc_feature: Ceres ANNOT ID no.6039430
  misc_feature: Bit score of 1305.6 for HMM based on sequences of FIGURE 21.
  misc_feature (198)..(339): Pfam Name: POX Pfam Description: Associated with HOX
  misc_feature (412)..(447): Pfam Name: Homeobox Pfam Description: Homeobox domain
  misc_feature: Functional Homolog Of Ceres SEEDLINE ID no. ME19971 at SEQ ID NO. 1540
MATYYSSQGSERDSQNMYSREPSNASYPMSSALGNLLYLNNPASGPYTEFSGILQSQQNCMEMPEPGHPSVMSQDSSARESDMLGSHQGQRSFGLVKDMKNEMLMHMMDGSQSSTADLIHDDAQNGIQLDFGVLNNHGSSNIPSVQGQGLSLSLNTQILAPSLPYWSVKPDMLSPHSYHDSLRVDDIRMKSMQSESSRAIRNSRYLKAAQELLDEVVNVWKNIKQKAQKEQVEAGKTDGKETEGGPKSEGVSSNPQESGANAAPELSTAEKQELQNKMAKLMAMLDEVDRKYKHYYHQMQSVVSSFDMVAGPGAAKPYTAVALQTISRHFRCLKDAINDQINVIRKKLGEEESSSGKEGKLTRLRYIDQQLRQQRAFQQYGMIPQNAWRPQRGLPENSVTILRAWLFEHFLHPYPKDSEKLMLARQTGLTRSQISNWFINARVRLWKPMIEDMYKEEIGDIEQDSNSSSDNTPRSKGKMVSSEDKEDPRSCTPRVCESSQLSESRGSMRTMNAVGGGAAMGFQNEPNPDDTFMNLMLKDQRSNGEEDGGLLLHNAVAQHQDENARFMAYHLAELGRYGNGNVSLTLGLQHSSSSSLSVPNAQQSFPGVGVGVGDDDIYNAAAAPLGVSVASSDYETMNQMDQRQRFEQSPLLHDFVA

SEQ ID NO: 1573 - DNA, 1773 bp, Sorghum bicolor
  misc_feature: Ceres ANNOT ID no.6068141
  misc_feature: Encodes the peptide sequence at SEQ ID NO. 1574
atggccacattcttctccacttccacgaatcagagggacctcaccggaggcggcggcgacatgtcgttccaccactacacctactcagactcaccagccggcggcctcatgcctttccccgccaccatcgtgtcggaaggccacgtcgcgcatggcggtgacgacggcagggacgagccggccgcgttcgtgaacgtgaacgtaaacgcaagggacgggacgacgagcggcgccgagatgggcctgcagacgcagctgctcatggcgaacgcgtcggcggcggtgcagcaccaggggctgtcgcttagccttggcacgcagggagtgccggtgtctctttaccagtaccgccaggcgcagcaggcaggcatggccgccgccgcctccttgctaagcccgaaccaggcgtcggcggcggcgagcaggaacgcgcagagcatctacatccagaactccaagtacctcaaggccgcgagggagctgctggacgaggtggtcaatgtccgggacgcgatcaagcggaagggggcggacaagaaccagcagggtaaggattccggcggcgagggcaaggacgccgagacgagcgacgacaaggccgacgagcacgaagggaactcctccgcggcggagctgacaccgtccgagaggcaagatctccagaacaaagtgtcggcactgatggcgctgctggatcaggtggaccgcaagtacaggcactaccaccaccagatgcagatcgtgatgtcgtccttcgacgcggtggccggcgccggcgcggcgaggccgtacacggcgctggcgctgcagaccatctcccgtcacttccggtcgctgcgtgacgccgtgggcgcgcaggtgcagtcgctgcggcggagcctgggcgagaaggacacctcggcgcacggcggcgggctgtcccggctccgctacatcgaccagcagctgcggcagcagcgcgccatgcagcagttcggcatgatgcagcagccgcagcacgcgtggcgcccccagcgcggcctcccggagtccgccgtctccgtgctccgcgcctggctcttcgagcatttcctccacccgtacccgaaagattcggagaagctgatgctcgctaggcagacaggcttgtctaggggtcaggtgtccaactggttcatcaacgcgcgagttcgtctgtggaagccgatgatcgaggagatgtacaaggaggaattcggggcggagatggactcgcactcgtcgtcggagaacgcggcgggcaacaagggcaaggcggacgaggcgatatcctcggaggaccacgacgagttccagagcccgtcgagcgccgctgcaaagcacggcgctgcagcaggtcaccacctcagcgcgttcaagtcggaggcgatcggtggcatggacgccgccggcgtcggcgtcggcgtcggcctgtccagcctcgacggcgccattggcccgtacgcgaccagcctcaacctcggcgctgctgtcgtcggcaacggcctgcaggaggccttcgcgcaccaccacggcggtggagacgcgaggttcgtgcaggcgtacggcgacatggccggcctcggcggctacgacggcggcagcgtgtcgctgacgctgggcctgcagcactgcaacgacgccggcgccgtgcccgccgagcagcagggcggtctcctgtacggcaacgccggcgacttcgagttcatcaacggctccgccgaggacaggcagcggttcggctcgtcgcagctgctgcacgattttgtcgcgtga

SEQ ID NO: 1574 - protein, 590 aa, Sorghum bicolor
  misc_feature: Ceres ANNOT ID no.6068141
  misc_feature: Bit score of 507.8 for HMM based on sequences of FIGURE 21.
  misc_feature (147)..(285): Pfam Name: POX Pfam Description: Associated with HOX
  misc_feature (336)..(394): Pfam Name: Homeobox Pfam Description: Homeobox domain
  misc_feature: Functional Homolog Of Ceres SEEDLINE ID no. ME19971 at SEQ ID NO. 1540
MATFFSTSTNQRDLTGGGGDMSFHHYTYSDSPAGGLMPFPATIVSEGHVAHGGDDGRDEPAAFVNVNVNARDGTTSGAEMGLQTQLLMANASAAVQHQGLSLSLGTQGVPVSLYQYRQAQQAGMAAAASLLSPNQASAAASRNAQSIYIQNSKYLKAARELLDEVVNVRDAIKRKGADKNQQGKDSGGEGKDAETSDDKADEHEGNSSAAELTPSERQDLQNKVSALMALLDQVDRKYRHYHHQMQIVMSSFDAVAGAGAARPYTALALQTISRHFRSLRDAVGAQVQSLRRSLGEKDTSAHGGGLSRLRYIDQQLRQQRAMQQFGMMQQPQHAWRPQRGLPESAVSVLRAWLFEHFLHPYPKDSEKLMLARQTGLSRGQVSNWFINARVRLWKPMIEEMYKEEFGAEMDSHSSSENAAGNKGKADEAISSEDHDEFQSPSSAAAKHGAAAGHHLSAFKSEAIGGMDAAGVGVGVGLSSLDGAIGPYATSLNLGAAVVGNGLQEAFAHHHGGGDARFVQAYGDMAGLGGYDGGSVSLTLGLQHCNDAGAVPAEQQGGLLYGNAGDFEFINGSAEDRQRFGSSQLLHDFVA

SEQ ID NO: 1575 - DNA, 1950 bp, Sorghum bicolor
  misc_feature: Ceres ANNOT ID no.6033916
  misc_feature: Encodes the peptide sequence at SEQ ID NO. 1576
atggctacttattactcgagccctggtagtgaaagagattcacaaacaatgtactcaacagagtcaggcaatgcatcatatccggtgccatcagccctagggaacttcctttatccaaacaatgcatcttctgggccttatacagaatttagtggaattgtgcagcctcagcagaatttcatggaacttactggtcatccttcagcaatgtcgcatgattcatcatccaatgaagctactaacatgagtacttcactcacagagcagcgctcttttggtcctttgaaagatatgagaaatgagatgttgatgcatttgatggatggagcacacagcagtggcagtgatctcatccacaatgatgcccatagcactgcacaacttgagtttggcatgttaaacaaccacaactcaagtgttccatcagcaccaggccaagggctgtctctgagcctcaatacgcatatcttggcgccttcctatccatactggtctgcaaagcaagatttactgacaccaaattcttaccagggtgatgacaacagaatgaagaatatgcagtctgaggcctcacaggcaatccggaactctaagtatctgaaggcagcacaggagttgcttgatgagattgtcagtgtttggaagagtgttaaacagaaaacagataaaggccctgctgaagcaggaaaggcagatggaaaagagactgatggggggactaaaagtgatggagtatcttccgatccacaagagtctggtgccaatgcagcagctgagctttcaactgctgagaaacaagagctccagaataagatggcgaaacttatggcaatgttagacgaggtggatcgaaagtacaaacactattatcatcagatgcaacttgtaatgtcatcgttcgatatggttgctggttctggagctgccaagccttataccgcagttgccctccagacaatctcacggcatttccgatgtctaaaggatgctatcaatgatcaaattagtgttatccggaagaaacttggagaggatgacactacatctggcaaagagggcaaactaactcgccttcgttatatcgatcagcaaataaggcaacagcgagctttccaacagtatggtatgctacagcaaaatgcttggaggccacagaggggactacctgaaaattcagtctcgattctccgggcttggctttttgaacacttccttcacccgtatccaaaagattccgaaaagataatgttatcgagacaaactgggttaacaagaagtcagatttcaaattggttcatcaatgcccgtgtccggctgtggaagccaatgatcgaagacatgtacaaagaagagattggtgaggcagagctagactccaactcttcctctgacaatgggcagcgaaacagggacaaagcaccatcttcggaagaaaaggaggacctgaagacctcgacaagccaggtttgccaaaccagccagcttgacgaatccaaagccagcgttggtggaatgatgagctttagtggagcgccagctggcggcttccacaacgaggccaaccccgatgacagcttcatgagcctgatgctgaaggcccagagagcgggtgaaactgatggcagcggttttctccatgatgccgtcgcccatcactcggatgagagcgcgcggttcatggcttaccacatggcagagtttgggaggtacggaaacaacaacgtctcactgacgctgggtttgcagcacgccgagaacagcctttcagtcccaccaaacacccagccaggcttccccggcgtccgagaccaagacatctacaacgccacagctcctctcaacgtcgcctccacatcttcagagtatgattcggcaagccaaatagatcaacaacaacaacaacggcagcggtttgagccgtcacctctgatgcatgatttcgtggcctga

SEQ ID NO: 1576 - protein, 649 aa, Sorghum bicolor
  misc_feature: Ceres ANNOT ID no.6033916
  misc_feature: Bit score of 1310.4 for HMM based on sequences of FIGURE 21.
  misc_feature (192)..(333): Pfam Name: POX Pfam Description: Associated with HOX
  misc_feature (406)..(441): Pfam Name: Homeobox Pfam Description: Homeobox domain
  misc_feature: Functional Homolog Of Ceres SEEDLINE ID no. ME19971 at SEQ ID NO. 1540
MATYYSSPGSERDSQTMYSTESGNASYPVPSALGNFLYPNNASSGPYTEFSGIVQPQQNFMELTGHPSAMSHDSSSNEATNMSTSLTEQRSFGPLKDMRNEMLMHLMDGAHSSGSDLIHNDAHSTAQLEFGMLNNHNSSVPSAPGQGLSLSLNTHILAPSYPYWSAKQDLLTPNSYQGDDNRMKNMQSEASQAIRNSKYLKAAQELLDEIVSVWKSVKQKTDKGPAEAGKADGKETDGGTKSDGVSSDPQESGANAAAELSTAEKQELQNKMAKLMAMLDEVDRKYKHYYHQMQLVMSSFDMVAGSGAAKPYTAVALQTISRHFRCLKDAINDQISVIRKKLGEDDTTSGKEGKLTRLRYIDQQIRQQRAFQQYGMLQQNAWRPQRGLPENSVSILRAWLFEHFLHPYPKDSEKIMLSRQTGLTRSQISNWFINARVRLWKPMIEDMYKEEIGEAELDSNSSSDNGQRNRDKAPSSEEKEDLKTSTSQVCQTSQLDESKASVGGMMSFSGAPAGGFHNEANPDDSFMSLMLKAQRAGETDGSGFLHDAVAHHSDESARFMAYHMAEFGRYGNNNVSLTLGLQHAENSLSVPPNTQPGFPGVRDQDIYNATAPLNVASTSSEYDSASQIDQQQQQRQRFEPSPLMHDFVA

SEQ ID NO: 1577 - DNA, 2313 bp, Sorghum bicolor
  misc_feature: Ceres ANNOT ID no.6034399
  misc_feature: Encodes the peptide sequence at SEQ ID NO. 1578
atgggcatagcggcgccaccgtaccagcagaccatcaccacgtacgtgagccaacccaccaagagcagcgcagcgatctccgcctccgcccgggcggctaccgcgacgtctatgtcccactcccagggattccaccaccaggccagcagcggcgtctacggctactcctctgatggcttcgaccgcccggactccagccaccaccagcaggatcaccatcagcagcagcacgagcacgtggcgcagcagagccgccgcgacaagctgagggtgcaggccggcttcgacccggccgccgccgccgggcacggcctgctccctatcgacggcggcgacgaccatggcggccccgggtccatatacgagcaagcggcggcggccgccggggcctccaacatgctctccgagatgttcaacttccccgcgccgccttcgggtccctccgccaccgagctgctggccagccagatgagcgccaactaccgcttcgggctacggcaacagcagcaggccgggcccggaggggtggccggcttgtccggcggcgacggcggttggttcgggaccggcgcggcgggtcgtgctggcttggtcctcggtggggccagcatgggctcgttaggtgaaacgtcgtccccgaagcagcagcaagcaggcagcatggctggcctggccaccgacccggccgccgcgatgcagctcttcctcatgaacccacagcagcagcagcagcagtctagatcgtcgccgacgtcgccgccgccgtcggacgtgcagcaccacgaggcgttccaggcgttcggcgccgccgccggggccgcgttcggtggcgccgggaccggcgtcgtggaaggccagggtctgtccctctcgctgtcgccgtcgctacagcagctggagatggcgaagcaggccgaggagctgagggtccgggacggcgtgctctacttcaaccggcagcaacagcagcagggcccgacgtcggtgcagcagcagcagctgccgatggcattgcacggccaggtcggcgcgctggggcagcagctgcacgtcggatacggccccgcgggcgtcgcgggcgtgctgcgcaactccaagtacacccgcgcggcgcaggagctcctggaggagttctgcagcgtcgggcgcgggcagatcaagggcggcgcgcggggcgggcgtggggcctcggcgtccaaccctaacgccagcaataagcagggcggcgcctccagctccggcgccgcgcagtcgccgtcgtccgcgtccaaggagccccctcaactgtcccccgccgaccggttcgagcaccagcgcaagaaggccaagctcatctccatgctcgacgaggtggaccgtcggtacaaccactactgcgaccagatgcagatggtggtgaacttcttcgactcggtgatggggttcggcgcggcgacgccgtacacggcgctggcgcagaaggccatgtcgcggcacttccggtgcctcaaggacgccatcgcggcgcagctgcggaccacgtgcgagctgctcggggagaaggacgccggcaccagctccgggctcaccaagggcgagaccccgcggctgcgcgccatcgaccagagcctccggcagcagcgcgccttccaccacatgggaatgatggagcaggaggcctggaggccccagcgcggcctccccgaacgctccgtcaacatcctccgatcctggctcttcgagcacttcctgcacccgtacccgagcgacgccgataagcacctgttggcgaggcagaccgggctgtccaggaaccaggtctccaactggttcatcaacgcccgtgtccggctatggaagcccatgatcgaggagatgtatcagcaggagtgcagggagctcgagggttcctcggccggcggcgggggcggccccgagtccggcaacgacccctccggcgccgacgactcgcactctccgaccaccaccggcgcagcgcagctcccgcaacagcaacagcagcacggcacaatgcccggagtgatgatgccccacaagcccgacccgagcgccgcgggtccttcggctgcggacgcggcgttcgtcgggatcgacccggtggagctcctcggcggcgacgcgcacgtgggcggtggcgcggacgacctgtacgggcggttcgagcccggggtgagggtgcggtacgggcccgctgcggcaggcgcggccgccggcgacgtgtctctgacgctaggcctgcagcacgccggcgccggcaacgccgggcccgacagcaccgggcggttctccttgagagactacagcggttgttga

SEQ ID NO: 1578 - protein, 770 aa, Sorghum bicolor
  misc_feature: Ceres ANNOT ID no.6034399
  misc_feature: Bit score of 311.0 for HMM based on sequences of FIGURE 21.
  misc_feature (360)..(502): Pfam Name: POX Pfam Description: Associated with HOX
  misc_feature (555)..(613): Pfam Name: Homeobox Pfam Description: Homeobox domain
  misc_feature: Functional Homolog Of Ceres SEEDLINE ID no. ME19971 at SEQ ID NO. 1540
MGIAAPPYQQTITTYVSQPTKSSAAISASARAATATSMSHSQGFHHQASSGVYGYSSDGFDRPDSSHHQQDHHQQQHEHVAQQSRRDKLRVQAGFDPAAAAGHGLLPIDGGDDHGGPGSIYEQAAAAAGASNMLSEMFNFPAPPSGPSATELLASQMSANYRFGLRQQQQAGPGGVAGLSGGDGGWFGTGAAGRAGLVLGGASMGSLGETSSPKQQQAGSMAGLATDPAAAMQLFLMNPQQQQQQSRSSPTSPPPSDVQHHEAFQAFGAAAGAAFGGAGTGVVEGQGLSLSLSPSLQQLEMAKQAEELRVRDGVLYFNRQQQQQGPTSVQQQQLPMALHGQVGALGQQLHVGYGPAGVAGVLRNSKYTRAAQELLEEFCSVGRGQIKGGARGGRGASASNPNASNKQGGASSSGAAQSPSSASKEPPQLSPADRFEHQRKKAKLISMLDEVDRRYNHYCDQMQMVVNFFDSVMGFGAATPYTALAQKAMSRHFRCLKDAIAAQLRTTCELLGEKDAGTSSGLTKGETPRLRAIDQSLRQQRAFHHMGMMEQEAWRPQRGLPERSVNILRSWLFEHFLHPYPSDADKHLLARQTGLSRNQVSNWFINARVRLWKPMIEEMYQQECRELEGSSAGGGGGPESGNDPSGADDSHSPTTTGAAQLPQQQQQHGTMPGVMMPHKPDPSAAGPSAADAAFVGIDPVELLGGDAHVGGGADDLYGRFEPGVRVRYGPAAAGAAAGDVSLTLGLQHAGAGNAGPDSTGRFSLRDYSGC

SEQ ID NO: 1579 - DNA, 1881 bp, Sorghum bicolor
  misc_feature: Ceres ANNOT ID no.6068617
  misc_feature: Encodes the peptide sequence at SEQ ID NO. 1580
atggcgcacgatcccagtctgggcttcgcggactacttctcggcagcggcggcggctggcgccacggcgatggacgacgacgacgtcggggcgccggagctctatggcttgcacgccgacatggagttcctcggcatgcgtggcctggccgccatgcccgccgcggcccaccaccaccaccaccacggccacggccacagcaaggccggtgtgctcgtcgacgacgacgcggggccagacggcagcggctccaacacggacgacgccaccatgcgattcctgagcgagcagcagcatcatccgagtcaccagcaggcgccgctgtcgctatcgctgtgccggccggacggtggtggcgtgggcgtgacgacgtcgttgcacgagcaacaacaacaactcggcggcggctcgtcccggcaccatcagcagcagcatccggcgccgcccgcggcgtggatgcagcagcacgactactcgccgcagccgcagcacgcgtggcacctgcgcggctccaggttcctcgtccccgcgcagcaggtcctgcaggagttctgcagcctccccgtggacagcagcagcgccgccgcttccagcaagcgcgcctccaagccgtcctcgcaccagcagcaagaagacggcggagaggggtcgtcgtcgtcggcctcctgggcgccgtcgctgcagatccaggccatggacgcgctggagctgcagcggctcaaggacaagctctacatcatgctggaagaggtggaccggagataccggcggtactgcgagcagatgcgtgcgctggcgggcgggttcgaggcggtggccggggagcgcgcggcggcggcgtacacggcgctggcgtcgcgcaccatctcgcggcacttccggagcctccgtgacggcgtggtggcgcagctgcaggcggcgcggagggcgctcggggagaaggacgtggcggtgcccgggatgacgcgcggggacacgccacggctgagggtgctggaccagtgcatccgccagcagaaggcgctcacccaggccggcatggtggaggcccacccgtggcgaccccagcgcggactccctgagcgcgcagtcaccatcctccgggcatggctcttcgagcacttcctgcacccgtatccaagcgacgtggacaagcatatcctggctcgccagacgggcctctcacggagccaggtgtccaactggttcatcaatgcgcgggtcaggctctggaagccaatggtggaggagatgtacgtcgaggagatgaaggctgaaggccagctggaagacggcggcggcggggaccagcagcagggccagggcgtcagcaacaaccctaaccctagcaacgccgccgccgaggcggctgatgatggctgcggggacaacggcgccgtcgtcgtcgaccggaagccgacgcgggcgcagctcctgcacgacgcgggctcgctcgcctccgtcgtcaacatcggcagcggctcacgcgcgggcgccgcagcgcggccgctcgagaacttcggcatcgtggaccacctcgacttcgacgcgtacggcggcggccaccacgccggcgggggcttcggcggcggcgtgtcgctcacgctgggcctgcagcagcacgactcccacgacggcggcgtcaacatcgcgttcggcgcgccgccgacgcccgcacaccaccacggcggcgccgcggggtacctgttcgctccgacgacgacggccggccatcagatgggcggcggcctgcacccggggcagcaacaccacgtccagttcggcggcgccagcatcgacggcgaggcggcgcacgggcaggagcattaccggggccttcagggcgccgggtttcacctcctgcgtgacctggccgggtga

SEQ ID NO: 1580 - protein, 626 aa, Sorghum bicolor
  misc_feature: Ceres ANNOT ID no.6068617
  misc_feature: Bit score of 209.4 for HMM based on sequences of FIGURE 21.
  misc_feature (166)..(302): Pfam Name: POX Pfam Description: Associated with HOX
  misc_feature (354)..(412): Pfam Name: Homeobox Pfam Description: Homeobox domain
  misc_feature: Functional Homolog Of Ceres SEEDLINE ID no. ME19971 at SEQ ID NO. 1540
MAHDPSLGFADYFSAAAAAGATAMDDDDVGAPELYGLHADMEFLGMRGLAAMPAAAHHHHHHGHGHSKAGVLVDDDAGPDGSGSNTDDATMRFLSEQQHHPSHQQAPLSLSLCRPDGGGVGVTTSLHEQQQQLGGGSSRHHQQQHPAPPAAWMQQHDYSPQPQHAWHLRGSRFLVPAQQVLQEFCSLPVDSSSAAASSKRASKPSSHQQQEDGGEGSSSSASWAPSLQIQAMDALELQRLKDKLYIMLEEVDRRYRRYCEQMRALAGGFEAVAGERAAAAYTALASRTISRHFRSLRDGVVAQLQAARRALGEKDVAVPGMTRGDTPRLRVLDQCIRQQKALTQAGMVEAHPWRPQRGLPERAVTILRAWLFEHFLHPYPSDVDKHILARQTGLSRSQVSNWFINARVRLWKPMVEEMYVEEMKAEGQLEDGGGGDQQQGQGVSNNPNPSNAAAEAADDGCGDNGAVVVDRKPTRAQLLHDAGSLASVVNIGSGSRAGAAARPLENFGIVDHLDFDAYGGGHHAGGGFGGGVSLTLGLQQHDSHDGGVNIAFGAPPTPAHHHGGAAGYLFAPTTTAGHQMGGGLHPGQQHHVQFGGASIDGEAAHGQEHYRGLQGAGFHLLRDLAG

SEQ ID NO: 1581 - DNA, 1497 bp, Sorghum bicolor
  misc_feature: Ceres ANNOT ID no.6026318
  misc_feature: Encodes the peptide sequence at SEQ ID NO. 1582
atggccgtccatcacccacacctgctcgacttctcgccacctccgaacacggtggccatggaggcgccgcccgcaccccacttcgaccatggtggccaccaccaccaccacctcctcgggctccatgtcgacggcggcgtcggcatgtccgtaggaggaggcgtgcctcaccgcgccctcgccgacgacgacacggtggcagcatgggcgccgcaggccgcggtctccctgtccttgtacaactacgacaacacggcgggaggttcgtcgtcgtcgctgttcggccatgacgagccacagttcggcgccatgcccccggcggcggcgttggcactgcctaaccaccagcagctgccgacgacgacgtcgagcatgcagcagccgttccagctcaggagctccaagtatctggcccccgtgcaggacctgctcagcgagttctgcagccttgaaggggacctgctgcacgccatgaacaagagagctccgagagcaggcaacaagtgggacgacgtggagacgtcgtcgtcttcctctggcctctgggggcacccgtccctgagctccatggatctcttggagcttgagaggcggaaggccaggctcttgtccatggttgaagaggtggacaggcggtaccggcgataccgtgagcagatgagggcagtggaggtgtcgttcgaggcggtggccggagccggcgcgtcgcaggtgtacacaaggttggcgctgcgcgccatgtcgcggcacttccggtgcctgcgggacgcgctggtggcgcaggtccgcgcgctgaggaaggccatgggggagcgggacggcggacctggtgcggcggcggcggcgacggcggcgggcgccaccaagggcgacacgccgaggctcaaggtgctggaccagtgcctgcggcagcagcgggcgttccagcaccccggcaccatcgagaactacccctggcgaccccagcgcggcctgccggagcgcgccgtcgccgtcctccgtgcctggctcttcgagcacttcctccacccgtatccaaatgatgtggacaagcacattctggcgcgccagacaggattgtcaagaagccaggtttccaattggttcatcaacgccagggtgaggttgtggaagccaatgatagaggagatgtacacggaagaagtcaaccagaaatcaaacgcgactccgcaaaaccctagcggcggcggcgtcatcaaacctgagcagatgagcacaacggcggtgcccgccgccattggaggagatcatagccacttcctatgcggtggcgaccatctgttcagtagttatccgagcatgcataggagtcacggcggcgccgtgtcgcttaccctagggctccaacagcagccgtttgtgtcgacgatgatgcaccaccagcgaccattgatgttgcatggtgacgagcaagagccggtgctgccgtacagagaccttatggggtctcagttgctgcatgatttcgcagggtag

SEQ ID NO: 1582 - protein, 498 aa, Sorghum bicolor
  misc_feature: Ceres ANNOT ID no.6026318
  misc_feature: Bit score of 158.3 for HMM based on sequences of FIGURE 21.
  misc_feature (129)..(260): Pfam Name: POX Pfam Description: Associated with HOX
  misc_feature (320)..(378): Pfam Name: Homeobox Pfam Description: Homeobox domain
  misc_feature: Functional Homolog Of Ceres SEEDLINE ID no. ME19971 at SEQ ID NO. 1540
MAVHHPHLLDFSPPPNTVAMEAPPAPHFDHGGHHHHHLLGLHVDGGVGMSVGGGVPHRALADDDTVAAWAPQAAVSLSLYNYDNTAGGSSSSLFGHDEPQFGAMPPAAALALPNHQQLPTTTSSMQQPFQLRSSKYLAPVQDLLSEFCSLEGDLLHAMNKRAPRAGNKWDDVETSSSSSGLWGHPSLSSMDLLELERRKARLLSMVEEVDRRYRRYREQMRAVEVSFEAVAGAGASQVYTRLALRAMSRHFRCLRDALVAQVRALRKAMGERDGGPGAAAAATAAGATKGDTPRLKVLDQCLRQQRAFQHPGTIENYPWRPQRGLPERAVAVLRAWLFEHFLHPYPNDVDKHILARQTGLSRSQVSNWFINARVRLWKPMIEEMYTEEVNQKSNATPQNPSGGGVIKPEQMSTTAVPAAIGGDHSHFLCGGDHLFSSYPSMHRSHGGAVSLTLGLQQQPFVSTMMHHQRPLMLHGDEQEPVLPYRDLMGSQLLHDFAG

SEQ ID NO: 1583 - DNA, 1905 bp, Sorghum bicolor
  misc_feature: Ceres ANNOT ID no.6107650
  misc_feature: Encodes the peptide sequence at SEQ ID NO. 1584
atggcgcatgacgagcaagcaggcctagcgtacgcggactacttcgcggcggcggcggccgccggcgccgtggcgacgctcgtgccggaggtggacgacgacgccgtcgccggggccggggaggaggaggaggatcttcacctctacggcgtgcaccaccagcatggggtcgagttgttcgggcccagcaggggccacatgctgcctgccgcgacgatgatggccggcggccacgctgccgctgcggcgcacggcaaggccgccgcgctcggtctcgtcgacgtcgacgtcgcttctcccgtcgtcggcgggcacgactttggcgaccaccaccaccggcagcagggtctccaggcgccgctgtcgctggcgctgcaccaccaccaccaccagcagcagctcggcggcggcggcgtgccacggcataaccagctgtcggcggcgtggccaggcccacagcagcagcaggggcagggcgcggcgtggcacctccgtggctccagattcctgcgcccgacgcagcagctcctgcaagaattctgcacccttcccgtcgacaccaccaccacagctgctgcttccaagcagccagccagcgaggacggcgtcggcgtcggctcctcgacctcggccccgtcggcgcagatccatgccatgagtgcgtccgagctgcagaggctcaaggccaagctctacgccatgctccaagaggtggagaggagataccggaggtaccgggagcagatgagggcggtggcggggtccttcgaggcggtggccggagagcaggcggcggtggcgtacacgaggctggcgtcgcggaccatatccaagcacttccggagcctgagggatggcgtggcggcgcagatgcaggtggtgcgccgggcgctcggcgagaaggacgcggacggcggtgttccggcggccggcgggatggtcaagggggagacgacgcccaggctgcgggtcatcgaccagtgtctgaggcagcacagggcgtaccaggccggcgtgctcgagagccagccgtggaggccgcagcgcgggctgccggagcgcgccgtctccatcctccgggcctggctgttcgagcacttcttgcacccgtatccaagcgacgtggataagcacatcctggcgcgccagacgggcctatcacgcagccaagtctccaactggttcatcaacgcgagggtcaggctgtggaagccgatggtggaggagatgtactcggaggagatgaaggacccgcaggagggcggcggcggcgccgcctgcagcaacgcgaacaacaacagcgtgaacactagcagctacacgtccgagctagggcagcagcagctggggcacgggggtggcgccagtggcgtggacggccgcggcggcgagcggaagccgacgcgggcgcagctgctggtccacgacgccgggtcgctagcgtcggtcgtcagtattggaagcagcagcagggaccagcagcagcagatgagcagcatcaattttggcatgatggaccacctcgacttcgacgcgtacaatgacgaccccaccgcggccggccccggcgggccagccggtgggttcggtgccggtggttccggcggcgtgtcgctcacgctcgggctgcagcatcagcacgccgacgacccgcacggcggcgtgaacatcgcgttcgccggcgccgctccgtcggcggcgcacgagttcctgttcatggcaggcggcggcgagcagcagatggtcgcgggtggcgccgtgcacccgtcccacggacacggacacggtcaccacggtcagttctcggccgccggcatgcaaggcgacggcgtgccctcctcgcactaccaccggggcctcagcgccgccaccgggttccagctcctccacgacctggctggctga

SEQ ID NO: 1584 - protein, 634 aa, Sorghum bicolor
  misc_feature: Ceres ANNOT ID no.6107650
  misc_feature: Bit score of 216.2 for HMM based on sequences of FIGURE 21.
  misc_feature (162)..(289): Pfam Name: POX Pfam Description: Associated with HOX
  misc_feature (346)..(404): Pfam Name: Homeobox Pfam Description: Homeobox domain
  misc_feature: Functional Homolog Of Ceres SEEDLINE ID no. ME19971 at SEQ ID NO. 1540
MAHDEQAGLAYADYFAAAAAAGAVATLVPEVDDDAVAGAGEEEEDLHLYGVHHQHGVELFGPSRGHMLPAATMMAGGHAAAAAHGKAAALGLVDVDVASPVVGGHDFGDHHHRQQGLQAPLSLALHHHHHQQQLGGGGVPRHNQLSAAWPGPQQQQGQGAAWHLRGSRFLRPTQQLLQEFCTLPVDTTTTAAASKQPASEDGVGVGSSTSAPSAQIHAMSASELQRLKAKLYAMLQEVERRYRRYREQMRAVAGSFEAVAGEQAAVAYTRLASRTISKHFRSLRDGVAAQMQVVRRALGEKDADGGVPAAGGMVKGETTPRLRVIDQCLRQHRAYQAGVLESQPWRPQRGLPERAVSILRAWLFEHFLHPYPSDVDKHILARQTGLSRSQVSNWFINARVRLWKPMVEEMYSEEMKDPQEGGGGAACSNANNNSVNTSSYTSELGQQQLGHGGGASGVDGRGGERKPTRAQLLVHDAGSLASVVSIGSSSRDQQQQMSSINFGMMDHLDFDAYNDDPTAAGPGGPAGGFGAGGSGGVSLTLGLQHQHADDPHGGVNIAFAGAAPSAAHEFLFMAGGGEQQMVAGGAVHPSHGHGHGHHGQFSAAGMQGDGVPSSHYHRGLSAATGFQLLHDLAG

SEQ ID NO: 1585 - DNA, 1134 bp, Arabidopsis thaliana
  misc_feature: Ceres SEEDLINE ID no.ME20871
  misc_feature: Predicted Sequence
  misc_feature: Encodes the peptide sequence at SEQ ID NO. 1587
atgccgggggaacaaaccggagaaactccgacggtggccggagttggcggcggtggagctggttgtagcgccgggaatagtggtggaagtagtggatgtggtgctggtggtggcggtggtggtagtggtggaggtggtggcggaggaggagattcacagaggtcaattccgacgccgtttttgacgaaaacgtatcagcttgtggaagatccggtttacgacgaattgatctcgtggaacgaagatggaaccacttttattgtgtggcgaccagctgaattcgctagagatcttcttcccaaatacttcaaacataataacttctcgagttttgttcgtcagctcaatacttacggatttcgaaaagtagttccagatcgttgggagttttctaatgattgttttaagagaggtgagaagattctgcttcgggatattcaacggcggaaaatctctcagcctgctatggccgcggctgctgcagcggcggcggcagccgtagcggcttcggctgttacagtagcagctgttcctgttgtagctcatattgtttctccatcgaactctggagaagaacaggttatatcgtctaattcttcgcctgcggctgctgctgctgctataggaggagtggttggtggtggttctttgcagaggacaacgagctgcaccactgcaccagagctggttgaggagaatgagcgattgaggaaagataatgagcgattgaggaaagagatgacaaagcttaaaggattgtatgcgaatatctacacattaatggcgaatttcacaccgggtcaagaagattgtgcgcatttgttacctgaagggaaacctttagatcttttaccggagagacaagagatgagtgaagccattatggcttctgaaatagagacagggattggtctgaaacttggtgaggatttgactccaaggttgtttggggtttctattggggtcaagcgagctagaagagaagaagaattgggtgctgcagaggaagaagatgatgatagacgagaagctgctgcccaagagggagaacaaagttctgatgttaaggcagagccaatggaggagaataactccggtaaccataatgggtcgtggcttgaactcggaaaatga

SEQ ID NO: 1586 - DNA, 2049 bp, Arabidopsis thaliana
  misc_feature: Ceres SEEDLINE ID no.ME20871
  misc_feature: Genomic Sequence
  misc_feature: Expected Sequence
  misc_feature: Encodes the peptide sequence at SEQ ID NO. 1587
atcaatacgttcctctcagaacattctggaacttcacaacataatctctctctctctctatctctagcttcgtgatcatcgtgtgtctctgtgttcaatctggattgtgacaatctctttctttcttggttggtgtagattacgtcaagagagagatagagaagtttttggatttggttctaatgggtctgtgatagacgtttcctttctcttctctgtctagtttctgttttgagatctctatgtttccaactttcttcaaagctcattcccattggtagatttcatcattatcttaatttgggtattgggattaaggaaagtttagatttttgatctataactcatgccgggggaacaaaccggagaaactccgacggtggccggagttggcggcggtggagctggttgtagcgccgggaatagtggtggaagtagtggatgtggtgctggtggtggcggtggtggtagtggtggaggtggtggcggaggaggagattcacagaggtcaattccgacgccgtttttgacgaaaacgtatcagcttgtggaagatccggtttacgacgaattgatctcgtggaacgaagatggaaccacttttattgtgtggcgaccagctgaattcgctagagatcttcttcccaaatacttcaaacataataacttctcgagttttgttcgtcagctcaatacttacgtgagtctcaatatacgtttgaatcgaaattttcagttattaggttttttagtagtgagctcttattttggtttattattggttttagggatttcgaaaagtagttccagatcgttgggagttttctaatgattgttttaagagaggtgagaagattctgcttcgggatattcaacggcggaaaatctctcagcctgctatggccgcggctgctgcagcggcggcggcagccgtagcggcttcggctgttacagtagcagctgttcctgttgtagctcatattgtttctccatcgaactctggagaagaacaggttatatcgtctaattcttcgcctgcggctgctgctgctgctataggaggagtggttggtggtggttctttgcagaggacaacgagctgcaccactgcaccagagctggttgaggagaatgagcgattgaggaaagataatgagcgattgaggaaagagatgacaaagcttaaaggattgtatgcgaatatctacacattaatggcgaatttcacaccgggtcaagaagattgtgcgcatttgttacctgaagggaaacctttagatcttttaccggagagacaagagatgagtgaagccattatggcttctgaaatagagacagggattggtctgaaacttggtgaggatttgactccaaggttgtttggggtttctattggggtcaagcgagctagaagagaagaagaattgggtgctgcagaggaagaagatgatgatagacgagaagctgctgcccaagagggagaacaaagttctgatgttaaggcagagccaatggaggagaataactccggtaaccataatgggtcgtggcttgaactcggaaaatgaaaaacacttgccgattcagaggcattgttgaatatgcaagaaactgttactgatccccattgcataggcaagccattgcgctgtcccggacggaaaatggggatgtgttcggtcataagaggacagatgttcattgagttggggtagtacaaaagtatctaaaaacactgattctaccatcctgagttgttcctgatttcagatgttgcctcctgaatcttcttcttgatggaactgaaactattctggcttgctgtgctccagtgagtggatgtgcttctcacgatttcggataaagcaggcagattcaatgttacatcttcatattctgcaacaaatagcaggaatcaatggtttttaagagttatggcaatgttgatacagaatcatttcttttgagttcaaaacaattgtagctctctgacttgtaatgatcttaatgaaatttatctctcttatttaaagatggtccaagttctct

SEQ ID NO: 1587 - protein, 377 aa, Arabidopsis thaliana
  misc_feature: Ceres SEEDLINE ID no.ME20871
  misc_feature: Bit score of 721.1 for HMM based on sequences of FIGURE 19.
  misc_feature (58)..(150): Pfam Name: HSF_DNA-bind Pfam Description: HSF-type DNA-binding
MPGEQTGETPTVAGVGGGGAGCSAGNSGGSSGCGAGGGGGGSGGGGGGGGDSQRSIPTPFLTKTYQLVEDPVYDELISWNEDGTTFIVWRPAEFARDLLPKYFKHNNFSSFVRQLNTYGFRKVVPDRWEFSNDCFKRGEKILLRDIQRRKISQPAMAAAAAAAAAAVAASAVTVAAVPVVAHIVSPSNSGEEQVISSNSSPAAAAAAIGGVVGGGSLQRTTSCTTAPELVEENERLRKDNERLRKEMTKLKGLYANIYTLMANFTPGQEDCAHLLPEGKPLDLLPERQEMSEAIMASEIETGIGLKLGEDLTPRLFGVSIGVKRARREEELGAAEEEDDDRREAAAQEGEQSSDVKAEPMEENNSGNHNGSWLELGK

SEQ ID NO: 1588 - DNA, 1542 bp, Gossypium hirsutum
  misc_feature: Ceres CLONE ID no.1839577
  misc_feature: Encodes the peptide sequence at SEQ ID NO. 1589
gacgagacgtaacgtagcttctcgttctttcctctcttcttcttctgttccattcacttttcctttgtaattttttattcctttcgctcatttttgtattctatttccccttatctgtttccgcaatcatcataaaatttgaactttctagaatttaacaatcagatttctcatctctggtgaacgaagcaaacaccttctttaaggaattattaattgttgtctctgatggctccgccgccggtggagcaaaacggagatgcaacgacgggaacggcggaatcacaaaggtctatacctacaccgttcttgactaaaacgtatcaattggttgatgatcacacgattgacgacgtgatttcgtggaacgacgacggatctacttttatcgtttggaatcccacggtgtttgctcgtgatttgcttcctaaatatttcaagcataacaatttctctagttttgttcgtcaactcaatacttatggatttagaaaagtggtgcccgatcgatgggaattctctaacgattattttcgacgaggtgaaaagcgacttttgtgcgaaatccagcggcggaagttgtcgtcgccaacagcagcagctgttacggtggctccggtgacggttgcggcgattccaatggcgaagcctattatatcaccgtcgaattctggagacgagcaatctccagtcatttcatcggcctcatcgccttcaaggctgaaccaagcaggaaccgttatggccgagctcatgaaagaaaacgaaaaattgaggaaagagaacgtgcagcttaacaaacaattatcagagatgaagagtttgtgcaataatatattcagtttgatgtcgaattacgcaagttctcagtcggagaacatttctccggtgcacaaaccgctagatttcttgccggcgaagcggttatcatgcggagaatcagtcgaagaagaaacgagtccgaggttattcggcgttcctataggaggagcggcaaagcgcgccagggaagaaggagaaggcgtagcgacggaagcggcgacggcagcagacgaaacgcaattacaactgcaacagcccggtggaagtgagattattaaattagagccgttggattgccagaaccgagggcgcgatgatgatcgtgggattcaagacgctccgtggcttcggcagtttcaccgagcgaatcaaagggtttgtaattgattttttttttttcgggttcgggttttttaggtagctttttggtcgggtatcgggttgtggatgatgattacggtgatcagaccggaattcacgtgcgaatgaaacgcacgtgatttctgaaaccttgagggaggacccaccccccacttcaagaactttcgtgggacatctttccatatataatatatgtatatatcttctttttctttttcttttcttcaactttaaagtccaaagtcttatattttactgttctctcttttttttttttatctttctaattataaaaattgaaaaatagaacccattttctaaaaaaaaaaaaaaaaaaaa

SEQ ID NO: 1589 - protein, 326 aa, Gossypium hirsutum
  misc_feature: Ceres CLONE ID no.1839577
  misc_feature: Bit score of 687.5 for HMM based on sequences of FIGURE 19.
  misc_feature (25)..(117): Pfam Name: HSF_DNA-bind Pfam Description: HSF-type DNA-binding
  misc_feature: Functional Homolog Of Ceres SEEDLINE ID no. ME20871 at SEQ ID NO. 1587
MAPPPVEQNGDATTGTAESQRSIPTPFLTKTYQLVDDHTIDDVISWNDDGSTFIVWNPTVFARDLLPKYFKHNNFSSFVRQLNTYGFRKVVPDRWEFSNDYFRRGEKRLLCEIQRRKLSSPTAAAVTVAPVTVAAIPMAKPIISPSNSGDEQSPVISSASSPSRLNQAGTVMAELMKENEKLRKENVQLNKQLSEMKSLCNNIFSLMSNYASSQSENISPVHKPLDFLPAKRLSCGESVEEETSPRLFGVPIGGAAKRAREEGEGVATEAATAADETQLQLQQPGGSEIIKLEPLDCQNRGRDDDRGIQDAPWLRQFHRANQRVCN

SEQ ID NO: 1590 - DNA, 1350 bp, Populus balsamifera subsp. trichocarpa
  misc_feature: Ceres ANNOT ID no.1491567
  misc_feature: Encodes the peptide sequence at SEQ ID NO. 1591
atgccgccattgcctgtggagcaaactggcgaatcacccgccgcatgtggcggcggagcagcagctggcggaccaccatcaggatcgggagattcgcaaagatctctcccaactccatttttaaccaaaacctatcagctagtcgatgacccgtcggttgatgacttgatttcatggaacgacgatggatcaaccttcatagtgtggcgtcctgcagagttcgccagagacttgttgcctaaatatttcaagcacaacaacttctctagcttcgttcgccaactcaacacatacggatttagaaaggtggtacccgatcgatgggaattcgcgaatgactgtttccggcgaggcgagaaagcacttctccgcgatattcagcgcaggaaaatatctacgatggcggcatcagctgtaacttccgcctctgttacggtcgccgccatccccacggtggcgagagcagtttctcctgctaactctggtgatgaccagggaatatcgtccacgtcgtctcctggcggggcagggacggcgggaggagcaaactcgtttctccggacgacgagctgcacgacgacgccggagattctggaggagaacgagaggttgaggaaggagaactcggcgctgagccacgagttgactcagttgagaggtctgtgtaataatataatggtgttgatgaataattacgcatcccctcagttagagggtaatagtggaaatagcaataataatttggcggaagtcaaggccgctttggaattgttgccggtggcggatgaagtggcggttagtggtagacccaggggcggagcggcggctacggagtcggaggtgagcccgagactgtttggggtttctattggattcaagcgcgtgaggatagacgaggaggaggaggaggagggtaatcggcaacaaacggaagggaaagagcacgaatctgacgttaaagcggagccgctggatggtagttcagggaattcagatcaccaagatcaacggtgagtggagcacgatgggcaccacaggaattggatcaggagatgggtagacgacacgtgtcttaaaagatgggtcgcttctggaagtttcatctgtctttacggaaagggaaaagatgcgatgatggtggtgggagcatcaaaagaagtggttggagtgccaaaacggcgcctcatggaaacaagatggatagattctccagagcacggtgattggttgctgctggagaggatctgtcccgtgatgattttgtacttgctgctgatgcaagttatacatggtagaagtgctgctgacttccttcttcaatggttggttgctttgcatggcttcttgtaa

SEQ ID NO: 1591 - protein, 337 aa, Populus balsamifera subsp. trichocarpa
  misc_feature: Ceres ANNOT ID no.1491567
  misc_feature: Bit score of 709.6 for HMM based on sequences of FIGURE 19.
  misc_feature (38)..(130): Pfam Name: HSF_DNA-bind Pfam Description: HSF-type DNA-binding
  misc_feature: Functional Homolog Of Ceres SEEDLINE ID no. ME20871 at SEQ ID NO. 1587
MPPLPVEQTGESPAACGGGAAAGGPPSGSGDSQRSLPTPFLTKTYQLVDDPSVDDLISWNDDGSTFIVWRPAEFARDLLPKYFKHNNFSSFVRQLNTYGFRKVVPDRWEFANDCFRRGEKALLRDIQRRKISTMAASAVTSASVTVAAIPTVARAVSPANSGDDQGISSTSSPGGAGTAGGANSFLRTTSCTTTPEILEENERLRKENSALSHELTQLRGLCNNIMVLMNNYASPQLEGNSGNSNNNLAEVKAALELLPVADEVAVSGRPRGGAAATESEVSPRLFGVSIGFKRVRIDEEEEEEGNRQQTEGKEHESDVKAEPLDGSSGNSDHQDQR

SEQ ID NO: 1592 - DNA, 1326 bp, Populus balsamifera subsp. trichocarpa
  misc_feature: Ceres ANNOT ID no.1438739
  misc_feature: Encodes the peptide sequence at SEQ ID NO. 1593
atgccgccattgcctgtggagcaaactggcgaatcacccgccgcatgtggcggcggagcagcagctggcggaccaccatcaggatcgggagattcgcaaagatctctcccaactccatttttaaccaaaacctatcagctagtcgatgacccgtcggttgatgacttgatttcatggaacgacgatggatcaaccttcatagtgtggcgtcctgcagagttcgccagagacttgttgcctaaatatttcaagcacaacaacttctctagcttcgttcgccaactcaacacatacggatttagaaaggtggtacccgatcgatgggaattcgcgaatgactgtttccggcgaggcgagaaagcacttctccgcgatattcagcgcaggaaaatatctacgatggcggcatcagctgtaacttccgcctctgttacggtcgccgccatccccacggtggcgagagcagtttctcctgctaactctggtgatgaccagggaatatcgtccacgtcgtctcctggcggggcagggacggcgggaggagcaaactcgtttctccggacgacgagctgcacgacgacgccggagattctggaggagaacgagaggttgaggaaggagaactcggcgctgagccacgagttgactcagttgagaggtctgtgtaataatataatggtgttgatgaataattacgcatcccctcagttagagggtaatagtggaaatagcaataataatttggcggaagtcaaggccgctttggaattgttgccggtggcggatgaagtggcggttagtggtagacccaggggcggagcggcggctacggagtcggaggtgagcccgagactgtttggggtttctattggattcaagcgcgtgaggatagacgaggaggaggaggaggagggtaatcggcaacaaacggaagggaaagagcacgaatctgacgttaaagcggagccgctggatggtagttcagggaattcagatcaccaagatcaacggtggaattggatcaggagatgggtagacgacacgtgtcttaaaagatgggtcgcttctggaagtttcatctgtctttacggaaagggaaaagatgcgatgatggtggtgggagcatcaaaagaagtggttggagtgccaaaacggcgcctcatggaaacaagatggatagattctccagagcacggtgattggttgctgctggagaggatctgtcccgtgatgattttgtacttgctgctgatgcaagttatacatggtagaagtgctgctgacttccttcttcaatggttggttgctttgcatggcttcttgtaa

SEQ ID NO: 1593 - protein, 441 aa, Populus balsamifera subsp. trichocarpa
  misc_feature: Ceres ANNOT ID no.1438739
  misc_feature: Bit score of 716.9 for HMM based on sequences of FIGURE 19.
  misc_feature (38)..(130): Pfam Name: HSF_DNA-bind Pfam Description: HSF-type DNA-binding
  misc_feature: Functional Homolog Of Ceres SEEDLINE ID no. ME20871 at SEQ ID NO. 1587
MPPLPVEQTGESPAACGGGAAAGGPPSGSGDSQRSLPTPFLTKTYQLVDDPSVDDLISWNDDGSTFIVWRPAEFARDLLPKYFKHNNFSSFVRQLNTYGFRKVVPDRWEFANDCFRRGEKALLRDIQRRKISTMAASAVTSASVTVAAIPTVARAVSPANSGDDQGISSTSSPGGAGTAGGANSFLRTTSCTTTPEILEENERLRKENSALSHELTQLRGLCNNIMVLMNNYASPQLEGNSGNSNNNLAEVKAALELLPVADEVAVSGRPRGGAAATESEVSPRLFGVSIGFKRVRIDEEEEEEGNRQQTEGKEHESDVKAEPLDGSSGNSDHQDQRWNWIRRWVDDTCLKRWVASGSFICLYGKGKDAMMVVGASKEVVGVPKRRLMETRWIDSPEHGDWLLLERICPVMILYLLLMQVIHGRSAADFLLQWLVALHGFL

SEQ ID NO: 1594 - protein, 432 aa, Brassica oleracea
  misc_feature: Public GI ID no.89274218
  misc_feature: Bit score of 367.1 for HMM based on sequences of FIGURE 19.
  misc_feature (36)..(215): Pfam Name: HSF_DNA-bind Pfam Description: HSF-type DNA-binding
  misc_feature: Functional Homolog Of Ceres SEEDLINE ID no. ME20871 at SEQ ID NO. 1587
MDGVTGGDSKSGEATTAPPLRNPHPATLLGTNALPPPFLSKTYDMVEDPASDAIVSWSPANNSFVVWDPPEFSRSLLPRYFKHNNFSSFVRQLNTYGFRKVDPDRWEFANEGFLRGQKHLLKTISRRKSTQGHGSSSSSNPQSHQGHMASLSSCVEVGKFGLEEEVEQLKRDKNVLMQELVKLRQQQQSTDSKLQSMVKSLQTMEQRQQQIMSFLAKAVQNPTFLSQFIQKQTDSGNMHVTEASKKRRLTEDAAAASDGQIVKYQPIRSDSTMSMMWNMMNTDEKFPFSPNRDSGVTFQEVLLPTTSGQSQAYAPISSASTSLMPMIPPMPQESISDSPTENYMNAEKDVSEAFISPSPFLDGGSVPNQLEGLPQDLDIDELMSNCDIFEEYLAQSPVFGDETTLESSDANGGHVDKLIEELGHLTSETKQL

SEQ ID NO: 1595 - DNA, 1970 bp, Glycine max
  misc_feature: Ceres CLONE ID no.574505
  misc_feature: Encodes the peptide sequence at SEQ ID NO. 1596
ttttttcctttgctatccactccatgattttagtctcctctcggaaacttctagaaacaacaacaacctacagctcattttttttccgattccgatcctctttctgcttctccgttcgctgggtgcatgccctctcagtaaccctatcagatagatcaaggtaaccaaaataatcataaattatcattcttcacttattaatattatttatcttctttttggattggataatattaagaagaaccagcgttagctaaggatagataggttctagcctttctgttatcattttcgaaagaatctgtagcagtgtaagtaccaaattgaaatggttagattttgtttagaaagcagttatgaacgaaactttgaagcttagaaaagcggttaggtagctaggttgagttccagatctggtagagaagttcatcatggcgccgttaccggcggagcaaaccggtgaatcagcgccgacggagttgcagagatccattccgacgccgtttctgaccaagacgtaccagctcgtcgatgatccctccgcggatgacctaatttcctggaacgaagacggcaccagcttcattgtatggcgacccgcggaatttgcaagggatttgcttcctaagtacttcaaacacaacaacttttccagtttcgtccgtcaacttaacacctatgggttccggaaggttgtccctgaccgttgggaattcgccaacgactgtttccggcgaggcgagagagctcttcttcgcgacatacagcgccggaaattactgccggttccgcctgcagccgcggcaccggcagcagtcacagccaatacggtgacggtggctgtggcagcaccggcggtgagaactgtgtctccaacgacttccggcgacgaacaggtactatcttcgaactcatctccgattgctgggaataataataataatacagtacaccgcaccacaagttgcaccactgcgcccgagctgttagaagagaatgaaaggcttaggaaagagaacatacaactgagtaacgagttgagtcaattgaagggtttgtgtaataacatactctctttgatgaccaattatgcttctggttttagccgccagcagttagaatcctccacaagcgctgtgaggaccgtgccggtgccggacgggaaggcgccgctggagcttttgcccgcgaaacatgtttcatcggctgatgacgccctgcatgtcggtggcgccgccggtgccgcggcgtgcgcgacggggaacgcggcggaagcagaggttccgaagctgtttggggtttcgattggactgaaacgatgtaggacagagtgcgaggccgaaccagaaggagaagatcagaatcagatgcaaacgcgagcacaaacacaatcacaatcgtcgcaagaaccagatcacggttcagatgtgaaatctgaaccgcttgatggtgatgattcggattatcaggatcatgaccctcattggttggagctatagggaaatgaaatgatgctccttcttcttcttgatctctctactaatttggtgaaatgacagtgcgcacttgctgcctgtactattagtgctgtgacgctgccattgggccggcacgtgacttggccatgtatttaactcgcggttggggtgaaaagtgcgaaacattgtactataaggaattatgtattcttctgattgctgggggttaaagaaagattatcatcgcgtcaaaatggagtaactgaagcaagggaaggacagacccctaaaagactcacgtctcggttttttatttcaaggaacatttgttggatacagcaaaatgtgtagatatttgtgtctgacatcattaaattttcgaatttgattcgtgtattgtaatgtttccatcctttgaaccaagtttgttcctaagcttcataattgtagcatgtatgttcttttaatgaaatgaaattctaatattatctt

SEQ ID NO: 1596 - protein, 355 aa, Glycine max
  misc_feature: Ceres CLONE ID no.574505
  misc_feature: Bit score of 744.7 for HMM based on sequences of FIGURE 19.
  misc_feature (23)..(115): Pfam Name: HSF_DNA-bind Pfam Description: HSF-type DNA-binding
  misc_feature: Functional Homolog Of Ceres SEEDLINE ID no. ME20871 at SEQ ID NO. 1587
MAPLPAEQTGESAPTELQRSIPTPFLTKTYQLVDDPSADDLISWNEDGTSFIVWRPAEFARDLLPKYFKHNNFSSFVRQLNTYGFRKVVPDRWEFANDCFRRGERALLRDIQRRKLLPVPPAAAAPAAVTANTVTVAVAAPAVRTVSPTTSGDEQVLSSNSSPIAGNNNNNTVHRTTSCTTAPELLEENERLRKENIQLSNELSQLKGLCNNILSLMTNYASGFSRQQLESSTSAVRTVPVPDGKAPLELLPAKHVSSADDALHVGGAAGAAACATGNAAEAEVPKLFGVSIGLKRCRTECEAEPEGEDQNQMQTRAQTQSQSSQEPDHGSDVKSEPLDGDDSDYQDHDPHWLEL

SEQ ID NO: 1597 - protein, 502 aa, Medicago sativa
  misc_feature: Public GI ID no.56117815
  misc_feature: Bit score of 1169.1 for HMM based on sequences of FIGURE 19.
  misc_feature (31)..(207): Pfam Name: HSF_DNA-bind Pfam Description: HSF-type DNA-binding
  misc_feature: Functional Homolog Of Ceres SEEDLINE ID no. ME20871 at SEQ ID NO. 1587
MDGASGGSGGGEGSTTQIPAPTPMLNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPMSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 1598 - protein, 502 aa, Medicago sativa
  misc_feature: Public GI ID no.115521211
  misc_feature: Bit score of 1164.9 for HMM based on sequences of FIGURE 19.
  misc_feature (31)..(207): Pfam Name: HSF_DNA-bind Pfam Description: HSF-type DNA-binding
  misc_feature: Functional Homolog Of Ceres SEEDLINE ID no. ME20871 at SEQ ID NO. 1587
MDGASGGSGGGEGSTTQIPAPTPMQNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPVSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 1599 - protein, 502 aa, Medicago sativa
  misc_feature: Public GI ID no.115521213
  misc_feature: Bit score of 1165.5 for HMM based on sequences of FIGURE 19.
  misc_feature (31)..(207): Pfam Name: HSF_DNA-bind Pfam Description: HSF-type DNA-binding
  misc_feature: Functional Homolog Of Ceres SEEDLINE ID no. ME20871 at SEQ ID NO. 1587
MDGASGGSGGGEGSTTQIPAPTPMLNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPVSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 1600 - protein, 561 aa, Medicago sativa
  misc_feature: Public GI ID no.115521217
  misc_feature: Bit score of 1098.3 for HMM based on sequences of FIGURE 19.
  misc_feature (31)..(207): Pfam Name: HSF_DNA-bind Pfam Description: HSF-type DNA-binding
  misc_feature: Functional Homolog Of Ceres SEEDLINE ID no. ME20871 at SEQ ID NO. 1587
MDGASGGSGGGEGSTTQIPAPTPMLNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPIMKWDTPRVESFNKNPDNYLIGDGTSPSSAMDSSSSTSWNSGVTLQEVPPSSVQSTQIPMSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 1601 - protein, 502 aa, Medicago sativa
  misc_feature: Public GI ID no.115521209
  misc_feature: Bit score of 1166.0 for HMM based on sequences of FIGURE 19.
  misc_feature (31)..(207): Pfam Name: HSF_DNA-bind Pfam Description: HSF-type DNA-binding
  misc_feature: Functional Homolog Of Ceres SEEDLINE ID no. ME20871 at SEQ ID NO. 1587
MDGASGASGGGEGSTTQIPAPTPMQNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPMSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 1602 - protein, 502 aa, Medicago sativa
  misc_feature: Public GI ID no.115521215
  misc_feature: Bit score of 1162.3 for HMM based on sequences of FIGURE 19.
  misc_feature (31)..(207): Pfam Name: HSF_DNA-bind Pfam Description: HSF-type DNA-binding
  misc_feature: Functional Homolog Of Ceres SEEDLINE ID no. ME20871 at SEQ ID NO. 1587
MDGASGASGGGEGSTTQIPAPTPMQNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPVSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 1603 - protein, 243 aa, Medicago truncatula
  misc_feature: Public GI ID no.92874021
  misc_feature: Bit score of 441.5 for HMM based on sequences of FIGURE 19.
  misc_feature (12)..(113): Pfam Name: HSF_DNA-bind Pfam Description: HSF-type DNA-binding
  misc_feature: Functional Homolog Of Ceres SEEDLINE ID no. ME20871 at SEQ ID NO. 1587
MVFTMESQKSVPAPFLTKTYQLVDDPLTDHIVSWSDDETTFVVWRPPEFARDLLPNFFKHNNFSSFVRQLNTYGFKKVVADRWEFANDYFKKGAKHLLCEIHRRKTPQHYQQQYYEQSPQIFQPDESICWIDSPLPSPKSNTDILTALSEDNQRLRRKNFMLLSELSHMKNLYNDIIYFIQNHVSPASPFEQRSNNSATILKLVELDSSSPQLPNDKDCNSSSVKLFGVPLCGKKRVHPSNLD

SEQ ID NO: 1604 - protein, 527 aa, Solanum lycopersicum
  misc_feature: Public GI ID no.11386827
  misc_feature: Bit score of 507.0 for HMM based on sequences of FIGURE 19.
  misc_feature (38)..(223): Pfam Name: HSF_DNA-bind Pfam Description: HSF-type DNA-binding
  misc_feature: Functional Homolog Of Ceres SEEDLINE ID no. ME20871 at SEQ ID NO. 1587
MEPNSYGSGKAAVGDGVGAPMLQTAPAPAPIPSANAPPPFLVKTYDMVDDPSTDKIVSWSPTNNSFVVWDPPEFAKDLLPKYFKHNNFSSFVRQLNTYGFRKVDPDRWEFANEGFLRGQKHLLKSISRRKPAHGHAQQQQQPHGNAQQQMQPPGHSASVGACVEVGKFGLEEEVERLKRDKNVLMQELVRLRQQQQATDNQLQGMVQRLQGMELRQQQMMSFLAKAVNRPGFLAQFVQQQNESNKRIAEGSKKRRIKQDIESQDPSVTPADGQIVKYQPGINEAAKAMLRELSKLDSSPRLDNFSNSPESFLIGDGSPQSNASSGRVSGVTLQEVPPTSGKPLLNTASAIAGQSLLPATSEMQSSHLGTCSEIINNQLSNIIPLVGGEDLHPGSLSASDMIMPELSQLQGILPENNTDVIGCDSFMDTSAVEGKVGLDIIGSCLSPGADIDWQSGLLDEIEEFPSVGDPFWEKFLQSPCSPDAAMDDDISNTSETKPQINGWDKTQNMEHLTEQMGATNIKQQKHMI

SEQ ID NO: 1605 - protein, 301 aa, Lycopersicon peruvianum
  misc_feature: Public GI ID no.123684
  misc_feature: Bit score of 566.2 for HMM based on sequences of FIGURE 19.
  misc_feature (7)..(111): Pfam Name: HSF_DNA-bind Pfam Description: HSF-type DNA-binding
  misc_feature: Functional Homolog Of Ceres SEEDLINE ID no. ME20871 at SEQ ID NO. 1587
MSQRTAPAPFLLKTYQLVDDAATDDVISWNEIGTTFVVWKTAEFAKDLLPKYFKHNNFSSFVRQLNTYGFRKIVPDKWEFANENFKRGQKELLTAIRRRKTVTSTPAGGKSVAAGASASPDNSGDDIGSSSTSSPDSKNPGSVDTPGKLSQFTDLSDENEKLKKDNQMLSSELVQAKKQCNELVAFLSQYVKVAPDMINRIMSQGTPSGSSLEELVKEVGGVKDLEEQGSYNDNDDKEDDDEKGDTLKLFGVLLKEKKKKRGPDENIETCGGRGKMMKTVDYNGPWMKMSSPAGESSKVCN

SEQ ID NO: 1606 - protein, 292 aa, Nicotiana tabacum
  misc_feature: Public GI ID no.5821136
  misc_feature: Bit score of 548.1 for HMM based on sequences of FIGURE 19.
  misc_feature (7)..(103): Pfam Name: HSF_DNA-bind Pfam Description: HSF-type DNA-binding
  misc_feature: Functional Homolog Of Ceres SEEDLINE ID no. ME20871 at SEQ ID NO. 1587
MSQRTVPAPFLTKTYQLVDDATTDDVVSWNESGTTFVVWKTAEFAKDLVPTYFKHNNFSSFVRQLNTYGFRKIVPDKWEFANENFKRGQKELLTAIRRRKTVTPTPAGGKSVVPGTSASPDNSGEDLGSSSTSSPDSKNPGSVDTPGKSQFADLSDENEKLKKDNQMLSSELAQAKKQCDELVAFLNQYVKVAPDMINRIISQGTSGSSYGELVKEVIGGVNDLEAQGSDDDEKGDTLKLFGVLLKENKKKRGPDENADISGSRGKMMKTMDYNLPWMKMSSAPGESNKVCN

SEQ ID NO: 1607 - protein, 371 aa, Helianthus annuus
  misc_feature: Public GI ID no.25052685
  misc_feature: Bit score of 133.3 for HMM based on sequences of FIGURE 19.
  misc_feature (70)..(244): Pfam Name: HSF_DNA-bind Pfam Description: HSF-type DNA-binding
  misc_feature: Functional Homolog Of Ceres SEEDLINE ID no. ME20871 at SEQ ID NO. 1587
MAGVVKEFDSSHDMFKVREEPKVVFNNKDLSEEMMKIKEEPMLVFDEHEDFVGGEEAPKPIEGLRDGGPPPFLKKTFEMVDDPTTDSIISWSSSKNSFILWDPHKFSTDLLPQRFKHNNFSSFVRQLNTYRFKKIDPDRWEFANEFFQKGKKHLLRDIKRRTNQPQNTQKQEEIRKQEQQQCCGHQTNSTMETELKNLRKERITLKQEILKMKQQQENTEKHLEMVEERMLRMEFKQQQLLVFMSKAFRNPIFVKLLQHLVQKQKTGSVEMCKKRKLEQMLNTDDLDRFQEMWNMIEPDAYTVLSSDGSVSPPEDQNTSDKSGSNGSDYNSESFILWEKLMEDELIFGGEQSGKDQTETYLQEWEELIPKA

SEQ ID NO: 1608 - DNA, 1486 bp, Zea mays
  misc_feature: Ceres CLONE ID no.283366
  misc_feature: Encodes the peptide sequence at SEQ ID NO. 1609
acgggaccggtaacttctagaacccaccaccttccatccttccttcctttcctctctctctctctctcctcgcgcccacggtgcccgccagccagatccgcgcgttcaccggcgccatggccgccgagcatgccaccgccgcggtgggtgagccgcctcccgccacgtcgcagccggcggagggcgtgacggcggcggcgggccagaggtccgtgcccacgccgttcctcagcaagacgtaccagctggtggacgacccggcggtggacgacatcatctcgtggaacgacgacgggtctgccttcatcgtgtggcgcccggcggagttcgcgcgcgatctgttgcccaagtacttcaagcacaacaacttctccagcttcgtgcgccagctcaacacctacgggttcaggaagatcgtgccggacaggtgggagttcgcgaacgactgcttccgccgaggggagaagcggctgctctgcgacatacaccgccggaaggtgtcgccggccacgggggcggtcacggtggccgccgccgccgctgcggccatcccgatggcgctgcccgtgggctctccggtgtactccggcgaggagcaggtgctgtcaagctcgtccccggagcccccgtcgctgcagcagcacccgccggcgccgtccgggtcgggctccggcggggtggtctcgggcgacgtgggcgaggagaacgagcggttgcggcgggagaacgcgcggctggcgcgcgagctcggacagatgaagaagctctgcaacaacatcctcctcctcatgtccaagtacgccgccactcagcagccggacgccgccaaggaggcggccgccgggaactgcaccggcgagtcgtcggatgccgccgcggcgcctccgctcccttcgatcctggagctcctaccctcgtgccgcgccgaccccgcgcccgctgcagccggaacggatcacgaggatgacgaaaaggcgggcgctaggctgttcggcgtctccatcgggcggaaacgaatgcgggacgagagcgaccaccacgccggcgtctgcgcagcggaggtgaaagccgagccggtggacgcgcgtcccgaccagcagcggcagcgcaacgccacggagccgcagtcgtggcccatttaccggcccaggcctgtgtaccacccgctccgggcctgcaacggctcgggcagcgctgggagcgaccacgacgggtccaacgactcgaggtgacgggagcaatcgtcgatctgccctcagtaaattagtattacacttactaatggtactaggtaactatattacaggttaaactaggatgtgagctctaaatctctaattatgtggggatttactgaccgatcctatgtaaaaatctccagtgtttatgtagttgatctcatattactgcaagtaccgagtatcctttctgtaccataaaactagaggttaacttatgcacagtagactaatattttctttaagtc

SEQ ID NO: 1609 - protein, 371 aa, Zea mays
  misc_feature: Ceres CLONE ID no.283366
  misc_feature: Bit score of 768.4 for HMM based on sequences of FIGURE 19.
  misc_feature (35)..(127): Pfam Name: HSF_DNA-bind Pfam Description: HSF-type DNA-binding
  misc_feature: Functional Homolog Of Ceres SEEDLINE ID no. ME20871 at SEQ ID NO. 1587
MAAEHATAAVGEPPPATSQPAEGVTAAAGQRSVPTPFLSKTYQLVDDPAVDDIISWNDDGSAFIVWRPAEFARDLLPKYFKHNNFSSFVRQLNTYGFRKIVPDRWEFANDCFRRGEKRLLCDIHRRKVSPATGAVTVAAAAAAAIPMALPVGSPVYSGEEQVLSSSSPEPPSLQQHPPAPSGSGSGGVVSGDVGEENERLRRENARLARELGQMKKLCNNILLLMSKYAATQQPDAAKEAAAGNCTGESSDAAAAPPLPSILELLPSCRADPAPAAAGTDHEDDEKAGARLFGVSIGRKRMRDESDHHAGVCAAEVKAEPVDARPDQQRQRNATEPQSWPIYRPRPVYHPLRACNGSGSAGSDHDGSNDSR

SEQ ID NO: 1610 - DNA, 1218 bp, Zea mays
  misc_feature: Ceres CLONE ID no.1440437
  misc_feature: Encodes the peptide sequence at SEQ ID NO. 1611
aaccaaaccaaatctctccgtctcctctcgccagagcaccaccagaaccatcgccctcaaccaactcatcaatggcgtcgccggcgctgggggcggggacgccgccgttcctcaccaagacgtacgcgatggtggacgacccggagaccgacgacaccatctcctggaacgagtccggcacggcgttcgtggtgtggcgccgcgccgagttcgagcgcgacctcctccccaagaacttcaagcacagcaacttcgcctccttcgtccgccagctcaacacctacggattcaggaagataggccttgacaggtgggagttcgccaacgagtgcttcaggaaaggggagaagcgcctgctcggcgcgatacagaggcggaagggatctggcgccggggcgccgccgcccgcgatgatggcgacgccgattgcgacggcgattccgatctcgcccacgccgacgagctccggcggggacgccgcggtctcgtcgtcgccgccgcccgggctggcgctggtggccaccggcgcgatggccgagctggaggaggagaacgcgcggctgcggcgcgagaacgcgaggctggcgcgggagctcgcgcgcgcgcggcgcgtctgcgacagcgtgcggcacctcgtctggcggtatgaccacggcggggatgaagtgggggaggaggacgagaggcacggcgccgcaggcgcgaagccgatgctattcggcgtcgcgatagggaggaagaggtcgcgcgaggatgggcacgggggaggggatgaggaaaatggggcagaggaggacggcgaagacgaggaggaggagcaagaacacgacgacgacgacgagaggcacgccgcccggcgagaacaagggaaggctatgaagacggagcggtcggatctgaatgtgctttcgctgtccgtgcgggcggcggcggcggcgaggcctgacggaggctcgcgtgatcgtagcggaaaccactagtaggatctaaatccacctcgcgtgatcgtagcggaaagcactaggatctaaatggtgtaccactctagctcgcattatgacgtctttgtatcttgacgtgacaagaattgcattgctggtagcacaatgtagaatcagccaaggcgtgtagaacaaccggtagattgtttggtagttagggcctgtttggtttccatgtagacctaggattgggaaaatgagaagagttggatgccag

SEQ ID NO: 1611 - protein, 302 aa, Zea mays
  misc_feature: Ceres CLONE ID no.1440437
  misc_feature: Bit score of 212.3 for HMM based on sequences of FIGURE 19.
  misc_feature (11)..(103): Pfam Name: HSF_DNA-bind Pfam Description: HSF-type DNA-binding
  misc_feature: Functional Homolog Of Ceres SEEDLINE ID no. ME20871 at SEQ ID NO. 1587
MASPALGAGTPPFLTKTYAMVDDPETDDTISWNESGTAFVVWRRAEFERDLLPKNFKHSNFASFVRQLNTYGFRKIGLDRWEFANECFRKGEKRLLGAIQRRKGSGAGAPPPAMMATPIATAIPISPTPTSSGGDAAVSSSPPPGLALVATGAMAELEEENARLRRENARLARELARARRVCDSVRHLVWRYDHGGDEVGEEDERHGAAGAKPMLFGVAIGRKRSREDGHGGGDEENGAEEDGEDEEEEQEHDDDDERHAARREQGKAMKTERSDLNVLSLSVRAAAAARPDGGSRDRSGNH

SEQ ID NO: 1612 - protein, 402 aa, Phaseolus acutifolius
  misc_feature: Public GI ID no.16118447
  misc_feature: Bit score of 840.8 for HMM based on sequences of FIGURE 19.
  misc_feature (12)..(117): Pfam Name: HSF_DNA-bind Pfam Description: HSF-type DNA-binding
  misc_feature: Functional Homolog Of Ceres SEEDLINE ID no. ME20871 at SEQ ID NO. 1587
MDEALGSSCSLPPFLAKTYEMVDDLSTNSIVSWSVSSKSFIVWNPPEFARDLLPRFFKHNNFSSFIRQLNTYGFKKIDPEQWEFANDDFVRGQPHLMKNIHRRKPVHSHSLQNLQAQGPLGDSERQGFTDGIEKLKRDKERLLVELQKFQHEWQTYEIQIHCSNDRLEKLEQKQHKMVSSISHVLQKPVLAVNILPLTETMDRKRRLPRSGHYYDESSIEDAIETSQMLPRENAENTTVLTLNVERLDQLESSVAFWEAIAHDIGDNFAQIQSNMDFDESTSCADSPSISCAQLDVDVRPKSSGIDMNSEPTAAAVPDPLASKDQPAGITVAATGVNDVFWEQFLTEDPGASETQEVQSERKDCDGRKNEGKPNDHSKFWWNIRNANNLSEPMGHVGQAEKT

SEQ ID NO: 1613 - protein, 446 aa, Oryza sativa subsp. indica
  misc_feature: Public GI ID no.125564440
  misc_feature: Bit score of 561.2 for HMM based on sequences of FIGURE 19.
  misc_feature (37)..(129): Pfam Name: HSF_DNA-bind Pfam Description: HSF-type DNA-binding
  misc_feature: Functional Homolog Of Ceres SEEDLINE ID no. ME20871 at SEQ ID NO. 1587
MAEQGAGEADAGGGEPPPAAVMTAAAEALAGQRSLPTPFLTKTYQLVEDPAVDDVISWNEDGSTFVVWRPAEFARDLLPKYFKHNNFSSFVRQLNTYGFRKIVPDRWEFANDCFRRGEKRLLCDIHRRKVVAAAAAAPPPPSPGMATAAAAVASGAVTVAAAPIPMALPVTRAGSPAHSSEEQVLSSNSGSGEEHRQASGSGSAPGGGGGGSASGGDMGEENERLRRENARLTRELGHMKKLCNNILLLMSKYAATQHVEGSAGISSIANCSGESSEAVPPPPPLPPAILDLMPSCPALATAAAAAGLAIDGEPDPSARLFGVSIGLKRTRDDAAAAADEDGGGEDQAEHGGADVKPEAADPHPAGGGGGSSTEASPESHPWPIYRPTPMYHAVRPTCNGPDRAGSDQDGSSSSVRSIRMPVHSLVSFTSVLGVSAKNGGDIGRKH

SEQ ID NO: 1614 - protein, 373 aa, Oryza sativa subsp. indica
  misc_feature: Public GI ID no.125562434
  misc_feature: Bit score of 764.5 for HMM based on sequences of FIGURE 19.
  misc_feature (29)..(121): Pfam Name: HSF_DNA-bind Pfam Description: HSF-type DNA-binding
  misc_feature: Functional Homolog Of Ceres SEEDLINE ID no. ME20871 at SEQ ID NO. 1587
MGEPSPPPPAPAAEAAGVGVGQQQRTVPTPFLTKTYQLVDDPAVDDVISWNDDGSTFVVWRPAEFARDLLPKYFKHNNFSSFVRQLNTYGFRKIVPDRWEFANDCFRRGERRLLCEIHRRKVTPPAPAATTAAVAAAIPMALPVTTTRDGSPVLSGEEQVISSSSSPEPPLVLPQAPSGSGSGGVASGDVGDENERLRRENAQLARELSQMRKLCNNIILLMSKYASTQQLDAANASSAAGNNNNNNNCSGESAEAATPLPLPAVLDLMPSCPGAASAAAPVSDNEEGMMSAKLFGVSIGRKRMRHDGGGDDDHAATVKAEPMDGRPHGKDEQSAETQAWPIYRPRPVYQPIRACNGYEYDRAGSDQDGSNST

SEQ ID NO: 1615 - protein, 305 aa, Oryza sativa subsp. indica
  misc_feature: Public GI ID no.116309817
  misc_feature: Bit score of 265.3 for HMM based on sequences of FIGURE 19.
  misc_feature (9)..(101): Pfam Name: HSF_DNA-bind Pfam Description: HSF-type DNA-binding
  misc_feature: Functional Homolog Of Ceres SEEDLINE ID no. ME20871 at SEQ ID NO. 1587
MASPAAGTPPFLTKTYAMVEDPSTDETISWNDSGTAFVVWRPAEFARDLLPKHFKHSNFSSFVRQLNTYGFKKVVADRWEFANDCFRRGEKHLLGGIQRRKGSGTGGAGAAPAGGIPTAIPISSPPTSSGGEPAVSSSPPRGAAGIAAGVSGAVAELEEENARLRRENARLARELARARRVCDGVRRLVSRYDHDHGGGEEEAGEGDVKPMLFGVAIGGKRSREENGEDEEEEEEGADEDGEDDEVEEEDDEERERHAARRVPVREGKVRRTTELSDLDVLALSVRAAAAARPGGASRDRKSSVS

SEQ ID NO: 1616 - protein, 288 aa, Oryza sativa subsp. indica
  misc_feature: Public GI ID no.125549382
  misc_feature: Bit score of 204.8 for HMM based on sequences of FIGURE 19.
  misc_feature (1)..(84): Pfam Name: HSF_DNA-bind Pfam Description: HSF-type DNA-binding
  misc_feature: Functional Homolog Of Ceres SEEDLINE ID no. ME20871 at SEQ ID NO. 1587
MVEDPSTDETISWNDSGTAFVVWRPAEFARDLLPKHFKHSNFSSFVRQLNTYGFKKVVADRWEFANDCFRRGEKHLLGGIQRRKGSGTGGAGAAPAGGIPTAIPISSPPTSSGGEPAVSSSPPRGAAGIAAGVSGAVAELEEENARLRRENARLARELARARRVCDGVRRLVSRYDHDHGGGEEEAGEGDVKPMLFGVAIGGKRSREENGEDEEEEEEGADEDGEDDEVEEEDDEERERHAARRVPVREGKVRRTTELSDLDVLALSVRAAAAARPGGASRDRKSSVS

SEQ ID NO: 1617 - protein, 414 aa, Oryza sativa subsp. japonica
  misc_feature: Public GI ID no.52077317
  misc_feature: Bit score of 563.6 for HMM based on sequences of FIGURE 19.
  misc_feature (37)..(129): Pfam Name: HSF_DNA-bind Pfam Description: HSF-type DNA-binding
  misc_feature: Functional Homolog Of Ceres SEEDLINE ID no. ME20871 at SEQ ID NO. 1587
MAEQGAGEADAGGGEPPPAAVMTAAAEALAGQRSLPTPFLTKTYQLVEDPAVDDVISWNEDGSTFVVWRPAEFARDLLPKYFKHNNFSSFVRQLNTYGFRKIVPDRWEFANDCFRRGEKRLLCDIHRRKVVAAAAAAPPPPSPGMATAAAAVASGAVTVAAAPIPMALPVTRAGSPAHSSEEQVLSSNSGSGEEHRQASGSGSAPGGGGGGSASGGDMGEENERLRRENARLTRELGHMKKLCNNILLLMSKYAATQHVEGSAGISSIANCSGESSEAVPPPPPLPPAILDLMPSCPALATAAAAAGLAIDGEPDPSARLFGVSIGLKRTRDDAAAAADEDGGGEDQAEHGGADVKPEAADPHPAGGGGGSSTEASPESHPWPIYRPTPMYHAVRPTCNGPDRAGSDQDGSSSR

SEQ ID NO: 1618 - protein, 616 aa, Oryza sativa subsp. japonica
  misc_feature: Public GI ID no.115477655
  misc_feature: Bit score of 748.9 for HMM based on sequences of FIGURE 19.
  misc_feature (190)..(282): Pfam Name: HSF_DNA-bind Pfam Description: HSF-type DNA-binding
  misc_feature: Functional Homolog Of Ceres SEEDLINE ID no. ME20871 at SEQ ID NO. 1587
MKGSRLAVKESCLPMTMPMPETFAQYSNPLRSTRAYGQLCRVPGRRRHACVDGWGQDRARTRGDDGQRRYAQCRGGWGDIWRWGGYITCGSPRETGMVNGAPSPPPPSPMVMSFGPLDSPWVKQPDTTVYPGQICAAAGGGGGMADQTAAAVVVGGGAAATMGEPSPPPPAPAAEAAGVGVGQQQRTVPTPFLTKTYQLVDDPAVDDVISWNDDGSTFVVWRPAEFARDLLPKYFKHNNFSSFVRQLNTYGFRKIVPDRWEFANDCFRRGERRLLCEIHRRKVTPPAPAATTAAVAAAIPMALPVTTTRDGSPVLSGEEQVISSSSSPEPPLVLPQAPSGSGSGGVASGDVGDENERLRRENAQLARELSQMRKLCNNILLLMSKYASTQQLDAANASSAAGNNNNNNCSGESAEAATPLPLPAVLDLMPSCPGAASAAAPVSDNEEGMMSAKLFGVSIGRKRMRHDGGGDDDHAATVKAEPMDGRPHGKDEQSAETQAWPIYRPRPVYQPIRACNGYEYDRAGSDQDECGAKPSNQDKKDLLRRWVVLISESLQLHGRQVVGAVQEWRRDRRGHRRPPAGHVQLRTCVNNLLVTGAGTLDAGREYETNSLPRPRR

SEQ ID NO: 1619 - protein, 390 aa, Oryza sativa subsp. japonica
  misc_feature: Public GI ID no.42408097
  misc_feature: Bit score of 763.3 for HMM based on sequences of FIGURE 19.
  misc_feature (47)..(139): Pfam Name: HSF_DNA-bind Pfam Description: HSF-type DNA-binding
  misc_feature: Functional Homolog Of Ceres SEEDLINE ID no. ME20871 at SEQ ID NO. 1587
MADQTAAAVVVGGGAAATMGEPSPPPPAPAAEAAGVGVGQQQRTVPTPFLTKTYQLVDDPAVDDVISWNDDGSTFVVWRPAEFARDLLPKYFKHNNFSSFVRQLNTYGFRKIVPDRWEFANDCFRRGERRLLCEIHRRKVTPPAPAATTAAVAAAIPMALPVTTTRDGSPVLSGEEQVISSSSSPEPPLVLPQAPSGSGSGGVASGDVGDENERLRRENAQLARELSQMRKLCNNILLLMSKYASTQQLDAANASSAAGNNNNNNCSGESAEAATPLPLPAVLDLMPSCPGAASAAAPVSDNEEGMMSAKLFGVSIGRKRMRHDGGGDDDHAATVKAEPMDGRPHGKDEQSAETQAWPIYRPRPVYQPIRACNGYEYDRAGSDQDGSNST

SEQ ID NO: 1620 - protein, 305 aa, Oryza sativa subsp. japonica
  misc_feature: Public GI ID no.115459982
  misc_feature: Bit score of 266.4 for HMM based on sequences of FIGURE 19.
  misc_feature (9)..(101): Pfam Name: HSF_DNA-bind Pfam Description: HSF-type DNA-binding
  misc_feature: Functional Homolog Of Ceres SEEDLINE ID no. ME20871 at SEQ ID NO. 1587
MASPAAGTPPFLTKTYAMVEDPSTDETISWNDSGTAFVVWRPAEFARDLLPKHFKHSNFSSFVRQLNTYGFKKVVADRWEFANDCFRRGEKHLLGGIQRRKGSGTGGAGAAPAGGIPTAIPISSPPTSSGGEPAVSSSPPRGAAGIAAGVSGAVAELEEENARLRRENARLARELARARRVCDGVRRLVSRYDHDHGGGEEEAGEGDVKPMLFGVAIGGKRSREENGEDEEEEEEEGADEDGEDDEVEEDDEERERHAARRVPVREGKVRRTTELSDLDVLALSVRAAAAARPGGASRDRKSSVS

SEQ ID NO: 1621 - protein, 288 aa, Oryza sativa subsp. japonica
  misc_feature: Public GI ID no.33591096
  misc_feature: Bit score of 205.8 for HMM based on sequences of FIGURE 19.
  misc_feature (1)..(84): Pfam Name: HSF_DNA-bind Pfam Description: HSF-type DNA-binding
  misc_feature: Functional Homolog Of Ceres SEEDLINE ID no. ME20871 at SEQ ID NO. 1587
MVEDPSTDETISWNDSGTAFVVWRPAEFARDLLPKHFKHSNFSSFVRQLNTYGFKKVVADRWEFANDCFRRGEKHLLGGIQRRKGSGTGGAGAAPAGGIPTAIPISSPPTSSGGEPAVSSSPPRGAAGIAAGVSGAVAELEEENARLRRENARLARELARARRVCDGVRRLVSRYDHDHGGGEEEAGEGDVKPMLFGVAIGGKRSREENGEDEEEEEEEGADEDGEDDEVEEDDEERERHAARRVPVREGKVRRTTELSDLDVLALSVRAAAAARPGGASRDRKSSVS

SEQ ID NO: 1622 - DNA, 1614 bp, Zea mays
  misc_feature: Ceres CLONE ID no.484753
  misc_feature: Encodes the peptide sequence at SEQ ID NO. 1623
ctcttctctccgtccccacctactactcggcgcctctggtttctctccaagtctccatgctacgcgaccggaaacttccagaatctaccagtaccaccttcctctctctctctcactcttcctgcgcgacggtgcaccctagcccgatccgcggcgccgccatggtcgccgagcaggccaccaccactgtggctgtgggcgagccgccaactgccaccccgcagccggcggcggcagcggctgcggggcagaggtccgtgcccacgccgttcctcaccaagacgtaccagctggtggacgacccggcggtggacgacgtcatctcgtggaacgacgacgggtcggccttcatcgtgtggcggccggcggagttcgcgcgcgacctcctgcccaagtacttcaagcacaacaacttctctagtttcgtgcgccagctcaacacctacgggttcaggaagatcgtgccggacaggtgggagttcgcgaacgactgcttccgccgagggcagaagcggctgctctgcgacatacaccgccggaaggtgacgctgccagtcgcggcggccacgagggcggtcacggtggtggcgaccatccccatggcgctgcccgtggactcgccggtgtactccggcgaggagcaggtgctgtcgtcaagctcgtcccccgagcccccgtcgctgctgcagcagcagccgacgccgtccgcgtctggctccggtgacatgggcgaggagaacgaacggctgcggcgggagaacgcgtggctcgcgcgcgagctcgggcagatgaagaagctgtgcaacaacatcctcctcctcatgtccaagtacgccgccactaagcagccggacgccgccaaggcggcggccgccgggaactgctccggcggcgagtcgtcgggcgccgccgcggcgcctccgcttccttcgatcctggagctcctgccctcctgccgccgcgaccccgcgtccgcggccgtcgacgcagcggcagcggcagcgggaacggagcacgaggttgatgaaaaggcgggcgctaggctgttcggcgtctccatcgggcggaaacgaatgcgggacgagagcagcggtcacggcggcggcggcgaggaccccgtgggccgctcggcggaggtgaaggcggagccggtggacgcgcgtctcgaccatcagcacagcgcgacggagccgcagtcgtggcccatttaccggcccaggccagtgtaccacccgctccgggcctgcagcggcttggtcagcgctgggagcgaccacgactggtccaacaactgaggtgacttttgcttgcaagcccaatcgtccacaggttacaggttaaacttagaatgagagatcaagtgtttatgtagcaataactttttgttagtttatctcatattaccgcaagtttcgagtatcattcatgtatagcgatccattaaactagaggttaccttactgaggacgacttgaattaaagtcagttgtttaaactgctagtcagttatttagactgttatcgttgtatttcataatgttaagtaaccctaattagggttatgtgggtaaatatctgctttgccaaaaaaaaaaaagaaaaaaaaaaaaaaaa

SEQ ID NO: 1623 - protein, 412 aa, Zea mays
  misc_feature: Ceres CLONE ID no.484753
  misc_feature: Bit score of 636.9 for HMM based on sequences of FIGURE 19.
  misc_feature (70)..(162): Pfam Name: HSF_DNA-bind Pfam Description: HSF-type DNA-binding
  misc_feature: Functional Homolog Of Ceres SEEDLINE ID no. ME20871 at SEQ ID NO. 1587
MLRDRKLPESTSTTFLSLSHSSCATVHPSPIRGAAMVAEQATTTVAVGEPPTATPQPAAAAAAGQRSVPTPFLTKTYQLVDDPAVDDVISWNDDGSAFIVWRPAEFARDLLPKYFKHNNFSSFVRQLNTYGFRKIVPDRWEFANDCFRRGQKRLLCDIHRRKVTLPVAAATRAVTVVATIPMALPVDSPVYSGEEQVLSSSSSPEPPSLLQQQPTPSASGSGDMGEENERLRRENAWLARELGQMKKLCNNILLLMSKYAATKQPDAAKAAAAGNCSGGESSGAAAAPPLPSILELLPSCRRDPASAAVDAAAAAAGTEHEVDEKAGARLFGVSIGRKRMRDESSGHGGGGEDPVGRSAEVKAEPVDARLDHQHSATEPQSWPIYRPRPVYHPLRACSGLVSAGSDHDWSNN

SEQ ID NO: 1624 - DNA, 921 bp, Sorghum bicolor
  misc_feature: Ceres ANNOT ID no.6035291
  misc_feature: Encodes the peptide sequence at SEQ ID NO. 1625
atggcgtcgccggcggcgggcactccgccgttcctgacgaagacgtacgccatggtcgaggacccgaccacggacgagacgatctcctggaacgacaccggcacggcgttcgtggtgtggcgccccgccgagttcgcacgcgacctcctccccaagcacttcaagcacagcaacttctcctcgttcgtccgccagctcaacacctacggattcaagaaggtagtggcggacagatgggagttcgccaacgacggcttccggagaggcgagaagcaccttctcggcgggatacagaggcggaaggggaccggcgccgtggcggcggtaccgacgccgggcataccgacggggataccgatctcgtccccgcccacgagctccggcggggagccggcggtctcgtcgtcgccgccgcgtggctcgacggctggagtgagcggcgcggtggccgagctggaggaggagaacgcgcggctgcggcgcgagaatgcgaggctggcgcgggagctggcccgcgcgcggcgcctctgcgacggcgtgcgccacctcgtggcgcggtacgaccaaggcagaggcggggatgaggatctggcggacggcgacgaagggcacggcggcggtggggaacgccccagcggcccgggagtgaagccaatgctgttcggcgtcccaatcggggccaagcggctacgcggcgcggatggagatggagacgatgttgatgacggcgaggacggggccgccgaggaaaatggcgagggcaacgacgaggaacaagacgaggacgaggagaggcacgcggcgcgggagcggggggttaaggcggccaggaggaacgagacgtcggatctggatgtgctgacgctgtccgtgcgggcggccgcggcggcgaggacgggtggagggtcacgtgaccgctaa

SEQ ID NO: 1625 - protein, 306 aa, Sorghum bicolor
  misc_feature: Ceres ANNOT ID no.6035291
  misc_feature: Bit score of 258.1 for HMM based on sequences of FIGURE 19.
  misc_feature (9)..(101): Pfam Name: HSF_DNA-bind Pfam Description: HSF-type DNA-binding
  misc_feature: Functional Homolog Of Ceres SEEDLINE ID no. ME20871 at SEQ ID NO. 1587
MASPAAGTPPFLTKTYAMVEDPTTDETISWNDTGTAFVVWRPAEFARDLLPKHFKHSNFSSFVRQLNTYGFKKVVADRWEFANDGFRRGEKHLLGGIQRRKGTGAVAAVPTPGIPTGIPISSPPTSSGGEPAVSSSPPRGSTAGVSGAVAELEEENARLRRENARLARELARARRLCDGVRHLVARYDQGRGGDEDLADGDEGHGGGGERPSGPGVKPMLFGVPIGAKRLRGADGDGDDVDDGEDGAAEENGEGNDEEQDEDEERHAARERGVKAARRNETSDLDVLTLSVRAAAAARTGGGSRDR

SEQ ID NO: 1626 - DNA, 1080 bp, Arabidopsis thaliana
  misc_feature: Ceres SEEDLINE ID no.ME21199
  misc_feature: Genomic Sequence
  misc_feature: Predicted Sequence
  misc_feature: Expected Sequence
  misc_feature: Encodes the peptide sequence at SEQ ID NO. 1630
atgatgttcttaccaaccgattattgttgcaggttaagcgatcaagagtatatggagcttgtgtttgagaatggccagattcttgcaaagggccaaagatccaacgtttctctgcataatcaacgtaccaaatcgatcatggatttgtatgaggcagagtataacgaggatttcatgaagagtatcatccatggtggtggtggtgccatcacaaatctcggggacacgcaggttgttccacaaagtcatgttgctgctgcccatgaaacaaacatgttggaaagcaataaacatgttgacgattctgagactttgaaagcttcttcatcaaagaggatgatggttgattatcataaccgaaagaagatcaagtttatacctcctgatgagcaatccgtggttgctgataggtcgttcaaattgggctttgacacttcctccgtaggtttcactgaagacagtgaaggatcgatgtatctaagcagtagtctagatgacgagtcagatgatgcgaggccacaagttcctgcaagaacaagaaaagctttggtcaaaagaaaacgaaatgcagaagcgtataattcacctgagagagtaagtaatctctttaagatacaaagcatagtgaacactgaatctgatacaacggacgacaacgaatcgatgttggatgaagcaatcaattatatgacaaaccttcaacttcaagttcagatgatgacgatgggtaacagatttgttacaccatcaatgatgatgcctttggggccgaactactctcagatgggtctagcaatgggtgtgggaatgcaaatgggcgaacaacagtttctgcctgcacatgttctaggagctggcttgcctgggattaatgattcagcagatatgctaaggtttcttaaccatcctggactaatgccaatgcaaaactctgcacctttcattccaacggaaaattgttccccacaatctgtccctccatcgtgcgctgctttccctaaccaaataccaaatcccaactctttgtcaaatttagatggtgcaaccttacacaagaaatcaaggaaaactaacagatga

SEQ ID NO: 1627 - DNA, 1080 bp, Arabidopsis thaliana
  misc_feature: Ceres SEEDLINE ID no.ME21199
  misc_feature: Inplanta Sequence
  misc_feature: Predicted Sequence
  misc_feature: Encodes the peptide sequence at SEQ ID NO. 1630
atgatgttcttaccaaccgattattgttgcaggttaagcgatcaagagtatatggagcttgtgtttgagaatggccagattcttgcaaagggccaaagatccaacgtttctctgcataatcaacgtaccaaatcgatcatggatttgtatgaggcagagtataacgaggatttcatgaagagtatcatccatggtggtggtggtgccatcacaaatctcggggacacgcaggttgttccacaaagtcatgttgctgctgcccatgaaacaaacatgttggaaagcaataaacatgttgacgattctgagactttgaaagcttcttcatcaaagaggatgatggttgattatcataaccgaaagaagatcaagtttatacctcctgatgagcaatccgtggttgctgataggtcgttcaaattgggctttgacacttcctccgtaggtttcactgaagacagtgaaggatcgatgtatctaagcagtagtctagatgacgagtcagatgatgcgaggccacaagttcctgcaagaacaagaaaagctttggtcaaaagaaaacgaaatgcagaagcgtataattcacctgagagagtaagtaatctctttaagatacaaagcatagtgaacactgaatctgatacaacggacgacaacgaatcgatgttggatgaagcaatcaattatatgacaaaccttcaacttcaagttcagatgatgacgatgggtaacagatttgttacaccatcaatgatgatgcctttggggccgaactactctcagatgggtctagcaatgggtgtgggaatgcaaatgggcgaacaacagtttctgcctgcacatgttctaggagctggcttgcctgggattaatgattcagcagatatgctaaggtttcttaaccatcctggactaatgccaatgcaaagctctgcacctttcattccaacggaaaattgttccccacaatctgtccctccatcgtgcgctgctttccctaaccaaataccaaatcccaactctttgtcaaatttagatggtgcaaccttacacaagaaatcaaggaaaactaacagatga

SEQ ID NO: 1628 - DNA, 1450 bp, Arabidopsis thaliana
  misc_feature: Ceres SEEDLINE ID no.ME21199
  misc_feature: Genomic Sequence
  misc_feature: Expected Sequence
  misc_feature: Encodes the peptide sequence at SEQ ID NO. 1631
atgatgttcttaccaaccgattattgttgcaggttaagcgatcaagagtatatggagcttgtgtttgagaatggccagattcttgcaaagggccaaagatccaacgtttctctgcataatcaacgtaccaaatcgatcatggatttgtatgaggcagagtataacgaggatttcatgaagagtatcatccatggtggtggtggtgccatcacaaatctcggggacacgcaggttgttccacaaagtcatgttgctgctgcccatgaaacaaacatgttggaaagcaataaacatgttgacgattctgagactttgaaagcttcttcatcaaagaggatgatggttgattatcataaccgaaagaagatcaagtttatacctcctgatgagcaatccgtggttgctgataggtcgttcaaattgggctttgacacttcctccgtaggtttcactgaagacagtgaaggatcgatgtatctaagcagtgtaagagggattgattcacaatttttttggtttggtctatcttgttaggttcttgtctgaagacaggttttgtctcaacgcagagtctagatgacgagtcagatgatgcgaggccacaagttcctgcaagaacaagaaaagctttggtcaaaagaaaacgaaatgcagaagcgtataattcacctgagagagtaagtaatctctttaagatacaaagcatagtgaacactgaatctgatacaacggtataatggtattgtgcaacacagaatcaaagaaatgatatcaacaagaaaatgcgtactttgcaaaatctactacctaactctcacaaggtttatcataagaaccaactttttcatttatttcgaaagagatcaaaagctttttaaagagtctatacttacatttccctaaatactcaatattgtccataggacgacaacgaatcgatgttggatgaagcaatcaattatatgacaaaccttcaacttcaagttcaggtataataaacaaatacttcaaacactttttcacatcaaaaacagattcaatctaaagattctttgtcctaacctgtataaatgttggatggtagatgatgacgatgggtaacagatttgttacaccatcaatgatgatgcctttggggccgaactactctcagatgggtctagcaatgggtgtgggaatgcaaatgggcgaacaacagtttctgcctgcacatgttctaggagctggcttgcctgggattaatgattcagcagatatgctaaggtttcttaaccatcctggactaatgccaatgcaaaactctgcacctttcattccaacggaaaattgttccccacaatctgtccctccatcgtgcgctgctttccctaaccaaataccaaatcccaactctttgtcaaatttagatggtgcaaccttacacaagaaatcaaggaaaactaacagatga

SEQ ID NO: 1629 - DNA, 1553 bp, Arabidopsis thaliana
  misc_feature: Ceres SEEDLINE ID no.ME21199
  misc_feature: Genomic Sequence
  misc_feature: Inplanta Sequence
  misc_feature: Encodes the peptide sequence at SEQ ID NO. 1630
  misc_feature (599)..(599): n is a, c, t, g, unknown, or other
tgatgtgatatctccactgacgtaagggatgacgcacaatcccactatccttcgcaagacccttcctctatataaggaagttcatttcatttggagagaacacgggggactctggcctgcagggccatcaccactgcagtggatggagcttgtgtttgagaatggccagattcttgcaaagggccaaagatccaacgtttctctgcataatcaacgtaccaaatcgatcatggatttgtatgaggcagagtataacgaggatttcatgaagagtatcatccatggtggtggtggtgccatcacaaatctcggggacacgcaggttgttccacaaagtcatgttgctgctgcccatgaaacaaacatgttggaaagcaataaacatgttgacgattctgagactttgaaagcttcttcatcaaagaggatgatggttgattatcataaccgaaagaagatcaagtttatacctcctgatgagcaatccgtggttgctgataggtcgttcaaattgggctttgacacttcctccgtaggtttcactgaagacagtgaaggatcgatgtatctaagcagtgtaagagggattgattcacaanttttttggtttggtctatcttgttaggttcttgtctgaagacaggttttgtctcaacgcagagtctagatgacgagtcagatgatgcgaggccacaagttcctgcaagaacaagaaaagctttggtcaaaagaaaacgaaatgcagaagcgtataattcacctgagagagtaagtaatctctttaagatacaaagcatagtgaacactgaatctgatacaacggtataatggtattgtgcaacacagaatcaaagaaatgatatcaacaagaaaatgcgtactttgcaaaatctactacctaactctcacaaggtttatcataagaaccaacttgttcatttatttcgaaagagatcaaaagctttttaaagagtctatacttacatttccctaaatactcaatattgtccataggacgacaacgaatcgatgttggatgaagcaatcaattatatgacaaaccttcaacttcaagttcaggtataataaacaaatacttcgaacactttttcacatcaaaaacagattcaatctaaagattctttgtcctaacctgtataaatgttggatggtagatgatgacgatgggtaacagatttgttacaccatcaatgatgatgcctttggggccgaactactctcagatgggtctagcaatgggtgtgggaatgcaaatgggcgaacaacagtttctgcctgcacatgttctaggagctggcttgcctgggattaatgattcagcagatatgctaaggtttcttaaccatcctggactaatgccaatgcaaagctctgcacctttcattccaacggaaaattgttccccacaatctgtccctccatcgtgcgctgctttccctaaccaaataccaaatcccaactctttgtcaaatttagatggtgcaaccttacacaagaaatcaaggaaaactaacagatgaccagagctctgg

SEQ ID NO: 1630 - protein, 359 aa, Arabidopsis thaliana
  misc_feature: Ceres SEEDLINE ID no.ME21199
MMFLPTDYCCRLSDQEYMELVFENGQILAKGQRSNVSLHNQRTKSIMDLYEAEYNEDFMKSIIHGGGGAITNLGDTQVVPQSHVAAAHETNMLESNKHVDDSETLKASSSKRMMVDYHNRKKIKFIPPDEQSVVADRSFKLGFDTSSVGFTEDSEGSMYLSSSLDDESDDARPQVPARTRKALVKRKRNAEAYNSPERVSNLFKIQSIVNTESDTTDDNESMLDEAINYMTNLQLQVQMMTMGNRFVTPSMMMPLGPNYSQMGLAMGVGMQMGEQQFLPAHVLGAGLPGINDSADMLRFLNHPGLMPMQSSAPFIPTENCSPQSVPPSCAAFPNQIPNPNSLSNLDGATLHKKSRKTNR

SEQ ID NO: 1631 - protein, 359 aa, Arabidopsis thaliana
  misc_feature: Ceres SEEDLINE ID no.ME21199
  misc_feature: Expected sequence
  misc_feature: Ceres ANNOT ID no.845310
  misc_feature: Expected Sequence
  misc_feature: Functional Homolog Of Ceres SEEDLINE ID no. ME21199 at SEQ ID NO. 1630
MMFLPTDYCCRLSDQEYMELVFENGQILAKGQRSNVSLHNQRTKSIMDLYEAEYNEDFMKSIIHGGGGAITNLGDTQVVPQSHVAAAHETNMLESNKHVDDSETLKASSSKRMMVDYHNRKKIKFIPPDEQSVVADRSFKLGFDTSSVGFTEDSEGSMYLSSSLDDESDDARPQVPARTRKALVKRKRNAEAYNSPERVSNLFKIQSIVNTESDTTDDNESMLDEAINYMTNLQLQVQMMTMGNRFVTPSMMMPLGPNYSQMGLAMGVGMQMGEQQFLPAHVLGAGLPGINDSADMLRFLNHPGLMPMQNSAPFIPTENCSPQSVPPSCAAFPNQIPNPNSLSNLDGATLHKKSRKTNR

SEQ ID NO: 1632 - protein, 359 aa, Arabidopsis thaliana; identical to SEQ ID NO: 1631
  misc_feature: Public GI ID no.6899919
  misc_feature: Functional Homolog Of Ceres SEEDLINE ID no. ME21199 at SEQ ID NO. 1630

SEQ ID NO: 1633 - DNA, 2172 bp, Arabidopsis thaliana
  misc_feature: Ceres SEEDLINE ID no.ME21508
  misc_feature: Predicted Sequence
  misc_feature: Expected Sequence
  misc_feature: Encodes the peptide sequence at SEQ ID NO. 1635
atgtcgaacaccgtcgaagatgacgacgacgacttccagatccctccttcctcacagctttcgattcgaaaacctcttcacccaaccaacgctaacaacatctctcaccgccctcctaacaaaaagcccagactctgccgttacccgggtaaagaaaatgtgactccgcctccttctccggatccggatctcttctgctcctcttctactcctcactgtatcttagattgtatcccatctagtgttgattgctctctaggagatttcaatggtccaatttcttctcttggtgaagaagataaagaggataaggacgactgtataaaggtgaatcgtgaaggttatttgtgtaattcgatggaggctaggttattgaaatcgagaatttgtctcgggtttgatagtggaatccatgaggatgatgaaggttttgttgagtctaactctgagcttgatgtgttgataaacctttgctctgagtctgagggtaggagtggagagtttagtttaggcaaggatgattcaattcaatgcccattgtgttccatggatatttcatctttgagtgaagagcagaggcaagttcatagcaatacttgtcttgataagtcatataatcagccttctgagcaagactccttgaggaaatgcgaaaatttgtcttctcttataaaagaatcgattgatgatccagttcagcttcctcagctagttaccgacttgtctccagtgctgaaatggcttaggagtctaggtttagctaaatatgaagatgtttttattcgtgaagagatcgactgggatacccttcagtcactcactgaggaggatcttctaagcataggtatcacgtcacttggtcccagaaagaagattgtgaatgcacttagcggagttagagatccctttgcatcttctgctgaagtgcaggcacagtctcattgtacaagtggccatgttacagagagacagagagataagtcaaccactcgtaaggcaagtgagcccaaaaaaccaactgcaaacaagttgattacagagtttttccctggtcaggctaccgagggcactaagatccggacagcccctaaacctgtcgcagaaaagagtccatcagattctagctctagacgtgctgtgagaagaaatggcaacaacggaaaatctaaagttattccacattggaattgcattccggggacaccttttcgagtggacgcattcaagtacctcacacgcgattgttgccactggtttcttacacactttcatctcgatcattatcaaggtttgacaaagtcatttagtcatgggaagatatactgttccttagttaccgcaaagttggtaaatatgaagattgggataccttgggagagactgcaagtcctggaccttggccagaaggttaatatttcaggcattgatgtgacatgctttgatgcaaaccactgtccgggatccatcatgatactctttgaaccagccaacggtaaggctgttctacatacgggggatttccgctatagtgaagagatgtcaaattggttgattggatcgcatatcagctctcttattcttgatactacatactgtaacccccagtatgactttccaaagcaagaggcggtaatacagtttgttgttgaggctattcaagcagaagcatttaatcccaagacccttttcttaattggaagctacaccatcggaaaggagaggctgttcttggaagttgcacgtgtgctacgggaaaagatatacatcaatcctgcgaaactaaaactcctcgagtgtttgggattctcaaaggatgatatacagtggtttacagtgaaggaagaggaaagccacattcacgttgtgcctttgtggacgcttgccagtttcaaacggctgaagcatgtagctaaccgatacacaaaccgttacagccttatcgttgcattttctcctactggttggacatctggtaagactaaaaagaagtccccaggaagaaggttgcaacagggtacaataataaggtacgaggttccttacagtgagcatagcagcttcacggagctaaaagagtttgtgcaaaaagtgtcacctgaagtcatcataccgagtgtaaacaatgatggacctgactctgcagctgcaatggtgtctttgttggttacgtag

SEQ ID NO: 1634 - DNA, 3491 bp, Arabidopsis thaliana
  misc_feature: Ceres SEEDLINE ID no.ME21508
  misc_feature: Genomic Sequence
  misc_feature: Expected Sequence
  misc_feature: Encodes the peptide sequence at SEQ ID NO. 1635
ttttgcctcgccggtatctaaatgtcgaacaccgtcgaagatgacgacgacgacttccagatccctccttcctcacagctttcgattcgaaaacctcttcacccaaccaacgctaacaacatctctcaccgccctcctaacaaaaagcccagactctgccgttacccgggtaaagaaaatgtgactccgcctccttctccggatccggatctcttctgctcctcttctactcctcactgtatcttagattgtatcccatctagtgttgattgctctctaggagatttcaatggtccaatttcttctcttggtgaagaagataaagaggataaggacgactgtataaaggtgaatcgtgaaggttatttgtgtaattcgatggaggctaggttattgaaatcgagaatttgtctcgggtttgatagtggaatccatgaggatgatgaaggttttgttgagtctaactctgagcttgatgtgttgataaacctttgctctgagtctgagggtaggagtggagagtttagtttaggcaaggatgattcaattcaatgcccattgtgttccatggatatttcatctttgagtgaagagcagaggcaagttcatagcaatacttgtcttgataagtcatataatcagccttctgagcaagtaagcttctttgttatctcataactggaattgatatcaaccttcaatttaggttaatacaatgaagtatactgtgttcaattgttacatcgttacgccattgattgactgctgatttgtaaatatgattattgtaggactccttgaggaaatgcgaaaatttgtcttctcttataaaagaatcgattgatgatccagttcagcttcctcagctagttaccgacttgtctccagtgctgaaatggcttaggagtctaggtttagctaaatatgaagatgtttttattcgtgaagagatcgactgggatacccttcagtcactcactgaggaggtaatggaactaaagtttacttatttatttatttacacagagaaacagaattgagtattgacaaggttatacttccacaggatcttctaagcataggtatcacgtcacttggtcccagaaagaagattgtgaatgcacttagcggagttagagatccctttgcatcttctgctgaagtgcaggcacagtctcattgtacaagtggccatgttacagagagacagagagataagtcaaccactcgtaaggcaagtgagcccaaaaaaccaactgcaaacaagttgattacagagtttttccctggtcaggctaccgagggcactaagatccggacagcccctaaacctgtcgcagaaaagagtccatcagattctagctctagacgtgctgtgagaagaaatggcaacaacggaaaatctaaagttattccacattggaattgcattccggggacaccttttcgagtggtaatgttacataacaagctaggtcatggtttaacttctccgcatgaatgcaacaaccttattacatatgcatccttctcattcaagtcaaatatgctcatgaaattagatttaaaacgtcatgctgatgctgaatatttatcttttaagtaatctttatgtttggtgacttttctggtttaatatatgtatgcaggacgcattcaagtacctcacacgcgattgttgccactggtttcttacacactttcatctcgatcgtaagtagtcagctgtatgtctaattataaattactacacagaagaagcctgcatatcgtggaatcaatgcttaaagtctctgtattctcattcacagattatcaaggtttgacaaagtcatttagtcatgggaagatatactgttccttagttaccgcaaagttggtaaatatgaagattgggataccttgggagagactgcaagtcctggaccttggccagaaggttaatatttcaggcattgatgtgacatgctttgatgcaaaccactgtccgggatccatcatgatactctttgaaccagccaacggtaaggtgcgttcttaaattagaaactttcagtgtgtagtcgtaagcctatgtttaactttccattcacaaaggaattgtccatggactctgttgatttgtataggctgttctacatacgggggatttccgctatagtgaagagatgtcaaattggttgattggatcgcatatcagctctcttattcttgatactacatactgtaacccccaggttcgtcatccatcaatactttgtagcataaagaaagctcaagtttttcagttaataactctattcggttttaattcgtatttgaaatccatttttgccacaagttttcctgcatgatttccactcttttgcgatttcttcatcttacatttaagttgaacgaagaagagaactttagagtttacgttttcttttcaaagcaagagtggtttgatacaaatgcatcatttgtttgcagtatgactttccaaagcaagaggcggtaatacagtttgttgttgaggctattcaagcagaagcatttaatcccaagacccttttcttaattggaagctacaccatcggtaatatgttcactcttctttttccgtttcgatatatcatgttgagatctaaattcttccatctcttctcttttgaaaggaaaggagaggctgttcttggaagttgcacgtgtgctacgggaaaagatatacatcaatcctgcgaaactaaaactcctcgagtgtttgggattctcaaaggatgatatacagtggtttacagtgaaggaagaggaaagccacattcacgttgtgcctttgtggacgcttgccagtttcaaacggctgaagcatgtagctaaccgatacacagtaagaaacacatccattcggtttgactgtcaaagaaaaacaaaagaagtgataatcttattggctgatttcgttagaggttgagttctaatactgttttctgtcctgcagaaccgttacagccttatcgttgcattttctcctactggttggacatctggtaagactaaaaagaagtccccaggaagaaggttgcaacagggtacaataataaggtaaactttttgcctatcttcatgtcctgtggcattgggctcaaaatcatgaggcggagaatctttatatatatttcaggtacgaggttccttacagtgagcatagcagcttcacggagctaaaagagtttgtgcaaaaagtgtcacctgaagtcatcataccgagtgtaaacaatgatggacctgactctgcagctgcaatggtgtctttgttggttacgtagaactgtgtttacatctgcgataagctttgcaacaaaaaggcagcctccttgactaccaattgagcagagacgtcaaagatctacaacgaaaatggatatgttatgttctatctaattgtagttatgtaaccacatgattatgtagtgtttttcatcacaaactccgaatgcatttgttat

SEQ ID NO: 1635 - protein, 723 aa, Arabidopsis thaliana
  misc_feature: Ceres SEEDLINE ID no.ME21508
  misc_feature: Bit score of 1740.2 for HMM based on sequences of FIGURE 20.
  misc_feature (237)..(300): Pfam Name: SAM_1 Pfam Description: SAM domain (Sterile alpha motif)
  misc_feature (609)..(707): Pfam Name: DRMBL Pfam Description: DNA repair metallo-beta-lactamase
MSNTVEDDDDDFQIPPSSQLSIRKPLHPTNANNISHRPPNKKPRLCRYPGKENVTPPPSPDPDLFCSSSTPHCILDCIPSSVDCSLGDFNGPISSLGEEDKEDKDDCIKVNREGYLCNSMEARLLKSRICLGFDSGIHEDDEGFVESNSELDVLINLCSESEGRSGEFSLGKDDSIQCPLCSMDISSLSEEQRQVHSNTCLDKSYNQPSEQDSLRKCENLSSLIKESIDDPVQLPQLVTDLSPVLKWLRSLGLAKYEDVFIREEIDWDTLQSLTEEDLLSIGITSLGPRKKIVNALSGVRDPFASSAEVQAQSHCTSGHVTERQRDKSTTRKASEPKKPTANKLITEFFPGQATEGTKIRTAPKPVAEKSPSDSSSRRAVRRNGNNGKSKVIPHWNCIPGTPFRVDAFKYLTRDCCHWFLTHFHLDHYQGLTKSFSHGKIYCSLVTAKLVNMKIGIPWERLQVLDLGQKVNISGIDVTCFDANHCPGSIMILFEPANGKAVLHTGDFRYSEEMSNWLIGSHISSLILDTTYCNPQYDFPKQEAVIQFVVEAIQAEAFNPKTLFLIGSYTIGKERLFLEVARVLREKIYINPAKLKLLECLGFSKDDIQWFTVKEEESHIHVVPLWTLASFKRLKHVANRYTNRYSLIVAFSPTGWTSGKTKKKSPGRRLQQGTIIRYEVPYSEHSSFTELKEFVQKVSPEVIIPSVNNDGPDSAAAMVSLLVT

SEQ ID NO: 1636 - DNA, 2226 bp, Populus balsamifera subsp. trichocarpa
  misc_feature: Ceres ANNOT ID no.1508307
  misc_feature: Encodes the peptide sequence at SEQ ID NO. 1637
atgtcctcaaaattcaattcgtcccaattttcctccctcgacgacgacgacgacgacttccaaatccctctctcccaaacaccaaaacagactctttctatccgcaacaaacccgctgacaatcctcgccgtccgtcaaaaaagccaaagaaaccccccaatcccggcaaagaaaatatagatcccaactctctactcctatatcagaaaactgagtccggtgccaatgacttcaatttagacgagaattgcagtttggattttatagagtcaagcatcgattgtactgtttcttctaaagttggaaacgagaaatttgatagcgggagcggtaaaaaagaaaaattggaagtgagtggaggatatttgtgtaattcgattgaggctaggttaatgaaatcaagagtggattatagtggagttaatgttggtaatgaagaggatttcgaagaaaatagtgagcttgatgccttaattaagttatgtaccgaggaagaagaaagtgaagctagagagaaaattaaggttaattgtaatggcgatgaatgttgttttgtcttatgtccgctttgtgggacagatatttcggatttgagcgaggaatttcgattagttcatactaacgagtgcctggataaagaagaaaatagtgttacatatgtgagtgtttttaggattcttgttgttcttggtggtgatgacggcagacctgaggttgtgccacgaggcgtggagggtcctgtttgtggtccgaagaaagttgttgtgtcacctgttgttaaatggctaaggaatctgggtttagagagatatgaagaggattttgttcgagaagagattgattgggagactttacagtggctgacagaagaggacctctttggcattggtgtcactgcacttggtcctaggaagaagattgtgcatgctcttagtgagcttagaaaagggtctaatcacgcaatcgaggcacatggagatgcacacgcctttggtgaagttggttcacggagaagccatggagcagaaatgcaagtagaggcttctaaaattattggcgatgacactagtaaaccaactgcaaacaaattgattacggattattttcctggatctgtacctatcaagaaaaaaactagtgtcatctctaaagaacaacggggagcagaaaaaagtcagccaggctatgttcgtaaacaaggggtgaaaaactatactaaaaaaggaaagttcaaagatattcctttgtggtgtagcataccagggacaccatttagagtggatgctttcaaatatcttagaggagattgttcccattggtttcttactcacttccacatggaccattatcaaggattaacaaggtctttctgtcatgggaagatttactgctccttgatcacagcaaagcttgtaaatttaaagattgggatcccttgggatagtttacatgttttacctctcaaccaaaagatctgtattgctggtgttgatgtgacatgcttggatgcaaaccactgtccaggctccattataattctcttcgaacctcccaatggtaaggctgtgctacacacgggagattttcgtttttctgagaagatggttacaatgcctgttttgcaaatgtcttctatccatactctcatccttgatactacatattgtaatgcccaggaggctgtaatacaatttgtcattgaggccattcaagctgaagctttcaaccccaaaacactttttttgatcggaagctatacaattggaaaggaaaggttgtttttggaggttgctcgtgtgctccataagaaggtttatgtcaacatggcaaaattccgtcttttagaatgcttggggttccctgaagaagatatgaggtggattacattaaatgaacaagaaagccacattcatgttgtgcctatgtggacgcttgcaagcttcaaaagattgaaacatttatcgagtcaatatgcaggtcgattcactctcatagttgctttctcccccactggctggacatttggtaaagggaagaagaaatctccagggagaaggtgtcagcagggaactattataagatacgaagtaccatacagtgagcattgcagttttacagaactcagagagtttgtgaagtttgtgtctcctgaaaacataataccaagtgtaaataatgatggaccagattctgccaatgatatggtttccctcctgctgtcttga

SEQ ID NO: 1637 - protein, 741 aa, Populus balsamifera subsp. trichocarpa
  misc_feature: Ceres ANNOT ID no.1508307
  misc_feature: Bit score of 1820.0 for HMM based on sequences of FIGURE 20.
  misc_feature (256)..(315): Pfam Name: SAM_1 Pfam Description: SAM domain (Sterile alpha motif)
  misc_feature (627)..(725): Pfam Name: DRMBL Pfam Description: DNA repair metallo-beta-lactamase
  misc_feature: Functional Homolog Of Ceres SEEDLINE ID no. ME21508 at SEQ ID NO. 1635
MSSKFNSSQFSSLDDDDDDFQIPLSQTPKQTLSIRNKPADNPRRPSKKPKKPPNPGKENIDPNSLLLYQKTESGANDFNLDENCSLDFIESSIDCTVSSKVGNEKFDSGSGKKEKLEVSGGYLCNSIEARLMKSRVDYSGVNVGNEEDFEENSELDALIKLCTEEEESEAREKIKVNCNGDECCFVLCPLCGTDISDLSEEFRLVHTNECLDKEENSVTYVSVFRILVVLGGDDGRPEVVPRGVEGPVCGPKKVVVSPVVKWLRNLGLERYEEDFVREEIDWETLQWLTEEDLFGIGVTALGPRKKIVHALSELRKGSNHAIEAHGDAHAFGEVGSRRSHGAEMQVEASKIIGDDTSKPTANKLITDYFPGSVPIKKKTSVISKEQRGAEKSQPGYVRKQGVKNYTKKGKFKDIPLWCSIPGTPFRVDAFKYLRGDCSHWFLTHFHMDHYQGLTRSFCHGKIYCSLITAKLVNLKIGIPWDSLHVLPLNQKICIAGVDVTCLDANHCPGSIIILFEPPNGKAVLHTGDFRFSEKMVTMPVLQMSSIHTLILDTTYCNAQEAVIQFVIEAIQAEAFNPKTLFLIGSYTIGKERLFLEVARVLHKKVYVNMAKFRLLECLGFPEEDMRWITLNEQESHIHVVPMWTLASFKRLKHLSSQYAGRFTLIVAFSPTGWTFGKGKKKSPGRRCQQGTIIRYEVPYSEHCSFTELREFVKFVSPENIIPSVNNDGPDSANDMVSLLLS

SEQ ID NO: 1638 - DNA, 2226 bp, Populus balsamifera subsp. trichocarpa
  misc_feature: Ceres ANNOT ID no.1455110
  misc_feature: Encodes the peptide sequence at SEQ ID NO. 1639
atgtcctcaaaattcaattcgtcccaattttcctccctcgacgacgacgacgacgacttccaaatccctctctcccaaacaccaaaacagactctttctatccgcaacaaacccgctgacaatcctcgccgtccgtcaaaaaagccaaagaaaccccccaatcccggcaaagaaaatatagatcccaactctctactcctatatcagaaaactgagtccggtgccaatgacttcaatttagacgagaattgcagtttggattttatagagtcaagcatcgattgtactgtttcttctaaagttggaaacgagaaatttgatagcgggagcggtaaaaaagaaaaattggaagtgagtggaggatatttgtgtaattcgattgaggctaggttaatgaaatcaagagtggattatagtggagttaatgttggtaatgaagaggatttcgaagaaaatagtgagcttgatgccttaattaagttatgtaccgaggaagaagaaagtgaagctagagagaaaattaaggttgttcttggtggtgatgacggcagacctgaggttgtgccacgaggcgtggagggtcctgtttgtggtccgaagaaagttgttgtgtcacctgttgttaaatggctaaggaatctgggtttagagagatatgaagaggattttgttcgagaagagattgattgggagactttacagtggctgacagaagagggaatgctagttggggccttaaccagtgcttgccacacctggaaagaactctttaaggcccacaacataaaaaatgcaggatttggttcaagaactgaagtagtaggattaggaatgtcaggaggacgagcagcacaggacctctttggcattggtgtcactgcacttggtcctaggaagaagattgtgcatgctcttagtgagcttagaaaagggtctaatcacgcaatcgaggcacatggagatgcacacgcctttggtgaagttggttcacggagaagccatggagcagaaatgcaagtagaggcttctaaaattattggcgatgacactagtaaaccaactgcaaacaaattgattacggattattttcctggatctgtacctatcaagaaaaaaactagtgtcatctctaaagaacaacggggagcagaaaaaagtcagccaggctatgttcgtaaacaaggggtgaaaaactatactaaaaaaggaaagttcaaagatattcctttgtggtgtagcataccagggacaccatttagagtggatgctttcaaatatcttagaggagattgttcccattggtttcttactcacttccacatggaccattatcaaggattaacaaggtctttctgtcatgggaagatttactgctccttgatcacagcaaagcttgtaaatttaaagattgggatcccttgggatagtttacatgttttacctctcaaccaaaagatctgtattgctggtgttgatgtgacatgcttggatgcaaaccactgtccaggctccattataattctcttcgaacctcccaatggtaaggctgtgctacacacgggagattttcgtttttctgagaagatggttacaatgcctgttttgcaaatgtcttctatccatactctcatccttgatactacatattgtaatgcccagtatgactttccgaagcaggaggctgtaatacaatttgtcattgaggccattcaagctgaagctttcaaccccaaaacactttttttgatcggaagctatacaattggaaaggaaaggttgtttttggaggttgctcgtgtgctccataagaaggtttatgtcaacatggcaaaattccgtcttttagaatgcttggggttccctgaagaagatatgaggtggattacattaaatgaacaagaaagccacattcatgttgtgcctatgtggacgcttgcaagcttcaaaagattgaaacatttatcgagtcaatatgcaggtcgattcactctcatagttgctttctcccccactggctggacatttggtaaagggaagaagaaatctccagggagaaggtgtcagcagggaactattataagatacgaagtaccatacagtgagcattgcagttttacagaactcagagagtttgtgaagtttgtgtctcctgaaaacataataccaagtgtaaataatgatggaccagattctgccaatgatatggtttccctcctgctgtcttga

SEQ ID NO: 1639 - protein, 741 aa, Populus balsamifera subsp. trichocarpa
  misc_feature: Ceres ANNOT ID no.1455110
  misc_feature: Bit score of 1629.3 for HMM based on sequences of FIGURE 20.
  misc_feature (284)..(309): Pfam Name: SAM_1 Pfam Description: SAM domain (Sterile alpha motif)
  misc_feature (627)..(725): Pfam Name: DRMBL Pfam Description: DNA repair metallo-beta-lactamase
  misc_feature: Functional Homolog Of Ceres SEEDLINE ID no. ME21508 at SEQ ID NO. 1635
MSSKFNSSQFSSLDDDDDDFQIPLSQTPKQTLSIRNKPADNPRRPSKKPKKPPNPGKENIDPNSLLLYQKTESGANDFNLDENCSLDFIESSIDCTVSSKVGNEKFDSGSGKKEKLEVSGGYLCNSIEARLMKSRVDYSGVNVGNEEDFEENSELDALIKLCTEEEESEAREKIKVVLGGDDGRPEVVPRGVEGPVCGPKKVVVSPVVKWLRNLGLERYEEDFVREEIDWETLQWLTEEGMLVGALTSACHTWKELFKAHNIKNAGFGSRTEVVGLGMSGGRAAQDLFGIGVTALGPRKKIVHALSELRKGSNHAIEAHGDAHAFGEVGSRRSHGAEMQVEASKIIGDDTSKPTANKLITDYFPGSVPIKKKTSVISKEQRGAEKSQPGYVRKQGVKNYTKKGKFKDIPLWCSIPGTPFRVDAFKYLRGDCSHWFLTHFHMDHYQGLTRSFCHGKIYCSLITAKLVNLKIGIPWDSLHVLPLNQKICIAGVDVTCLDANHCPGSIIILFEPPNGKAVLHTGDFRFSEKMVTMPVLQMSSIHTLILDTTYCNAQYDFPKQEAVIQFVIEAIQAEAFNPKTLFLIGSYTIGKERLFLEVARVLHKKVYVNMAKFRLLECLGFPEEDMRWITLNEQESHIHVVPMWTLASFKRLKHLSSQYAGRFTLIVAFSPTGWTFGKGKKKSPGRRCQQGTIIRYEVPYSEHCSFTELREFVKFVSPENIIPSVNNDGPDSANDMVSLLLS

SEQ ID NO: 1640 - DNA, 1422 bp, Populus balsamifera subsp. trichocarpa
  misc_feature: Ceres ANNOT ID no.1525218
  misc_feature: Encodes the peptide sequence at SEQ ID NO. 1641
atgagcacaatcggcggcgctggaggagattatgattccaaagaagaatggaccgaatttgaatggttggaagatgcgctctcaattatagagaatattgaggagcaaagttaccagattcatccatcgattaaacaagaagaagaagaagaagatggagatggtggtgatgggagtttctctgccgaattctatcggtgtggaaccgattggtcttgcctgtcgccggcggctgaagtagttgaaccttcccattcaagaaatctgaaacaggcgaatctatggcagatgtggggccaaaacaaaccttcttccctttcctctccgcctccgaagaagaagctgaagccaactcaattttgcagccaaggcaaggcggcttcctcgtctcctaagcataaccgccctcgcgcttgccctttctataaacggattccagttgatgcattccggtatggtccgatcccaggatgctctgcgtacttcctgacccacttccattatgatcattacggtggccttaccaaaggatggtctcatggccctatttattgtactcctctcactgctcgcctccttacaatctgtctctccctcaattccttatatattcatccattggaacttgacacagaatatgttattcaaggagttaaagtaacattactagaagctaatcactgtcccggtgctgctctccttcatttccgtctcccgactggactctgctatttgcacactggagatttcagggcttctaaacttatgcaggcccatccacttcttgcaaacaacagagttaacgtgctttacttagatacaacctattgcaatccaaagtacaagtttccttcaaaggaagatgtgttgagttatgttgttagagttactaagagttctctcaaaaagcaacctaaaacccttgttgttgtcggagcgtatagtattggcaaagagagtgtttatcttgccatttccaaggcattaggggttaaaatatatgcaaataattcaaggagacggattctgcaatcttttggttggcctgatctttcgacgaatctttgtacaaaagctatagacacatgtcttcatgtgctgcccatatcttccctgcgatatgagaccttgaaggattacttgaagaatcatgtaaatcagtatgcagcagttttggcattccggccaacaggctggacttactcagaaggtttaggcagagagcttgatctaattaggcctagcactagaggcaacatcacaatatatggagttccatacagtgagcactctagtttcacagagctgagagactttgtcgagtttttgaagcctgacaagataattcctacagtaaatgttgggaatccagataatcgagataagatgcaatcttatttccgggaatggcttaaagggtag

SEQ ID NO: 1641 - protein, 377 aa, Populus balsamifera subsp. trichocarpa
  misc_feature: Ceres ANNOT ID no.1525218
  misc_feature: Bit score of 574.8 for HMM based on sequences of FIGURE 20.
  misc_feature (258)..(357): Pfam Name: DRMBL Pfam Description: DNA repair metallo-beta-lactamase
  misc_feature: Functional Homolog Of Ceres SEEDLINE ID no. ME21508 at SEQ ID NO. 1635
MWGQNKPSSLSSPPPKKKLKPTQFCSQGKAASSSPKHNRPRACPFYKRIPVDAFRYGPIPGCSAYFLTHFHYDHYGGLTKGWSHGPIYCTPLTARLLTICLSLNSLYIHPLELDTEYVIQGVKVTLLEANHCPGAALLHFRLPTGLCYLHTGDFRASKLMQAHPLLANNRVNVLYLDTTYCNPKYKFPSKEDVLSYVVRVTKSSLKKQPKTLVVVGAYSIGKESVYLAISKALGVKIYANNSRRRILQSFGWPDLSTNLCTKAIDTCLHVLPISSLRYETLKDYLKNHVNQYAAVLAFRPTGWTYSEGLGRELDLIRPSTRGNITIYGVPYSEHSSFTELRDFVEFLKPDKIIPTVNVGNPDNRDKMQSYFREWLKG

SEQ ID NO: 1642 - protein, 484 aa, Arabidopsis thaliana
  misc_feature: Public GI ID no.1495267
  misc_feature: Bit score of 1056.4 for HMM based on sequences of FIGURE 20.
  misc_feature (365)..(464): Pfam Name: DRMBL Pfam Description: DNA repair metallo-beta-lactamase
  misc_feature: Functional Homolog Of Ceres SEEDLINE ID no. ME21508 at SEQ ID NO. 1635
MDFSDEDDDENCFGSRFNDGVNEEEEDEEGFVFNDDVEENEEEEGFASDFYKAGSDWSCLVEDEETVSSSVKKMKQSNLFQIWGLQENSPDTTKKMKQTDLFQSWGLQKPSPFTSPASNSAKKTTSALGKRRRDSSFSNDSPRPCPFYKKLPGTPFTVDAFRYGCVQGCSAYFLTHFHADHYIGLTKAWSHGPIYCSSLTSRLLRLSLSVNPSSIHPLELDVEYTINGIKVTLIEANHCPGAALIHFRLLDGTCYLHTGDFRASKQMQTHPLLFNQRVHVLYLDTTYCNPRYKFPSKEDVLSYVVRITKDFLRKQPKTLIVVGSYSIGKECVYLAIAKALGVKIFANASRRRILQSFGWDDISKNLSTDGKATCLHVLPMSSLKVERLDEHLKIYREQYGAVLAFRPTGWTYSEKIGEHLDLIKPTSRGKITIYGVPYSEHSSFTELREFVQFLRPDKIIPTVNNGNAGTREKMQSCFREWLRP

SEQ ID NO: 1643 - protein, 484 aa, Arabidopsis thaliana
  misc_feature: Public GI ID no.15231597
  misc_feature: Bit score of 1053.9 for HMM based on sequences of FIGURE 20.
  misc_feature (365)..(464): Pfam Name: DRMBL Pfam Description: DNA repair metallo-beta-lactamase
  misc_feature: Functional Homolog Of Ceres SEEDLINE ID no. ME21508 at SEQ ID NO. 1635
MDFSDEDDDENCFGSRFNDGVNEEEEDEEGFVFNDDVEENEEEEGFASDFYKAGSDWSCLVEDEETVSSSVKKMKQSNLFQIWGLQENSPDTTKKMKQTDLFQSWGLQKPSPFTSPASNSAKKTTSALGKRRRDSSFSNDSPRPCPFYKKLPGTPFTVDAFRYGCVQGCSAYFLTHFHADHYIGLTKAWSHGPIYCSSLTSRLLRLSLSVNPSSIHPLELDVEYTINGIKVTLIEANHCPGAALIHFRLLDGTCYLHTGDFRASKQMQTHPLLFNQRVHVLYLDTTYCNPRYKFPSKEDVLSYVVRITKDFLRKQPKTLIVVGSYSIGKECVYLAIAKALGVKIFANASRRRILQSFGWDDISKNLSTDGKATCLHVLPMSSLKVERLDEHLKIYREQYGAVLAFRPTGWTYSEKIGEHLDLIKPTSRGKITIYGVPYSEHSSFTELREFVQFLRPDKIIPTVNNGNAGTREKMQSCFREWLRR

SEQ ID NO: 1644 - protein, 511 aa, Medicago truncatula
  misc_feature: Public GI ID no.87241310
  misc_feature: Bit score of 1115.3 for HMM based on sequences of FIGURE 20.
  misc_feature (392)..(491): Pfam Name: DRMBL Pfam Description: DNA repair metallo-beta-lactamase
  misc_feature: Functional Homolog Of Ceres SEEDLINE ID no. ME21508 at SEQ ID NO. 1635
MSFPTAASPPAASEAGTLHHDDGDSYNVNDDDASFDAIRLDDEGFPSQQLPIESPSPNGSEKSSFAADFYRCGSDCSSLLTPERDSLSSGKKLKQANLFQIWGFKRNVEFESPNQGGYCDVVGEGSVSSEKKSVKRGNWGSILRDTGKVVENSKSTGKRKSFHGEKRVTRSCPFYKKMPGTNFTVDAFRYGCVEECSAYFLSHFHADHYGGLSKKWSHGPIYCSPLTGRLVQMCLYVNPSYICPLEFDTEYVIDGIKVTLIDANHCPGAALIHFELPNGQCYLHTGDFRACKLMQDYHLFVNKRVNVLYLDTTYCNPKYKFPSKDDVLNYVVKITNNHLKKYPRTLVVVGAYSIGKECVYLAISKALGVKIHVNASRRRILLAYDCPDYSDRLCTNGNNTLLHVLPMSSLRIETLKEYLKTYKEQFTSVLAFRPTGWTFSEKIGNDLALIKPVSNGNITTYGVPYSEHSSFTELRDFVQFLRPDKIIPTVNVGNAANREKMQSYFRDWLKG

SEQ ID NO: 1645 - DNA, 1710 bp, Triticum aestivum
  misc_feature: Ceres CLONE ID no.938390
  misc_feature: Encodes the peptide sequence at SEQ ID NO. 1646
cctcttcttccctccccactcccgccgctcgtttcaaaccctccttgcgaccccagccgcgatggtcgccgccatcgccggcgacgccgaaaccgacctgaccctgcccatttcggacgacctcgacgacaacggtttccccgcgtcaccccccaccgcacccgccaccagcagcttcgccgacgacttctaccgcagcggcatcgactggtcctccctgcaagcccctccttctcatcggagaaggccagccgatggaacaacggagaaattttgcggcccgttggttcagaagaacctcttccaggcgtgggggatcgagaagccagcctctggaatgacggagaaagtttgcggcccgccggttcagaagaacctcttccaggcgtggggaatccagaagccgccgcgggaagaggcggcgcagggggtccccgttggggctggggcttcctcctcttccccttctccttctgttgctgggtccggtaggaagcggcgctggggaggctcggacgagaacggggcgtccaggaagcccgtcgcttgccccttctacaagcagattcccggtacgccgttcacggtggacgcatttcggtatggagcagttgagtggtgctctgcttattttctcagccatttccattatgatcattacggtgggttaaccaagaagtggtgtcatggtcctatctattgtactgcactcactgcacgcctggtgaagatgttactatcaattgactctgcgtatgtttgtcccttggagcttgatactgagtatgtcattgacggagtgaaggttaccttcttggaggccaatcattgccctggtgcagctctaattcactttcgtcctagtgatggcaagacctatctccacactggggattttagagcatcaaaatccatgcaattgcacccactcctccaaactggctgcataagtttgctttatctggatacaacatattgcaatccaaaatacaaatttccaccacaggaggatgttattgattttgttgtcaggacagctcaaaggtatctaaagaagcaaccaaagacacttattgttgttggggcatatagcatcgggaaagagaatgtctatctagcaatttctcaagctttagaggtccctatatacactgatgcatcacgaaggcggattcttcactcatttggctggccggacttgtccaaaaggataagttcatgcaatcaaagttcaccacttcatgttctgccccttgcatcactgcaacatgagaacttgaagaagtacttggagactcttgatcaaagatttctagctgtgctggcttttcgacctacaggttggactttttctgaggcagctggaaaggagcttgacttaattaaacctagctctagaggcagagttacaatctatggtgtaccttatagcgagcactcaagtttcagcgagcttagggactttttgaagtttctgagacctcaaaaggtaattcccactgttaatgttggtaatgcggcaaaccgagataaaatgcaagcttatttccgggaatggctcaagggcacgtgatggatggaggcatgaagcatgatcagttatgtaagcctcatatgtggaattttcagtgtggtatctgttgtacgccttcctacatttaacagtctaataatgctttgtatcttcgtgaaagaaaaaaaaaaaaaaaa

SEQ ID NO: 1646 - protein, 503 aa, Triticum aestivum
  misc_feature: Ceres CLONE ID no.938390
  misc_feature: Bit score of 1115.3 for HMM based on sequences of FIGURE 20.
  misc_feature (383)..(482): Pfam Name: DRMBL Pfam Description: DNA repair metallo-beta-lactamase
  misc_feature: Functional Homolog Of Ceres SEEDLINE ID no. ME21508 at SEQ ID NO. 1635
MVAAIAGDAETDLTLPISDDLDDNGFPASPPTAPATSSFADDFYRSGIDWSSLQAPPSHRRRPADGTTEKFCGPLVQKNLFQAWGIEKPASGMTEKVCGPPVQKNLFQAWGIQKPPREEAAQGVPVGAGASSSSPSPSVAGSGRKRRWGGSDENGASRKPVACPFYKQIPGTPFTVDAFRYGAVEWCSAYFLSHFHYDHYGGLTKKWCHGPIYCTALTARLVKMLLSIDSAYVCPLELDTEYVIDGVKVTFLEANHCPGAALIHFRPSDGKTYLHTGDFRASKSMQLHPLLQTGCISLLYLDTTYCNPKYKFPPQEDVIDFVVRTAQRYLKKQPKTLIVVGAYSIGKENVYLAISQALEVPIYTDASRRRILHSFGWPDLSKRISSCNQSSPLHVLPLASLQHENLKKYLETLDQRFLAVLAFRPTGWTFSEAAGKELDLIKPSSRGRVTIYGVPYSEHSSFSELRDFLKFLRPQKVIPTVNVGNAANRDKMQAYFREWLKGT

SEQ ID NO: 1647 - DNA, 1859 bp, Zea mays
  misc_feature: Ceres CLONE ID no.272338
  misc_feature: Encodes the peptide sequence at SEQ ID NO. 1648
acggcccatctggccatcagattagcaagaccaacaaatgcaacactgatacgttcccttagaacccacctcctatggccaccgtcgactgccccctgccctctcccgcggacctcgacgacaacggattcccggctctaccctcatcccccgctgcctgtagcagcggcttcgcggaggacttctaccgcagcggcaccgactggtcctccttacgcgcccctccgccgctggggccgcccagaagggcacccggtgtgaaggagagaggaggcggctcggccgtgcagagcagcctcttccaggcgtgggggatcgagaagccgcggcgggacgggcgtggggctggggattcatcgcttgtgcagaggagcctcttccaggcatgggggatcgagagaccgcagagggagggtctcggggctggagattcctccccctcctcctccctttccggttctttgttggcaaggaagcggaggcgaggaagcaccgaggaggagcgggtggcggccaagaagcccctcgcgtgccccttctacaagaagattcctggcacaccattcacggtggatgcatttcggtatggacaagttgaggggtgctcggcctatttccttagccactttcatcatgaccattacggtggattaaccaagaaatggtgccatggccccatctattgttctgcactcactgcacgcctagtgaagatgtgcttgtcagtaaattccgagtatatctgtcctttggagcttgataccgagtatgtcatagagggagtgacagttaccttgttggaggccaaccattgccctggtgcagctctaatccacttccgactaagtgatggaaagacctgtctccacactggggattttagagcatcaaaaactatgcaatcgcatccacttctccagagaggccgagtaaatttggtttacctggacacaacatattgcaatcccaagtacaagttcccaccccaggaggatgttattgattttgttgtgagaaccactcaaagatatctaaagaaacaaccaaaaaccctcattgttgttggggcatatagcattgggaaagagaatgtgtatctagcaatttcccaagctttagaggcccatatatacaccgatgcatcgagaaggcggattctctactcatttggctggccagatttgtccaaaaggctatgttcatgcaatcaaagttcaccacttcatgttctgcccattggatctataaatcatgagaacttgaagaagtacatggagactcttaatggaagattcctagcggtgctggcttttcggcctacaggttggactttctctgaggcaactggaaagcatcttgacctaataaaaccaagctctaatgccaatgtaacaatctatggtgtgccttatagcgagcattcaagtttcactgagcttagggattttgtgatgcttctgaaacctcaaaagataattcctactgttaatgttggcaatgcgacaagccgagataaaatgcaagcacatttccgggaatggctgaagagcccgtgataaatatatcctggtcatgatttttctgtatcggcgtcaactcgactccactcaatgagtgacacagtcatggtacggaaaagaagtggatatatttttaaaggttggtttgcttggtactaaaaatgctatgtttagagtaccacttttcccaacattattccgagattcgttttgtggaacttatctcttttgagaggtaaatgtgttgtttctcgctagtctgaaaatttctttgcacggaaattgtaagatgaagaaatattgatttgaattactgtttatcaaatcccattatcagcg

SEQ ID NO: 1648 - protein, 493 aa, Zea mays
  misc_feature: Ceres CLONE ID no.272338
  misc_feature: Bit score of 1123.1 for HMM based on sequences of FIGURE 20.
  misc_feature (380)..(472): Pfam Name: DRMBL Pfam Description: DNA repair metallo-beta-lactamase
  misc_feature: Functional Homolog Of Ceres SEEDLINE ID no. ME21508 at SEQ ID NO. 1635
MATVDCPLPSPADLDDNGFPALPSSPAACSSGFAEDFYRSGTDWSSLRAPPPLGPPRRAPGVKERGGGSAVQSSLFQAWGIEKPRRDGRGAGDSSLVQRSLFQAWGIERPQREGLGAGDSSPSSSLSGSLLARKRRRGSTEEERVAAKKPLACPFYKKIPGTPFTVDAFRYGQVEGCSAYFLSHFHHDHYGGLTKKWCHGPIYCSALTARLVKMCLSVNSEYICPLELDTEYVIEGVTVTLLEANHCPGAALIHFRLSDGKTCLHTGDFRASKTMQSHPLLQRGRVNLVYLDTTYCNPKYKFPPQEDVIDFVVRTTQRYLKKQPKTLIVVGAYSIGKENVYLAISQALEAHIYTDASRRRILYSFGWPDLSKRLCSCNQSSPLHVLPIGSINHENLKKYMETLNGRFLAVLAFRPTGWTFSEATGKHLDLIKPSSNANVTIYGVPYSEHSSFTELRDFVMLLKPQKIIPTVNVGNATSRDKMQAHFREWLKSP

SEQ ID NO: 1649 - DNA, 1428 bp, Panicum virgatum
  misc_feature: Ceres CLONE ID no.1993510
  misc_feature: Encodes the peptide sequence at SEQ ID NO. 1650
actcctccgttcccgctgccatttgaaaccccacctccgatggccaccgccgacggcgacccgccccaacccttccccgccgacctcgacgacaacggattccccgatctaccctcctcccccgccgccgccaccaccaccagcagcggcttcgccgaggatttctaccgtagcggcatcgactggtcctccctgcgcgcccctccgccgcggcggccgcccgagggggcagctggggttaaggagaagggtaaggagggtggctcgctcgtccagagcagcctcttccaggcgtgggggatcgagaggccacggcgggaggagggggccggggctggggattcctcgctcgtgcagaggagcctcttccaggcgtgggggatagagaggccgaagcgagaggggggaggggctggggacgcctccccttccccttcccgttccggttcttggtcgggaaggaaacggcggcgaggaggccccgaggaggaggtggcggcggcggccatgaatccccgcacttgccccttctacaagaagattcccggcacgccattcacggtggacgcatttcggtacggagaagttgagggctgctcggcctatttcctcagccattttcatcatgaccattatggtggattgaccaagaaatggtgccatggccccatctattgttctgcgctcactgcacgcttggtaaagatgtgcctgtcagtaaattcagattatatttgtcccttggagcttgatactgagtatgtcatcgagggagtgacagttaccttgttggaggccaatcattgccctggtgcagctctcattcacttccgactaagtgatggaaagacttatctccacactggggatttcagagcatcgagatctatgcaactgcatccactcctccagagaggacgcataaatttgctttacctggacacaacatattgcaatcccaagtacaagttcccaccgcaggaggatgttattgattttgttgtgagcacagctcgaagatatctaaagaagcaaccaaaaaccctcattgttgttggggcatatagcattgggaaagaaaatgtgtatctagcgatttctcaagctttggaggtacccatatacaccgatgcatcgagaagacggattcttcactcatttggttggaaggacttatccaaaaggatatgttcttgcaatcaaagctcagcacttcatgttttgccccttggatctgtaaaccatgagaactggaagaagtacttggggactctcaaccaacaatttctagctgtgttggcttttcggcctacaggttggactttctctgaggcaactggaaagcagcttgacctaataaaaccaaactctaatggcagcgtaacaatctatggtgtgccttatagcgagcactcaagtttcactgag

SEQ ID NO: 1650 - protein, 463 aa, Panicum virgatum
  misc_feature: Ceres CLONE ID no.1993510
  misc_feature: Bit score of 979.5 for HMM based on sequences of FIGURE 20.
  misc_feature (389)..(463): Pfam Name: DRMBL Pfam Description: DNA repair metallo-beta-lactamase
  misc_feature: Functional Homolog Of Ceres SEEDLINE ID no. ME21508 at SEQ ID NO. 1635
MATADGDPPQPFPADLDDNGFPDLPSSPAAATTTSSGFAEDFYRSGIDWSSLRAPPPRRPPEGAAGVKEKGKEGGSLVQSSLFQAWGIERPRREEGAGAGDSSLVQRSLFQAWGIERPKREGGGAGDASPSPSRSGSWSGRKRRRGGPEEEVAAAAMNPRTCPFYKKIPGTPFTVDAFRYGEVEGCSAYFLSHFHHDHYGGLTKKWCHGPIYCSALTARLVKMCLSVNSDYICPLELDTEYVIEGVTVTLLEANHCPGAALIHFRLSDGKTYLHTGDFRASRSMQLHPLLQRGRINLLYLDTTYCNPKYKFPPQEDVIDFVVSTARRYLKKQPKTLIVVGAYSIGKENVYLAISQALEVPIYTDASRRRILHSFGWKDLSKRICSCNQSSALHVLPLGSVNHENWKKYLGTLNQQFLAVLAFRPTGWTFSEATGKQLDLIKPNSNGSVTIYGVPYSEHSSFTE

SEQ ID NO: 1651 - protein, 966 aa, Oryza sativa subsp. indica
  misc_feature: Public GI ID no.125563862
  misc_feature: Bit score of 2494.8 for HMM based on sequences of FIGURE 20.
  misc_feature (488)..(551): Pfam Name: SAM_1 Pfam Description: SAM domain (Sterile alpha motif)
  misc_feature (851)..(949): Pfam Name: DRMBL Pfam Description: DNA repair metallo-beta-lactamase
  misc_feature: Functional Homolog Of Ceres SEEDLINE ID no. ME21508 at SEQ ID NO. 1635
MPANPKLAAKPSPSPPTAAAAASRPKATAKPPLGAGYRDNDDDDDDFQSPPRASSRAARALKPSGNGAASRRPSKRLKPSSSCCSGKENLPAAAGSGRAPAGRAASKGAGVGETLGVVSRVSSGVPGGDKARGGGICGLLRCGSDDFSSVSNGKKGLDRYWRRDGGLHSRPNPMDSTVSMPDATCDLENGGSQVAQMLSSNDRISVQLEGNAKVELGKSESDPTTMRKERNGSGACESDHPARLIEPRLLTLVTNCDFGGADSMDSKELGSAIHPSVSKDRNVENESGGASVCTFALHNRNCHSSCVESELELLNAKYDLGPRDCKESQEGPGLCSLISEERTVAAEGDATFTFEERGNTSSGLEACKGSHCLDPVEPKLMDSCATHALEGDGCDDFEIGTQLNELINLCMEDYTEGPLSNKVACLEGNGMDCGSFNSSCEVQCPLCGSNISDLSEELRLVHTNSCLDGDKPAKEPNSDNQNEPCGESNVEKRRVMEWLRNLGLSKYEEIFIKEEVDWETLQWLTEEDLLGMGITSLGPRKKIAHALCELRKKNDDANDLAADMLNLENTKKAKIPMNGNKLITEYFRCPSSDQRQKKACKVNTPSNLNSQKNSNAKATGGRRTVKGKVKDTPIWCCIPGTPFRVDAFRYLRGDCCHWFLTHFHVDHYQGLTKSFCHGKIYCSSVTANLVHYKIGIPWDRLHVLPLNEKITIAGVNLTCFDANHCPGAVIILFEPSNGKAVLHTGDFRFSSEMANNRVLQSSPIHTLILDTTYCNPRYDFPTQEIVIQFVIEAIQAEAFNPKTLFLIGSYTIGKERLYMEVARLLQKKIYVGAAKLQILKHLGLPQEIMHWFTANEAESHIHVVPMWTLASFKRMKYLSTQYADRFDLIVAFCPTGWSFGKGKKRTPGRKWQQGAIIRYEVPYSEHSSFTELREFVRFISPEHIIPSVNNDGPDSANAMLAQLLND

SEQ ID NO: 1652 - protein, 428 aa, Oryza sativa subsp. indica
  misc_feature: Public GI ID no.125548147
  misc_feature: Bit score of 589.3 for HMM based on sequences of FIGURE 20.
  misc_feature (347)..(412): Pfam Name: DRMBL Pfam Description: DNA repair metallo-beta-lactamase
  misc_feature (414)..(428): Pfam Name: SAM_1 Pfam Description: SAM domain (Sterile alpha motif)
  misc_feature: Functional Homolog Of Ceres SEEDLINE ID no. ME21508 at SEQ ID NO. 1635
MGTDIAGDGEPSSPPPLPVPDGLDDNGFPLPSSPTAATAATSFADDFYRSGTDWSSLLAAPSPPPSSEESGKNKSGDSLVQRSLFQAWGIDRRPRREEEVAGVAGGAGAGASSAPSGSWPGRKRRRGGEVEAAADRKPLACPFYKKIPVVLKLKLTNIGTPFTVDAFRYGAVEGCNAYFLSHFHHDHYGGLTKKWCHGPIYCTALTARLVKMCLSVNPEYICPLELDKEYVIEGVSVTLLEANHCPGAALIHFRLGDGKKYLHTGDFRASKSMQLYPLLQRGQINLLYLDTTYCNPKYKFPPKEDVIDFAVRTAKRYLQKEPKTLIVVGAYSIGKENVYLAISKALQNLQKYLETLKQRFLAVLAFRPTGWTFSEETGNQLDLIKPSSRGKITIYGVPYSEHSSFSELREFVMVYICLLVSETPKVKE

SEQ ID NO: 1653 - protein, 967 aa, Oryza sativa subsp. japonica
  misc_feature: Public GI ID no.125605833
  misc_feature: Bit score of 2498.6 for HMM based on sequences of FIGURE 20.
  misc_feature (489)..(552): Pfam Name: SAM_1 Pfam Description: SAM domain (Sterile alpha motif)
  misc_feature (852)..(950): Pfam Name: DRMBL Pfam Description: DNA repair metallo-beta-lactamase
  misc_feature: Functional Homolog Of Ceres SEEDLINE ID no. ME21508 at SEQ ID NO. 1635
MPANPKLAAKPSPSTAEPPPQTASRPKATAKPPLGAGYRDNDDDDDDFQSPPRASSRAARALKPSGNGAASRRPSKRLKPSSSCCSGKENRPAAAGSGRAPAGRAASKGAGVGETLGVVSRVSSGVPGGDKARGGGICGLLRCGSDDFSSVSNGKKGLDRYWRRDGGLHSRPNPMDSTVSMPDATCDLENGGSQVAQMLSSNDRISVQLEGNAKVELGKSESDPTTMRKERNGSGACESDHPARLIEPRLLTLVTNCDFGGADSMDSKELGSAIHPSVSKDRNVENESGGASVCTFALHNRNCHSSCVESELEMLNAKYDLGPRDCKESQEGPGLCSLISEERTVAAEGDATFTFEERGNTSSGLEACKGSHCLDPVEPKLMDSCATHALEGDGCDDFEIGTQLNELINLCMEDYTEGPLSNKVACLEGNGMDCGSFNSSCEVQCPLCGSNISDLSEELRLVHTNSCLDGDKPAKEPNSDNQNEPCGESNVEKRRVMEWLRNLGLSKYEEIFIKEEVDWETLQWLTEEDLLGMGITSLGPRKKIAHALCELRKKNNDANDLAADMLNLENTKKAKIPMNGNKLITEYFRCPSSDQRQKKACKVNTPSNLNSQKKSNAKATGGRRTVKGKVKDTPIWCCIPGTPFRVDAFRYLRGDCCHWFLTHFHVDHYQGLTKSFCHGKIYCSSVTANLVHYKIGIPWDRLHVLPLNEKITIAGVNLTCFDANHCPGAVIILFEPSNGKAVLHTGDFRFSSEMANNRVLQSSPIHTLILDTTYCNPRYDFPTQEIVIQFVIEAIQAEAFNPKTLFLIGSYTIGKERLYMEVARLLQKKIYVGAAKLQILKHLGLPQEIMHWFTANEAESHIHVVPMWTLASFKRMKYLSTQYADRFDLIVAFCPTGWSFGKGKKRTPGRKWQQGAIIRYEVPYSEHSSFTELREFVRFISPEHIIPSVNNDGPDSANAMLAQLLND

SEQ ID NO: 1654 - protein, 1024 aa, Oryza sativa subsp. japonica
  misc_feature: Public GI ID no.51091343
  misc_feature: Bit score of 2497.7 for HMM based on sequences of FIGURE 20.
  misc_feature (546)..(609): Pfam Name: SAM_1 Pfam Description: SAM domain (Sterile alpha motif)
  misc_feature (909)..(1007): Pfam Name: DRMBL Pfam Description: DNA repair metallo-beta-lactamase
  misc_feature: Functional Homolog Of Ceres SEEDLINE ID no. ME21508 at SEQ ID NO. 1635
MDTAVGPIAPPLTSLKLDSHHRSRYGAVGGEWDGRGQREVAPIEIEGKGVAGEGRKRRMPANPKLAAKPSPSPPTAAAAASRPKATAKPPLGAGYRDNDDDDDDFQSPPRASSRAARALKPSGNGAASRRPSKRLKPSSSCCSGKENRPAAAGSGRAPAGRAASKGAGVGETLGVVSRVSSGVPGGDKARGGGICGLLRCGSDDFSSVSNGKKGLDRYWRRDGGLHSRPNPMDSTVSMPDATCDLENGGSQVAQMLSSNDRISVQLEGNAKVELGKSESDPTTMRKERNGSGACESDHPARLIEPRLLTLVTNCDFGGADSMDSKELGSAIHPSVSKDRNVENESGGASVCTFALHNRNCHSSCVESELEMLNAKYDLGPRDCKESQEGPGLCSLISEERTVAAEGDATFTFEERGNTSSGLEACKGSHCLDPVEPKLMDSCATHALEGDGCDDFEIGTQLNELINLCMEDYTEGPLSNKVACLEGNGMDCGSFNSSCEVQCPLCGSNISDLSEELRLVHTNSCLDGDKPAKEPNSDNQNEPCGESNVEKRRVMEWLRNLGLSKYEEIFIKEEVDWETLQWLTEEDLLGMGITSLGPRKKIAHALCELRKKNNDANDLAADMLNLENTKKAKIPMNGNKLITEYFRCPSSDQRQKKACKVNTPSNLNSQKKSNAKATGGRRTVKGKVKDTPIWCCIPGTPFRVDAFRYLRGDCCHWFLTHFHVDHYQGLTKSFCHGKIYCSSVTANLVHYKIGIPWDRLHVLPLNEKITIAGVNLTCFDANHCPGAVIILFEPSNGKAVLHTGDFRFSSEMANNRVLQSSPIHTLILDTTYCNPRYDFPTQEIVIQFVIEAIQAEAFNPKTLFLIGSYTIGKERLYMEVARLLQKKIYVGAAKLQILKHLGLPQEIMHWFTANEAESHIHVVPMWTLASFKRMKYLSTQYADRFDLIVAFCPTGWSFGKGKKRTPGRKWQQGAIIRYEVPYSEHSSFTELREFVRFISPEHIIPSVNNDGPDSANAMLAQLLND

SEQ ID NO: 1655 - protein, 966 aa, Oryza sativa subsp. japonica
  misc_feature: Public GI ID no.115479355
  misc_feature: Bit score of 2497.7 for HMM based on sequences of FIGURE 20.
  misc_feature (488)..(551): Pfam Name: SAM_1 Pfam Description: SAM domain (Sterile alpha motif)
  misc_feature (851)..(949): Pfam Name: DRMBL Pfam Description: DNA repair metallo-beta-lactamase
  misc_feature: Functional Homolog Of Ceres SEEDLINE ID no. ME21508 at SEQ ID NO. 1635
MPANPKLAAKPSPSPPTAAAAASRPKATAKPPLGAGYRDNDDDDDDFQSPPRASSRAARALKPSGNGAASRRPSKRLKPSSSCCSGKENRPAAAGSGRAPAGRAASKGAGVGETLGVVSRVSSGVPGGDKARGGGICGLLRCGSDDFSSVSNGKKGLDRYWRRDGGLHSRPNPMDSTVSMPDATCDLENGGSQVAQMLSSNDRISVQLEGNAKVELGKSESDPTTMRKERNGSGACESDHPARLIEPRLLTLVTNCDFGGADSMDSKELGSAIHPSVSKDRNVENESGGASVCTFALHNRNCHSSCVESELEMLNAKYDLGPRDCKESQEGPGLCSLISEERTVAAEGDATFTFEERGNTSSGLEACKGSHCLDPVEPKLMDSCATHALEGDGCDDFEIGTQLNELINLCMEDYTEGPLSNKVACLEGNGMDCGSFNSSCEVQCPLCGSNISDLSEELRLVHTNSCLDGDKPAKEPNSDNQNEPCGESNVEKRRVMEWLRNLGLSKYEEIFIKEEVDWETLQWLTEEDLLGMGITSLGPRKKIAHALCELRKKNNDANDLAADMLNLENTKKAKIPMNGNKLITEYFRCPSSDQRQKKACKVNTPSNLNSQKKSNAKATGGRRTVKGKVKDTPIWCCIPGTPFRVDAFRYLRGDCCHWFLTHFHVDHYQGLTKSFCHGKIYCSSVTANLVHYKIGIPWDRLHVLPLNEKITIAGVNLTCFDANHCPGAVIILFEPSNGKAVLHTGDFRFSSEMANNRVLQSSPIHTLILDTTYCNPRYDFPTQEIVIQFVIEAIQAEAFNPKTLFLIGSYTIGKERLYMEVARLLQKKIYVGAAKLQILKHLGLPQEIMHWFTANEAESHIHVVPMWTLASFKRMKYLSTQYADRFDLIVAFCPTGWSFGKGKKRTPGRKWQQGAIIRYEVPYSEHSSFTELREFVRFISPEHIIPSVNNDGPDSANAMLAQLLND

SEQ ID NO: 1656 - DNA, 2847 bp, Sorghum bicolor
  misc_feature: Ceres ANNOT ID no.6042086
  misc_feature: Encodes the peptide sequence at SEQ ID NO. 1657
atggcggcgagtggcaagctctcggcgaagccctccccgtcgccgacggtcgctcccgcctcgcgccccaaattcacagccgttaccttcctcggtgactgtgacgacgacgacgacttccaacctcctcgcccccgcccattgaagccttgcaatggcgccgccgcacttcggctccgcaagaagctcaaggcttcatcctcctccgcttcctccgggaaggagaacagttccgccgccggtggtgccgttgctgcggtggggatcgcctcgacagccgcgaaggatgccggaaccctagccacctgctcaagggttagtggcggcgttcccaaatcgaagaaacgaaaggccggagaaatttgcggcctctcgaggtacggatctgatagcaccaaactaagttgtaaaccgaagataggattggatagatatggatatggcaaagggagctccagttccttgcccaattcgttagaatcgagggttttggcgctcggtgcggtatgtgatttgggagttgggcgctgtgaggtggctcaagtagctggtaccttagttcttgaggaggggcacgccacagaggagctggctggctctgagtgtgatcctccaaaaacggagaagaagctgggcagttctggagctgtagagggacattatgactccaggttgattgaaccggggcttattgaatcagatgcaaaccgggagtctgtaactgcttgttcatatgattcagaagtgcttgattcagggattcttggctcactgactgataaacaggacacgaagaaagcaaacggggtggcatctgaatgtggttttgggcttcagaacgggaactatcacttgcattctctacagtcagagctcctaatgtcgaacgcaaagtatgattctagggtttttgctagcaatgaaatccaagagcctggtttgggagctggtaacttgatttcacaagagaggaacgtagcagcaggacattctgcatgtacaacccctgaaaatgtgactatggagaataaatcaagtgagcatgaggcttgtaaggggaagtgccgctctaattcatctgaatcaaagcttcaagaatcccatatgatccatgactttgaagttgatggttgtgatgatttcgagattgggacacagctcagtgagctcattaacttgtgtatgaaggattccatagagggacagttaaactttagtgcatctcccatggaacagaacacattggattctaagcgactcggttcagactatgaagtgaaatgccctctctgtggatcggatatatctgatttaagcgaggagctccggcagctgcatactaacaattgtcttgacgaaccagctaaggaatctagtcccaaccataaaaaagagccctgtgctggacaaaatgttgaaactggacgtgttgtcgaatggttaagaaaccttgggttatccaagtatgaggaggtttttatcagagaagaagttgactgggaaaccttgcagtggctcactgaagaggatctgttgggtatcgggatcacctctcttggaccaagaaagaaaattatccatgctctaggagagttacggaagaaacatgacgatccctgtgaagtggaagatgtcgtgttaaattcagaaaatactaagaagactaaacttccgatgaatggtaataaattaattactgaatactttcaatgttcctcatttgatcaaagacaaagaagggtatgcaaagtcaacaagccatctaatctgaacgagaagaaaatttctagtgctaaaatacccactagaagaagtgctggtaaaggaaaggttaaagatacacctctttggtgttgcatcccagggaccccttttcgagtggatgcatttcgctacttgagaggcgattgttcccactggtttctcacacacttccatgtggatcattatcaaggcttgactagaagcttttgtcatgggaagatatactgttcgtcaattacagcaagtcttgtgcatcataagattggtatcccatgggatagattgcatgtattgaccctaaatgaaaagctcactattggtggagttagtttgacatgttttgatgccaatcattgccctggatcaatcattattctctttgagcctcccaacggtaaagctgttttgcacaccggagacttccggttttcttccgagatggccaacaatcctgttttgcagtcttctcatatccacactctaatacttgacacaacctattgcaatccacggtatgacttcccaagtcaagagattgtaatacagttcgttatcgaggccatccaagcagaagctttcaatccaaaaacattgtttttgattggtagctacacaattggaaaagaaagactgtttatggaggttgctcgtttgcttcagaagaaaatatatgttggagctgcaaagctgcaaatattgaaacatttagagcttcctcaggagattatgcactggtttacagccaatgaagcagaaagtcacatacatgttgtccccatgtggactctagcaagcttcaagcggatgaaatatttatcaaatcaatatgccggccagtttgacctcatagtggcgttttgtcctactggttgggcatttggcaaaggtaggaaaaagacaccaggcaaaaggtggcaacaaggatcaatcatcagatacgaagtgccctacagtgaacacagcagtttcacggaactgcaagaatttgtcaagttcatatcaccagagcacataatccctagtgtgaacaacgatggccctgagagtgcagatgctatgcttgcccagctgttaaacgagtag

SEQ ID NO: 1657 - protein, 948 aa, Sorghum bicolor
  misc_feature: Ceres ANNOT ID no.6042086
  misc_feature: Bit score of 1480.4 for HMM based on sequences of FIGURE 20.
  misc_feature (470)..(533): Pfam Name: SAM_1 Pfam Description: SAM domain (Sterile alpha motif)
  misc_feature (833)..(931): Pfam Name: DRMBL Pfam Description: DNA repair metallo-beta-lactamase
  misc_feature: Functional Homolog Of Ceres SEEDLINE ID no. ME21508 at SEQ ID NO. 1635
MAASGKLSAKPSPSPTVAPASRPKFTAVTFLGDCDDDDDFQPPRPRPLKPCNGAAALRLRKKLKASSSSASSGKENSSAAGGAVAAVGIASTAAKDAGTLATCSRVSGGVPKSKKRKAGEICGLSRYGSDSTKLSCKPKIGLDRYGYGKGSSSSLPNSLESRVLALGAVCDLGVGRCEVAQVAGTLVLEEGHATEELAGSECDPPKTEKKLGSSGAVEGHYDSRLIEPGLIESDANRESVTACSYDSEVLDSGILGSLTDKQDTKKANGVASECGFGLQNGNYHLHSLQSELLMSNAKYDSRVFASNEIQEPGLGAGNLISQERNVAAGHSACTTPENVTMENKSSEHEACKGKCRSNSSESKLQESHMIHDFEVDGCDDFEIGTQLSELINLCMKDSIEGQLNFSASPMEQNTLDSKRLGSDYEVKCPLCGSDISDLSEELRQLHTNNCLDEPAKESSPNHKKEPCAGQNVETGRVVEWLRNLGLSKYEEVFIREEVDWETLQWLTEEDLLGIGITSLGPRKKIIHALGELRKKHDDPCEVEDVVLNSENTKKTKLPMNGNKLITEYFQCSSFDQRQRRVCKVNKPSNLNEKKISSAKIPTRRSAGKGKVKDTPLWCCIPGTPFRVDAFRYLRGDCSHWFLTHFHVDHYQGLTRSFCHGKIYCSSITASLVHHKIGIPWDRLHVLTLNEKLTIGGVSLTCFDANHCPGSIIILFEPPNGKAVLHTGDFRFSSEMANNPVLQSSHIHTLILDTTYCNPRYDFPSQEIVIQFVIEAIQAEAFNPKTLFLIGSYTIGKERLFMEVARLLQKKIYVGAAKLQILKHLELPQEIMHWFTANEAESHIHVVPMWTLASFKRMKYLSNQYAGQFDLIVAFCPTGWAFGKGRKKTPGKRWQQGSIIRYEVPYSEHSSFTELQEFVKFISPEHIIPSVNNDGPESADAMLAQLLNE

SEQ ID NO: 1658 - DNA, 1491 bp, Sorghum bicolor
  misc_feature: Ceres ANNOT ID no.6029903
  misc_feature: Encodes the peptide sequence at SEQ ID NO. 1659
atggccaccgccgaaggcgacgccgactggtccctgccctcccccaccgacctcgatgacaacgggttcccggatctaccctgctcccccgccgcctctagcagctgcttcgcggaggacttctacagcagcggcaccgactggtcctccctgcgtgcccctccgccgctgcgcccgcccggaagggcacccggtgtgaaggagaaggagatgggaggcggttcgctcgtgcagagcagcctcctccaggcgtgggggatcgagaagccgcggcgggaggctggggattcatcgcttgtgcagaggagcctcttccaggcgtgggggatcgagaggccaccgagggaggggctcggggctgggcattcatccccctccccctcccgttccggttcttggttgggaaggaagcggaggcgaggaagcaccgaggaggagcgggtggcgcccaagaagcccctcgcgtgccccttctacaagaagattcccggcacaccattcacggtggatgcgtttcgctatggacaagttgaggggtgctcggcctatttccttagccattttcatcatgaccactacggtggattgaccaagaagtggtgtcatggccccatctattgttctgcactcactgcacgcttagtgaagatgtgtctgtcagtaaattccgactatatttatcctttggagcttgataccaattatgtcatagagggagtgacagttaccttgttagaggccaaccattgccctggtgcagctctaatccacttccaactaagtgatggaaagacctatctccacactggggattttagagcatcaaaatcaatgcaattgcatccacttctccagagaggcagggtaaatttggtttacctggacacaacatattgcaatcccaaatacaagttcccaccccaggaggatgttattgattttgttgtgaggacagctcaaagatatctaaagaaacagccaaaaaccctcattgttgttggggcgtatagcattgggaaagagaatgtgtatctagcaatttcccaagctttagaggtccctatatacactgatgcatcaaggaggcggattcttcactcatttggctggtcagacttatccaaaaggatatgctcatgcaatcaaagttcaccactacatgttctgccccttggatctgtaaatcatgagaacttgaagaagtacttggagactcttagtggaagatttctagctgtgctggcttttcggcctacaggttggactttctctgaggcaactggaaagcatcttgacctaataaaaccaagttgtaatggcagtgtaacaatctatggtgtgccttatagcgagcattcaagtttcactgagcttcgggattttgtgatgtttctgagacctcaaaaggtaattcctactgttaatgttggcaacgcaacaagccgagataaaatgcaagcacatttccgggaatggctgaagagcctgtga

SEQ ID NO: 1659 - protein, 496 aa, Sorghum bicolor
  misc_feature: Ceres ANNOT ID no.6029903
  misc_feature: Bit score of 1075.2 for HMM based on sequences of FIGURE 20.
  misc_feature (383)..(475): Pfam Name: DRMBL Pfam Description: DNA repair metallo-beta-lactamase
  misc_feature (481)..(495): Pfam Name: SAM_1 Pfam Description: SAM domain (Sterile alpha motif)
  misc_feature: Functional Homolog Of Ceres SEEDLINE ID no. ME21508 at SEQ ID NO. 1635
MATAEGDADWSLPSPTDLDDNGFPDLPCSPAASSSCFAEDFYSSGTDWSSLRAPPPLRPPGRAPGVKEKEMGGGSLVQSSLLQAWGIEKPRREAGDSSLVQRSLFQAWGIERPPREGLGAGHSSPSPSRSGSWLGRKRRRGSTEEERVAPKKPLACPFYKKIPGTPFTVDAFRYGQVEGCSAYFLSHFHHDHYGGLTKKWCHGPIYCSALTARLVKMCLSVNSDYIYPLELDTNYVIEGVTVTLLEANHCPGAALIHFQLSDGKTYLHTGDFRASKSMQLHPLLQRGRVNLVYLDTTYCNPKYKFPPQEDVIDFVVRTAQRYLKKQPKTLIVVGAYSIGKENVYLAISQALEVPIYTDASRRRILHSFGWSDLSKRICSCNQSSPLHVLPLGSVNHENLKKYLETLSGRFLAVLAFRPTGWTFSEATGKHLDLIKPSCNGSVTIYGVPYSEHSSFTELRDFVMFLRPQKVIPTVNVGNATSRDKMQAHFREWLKSL

SEQ ID NO: 1660 - DNA, 939 bp, Gossypium hirsutum
  misc_feature: Ceres Clone ID no. 100066339
  misc_feature: Encodes the peptide sequence at SEQ ID NO. 1661
ctttattcctaactctctctaccacctaaacctcattctattctttttttcgttttaatggatgagttaaacagcaagaagcgggctagggacgactccaacgagtcgggcctggactcgcccgacgtgaagagactcagagatgatttatttcttgatgattcagattccttgcctcttaatcaagaccttgcatccgtaatgaagagttttgaagaggaaatagcagctgtcccatctacttcaacgggatctatgccagttgtggatctcacttctgattctagtgactcgcaacctgatcttggttacctttttgaggcttccgatgatgaacttggtctccctccccctacggcttccacaactgatactgaaggaaggtccgaagcgactgatttggtgcgagctgactcaaactcctcaggaatcgatgatttgtgggggttcgaggaacagaaccctaactacgattctttcgagtttggattcgttaataatttcaatgatggcaccgttgcatatgatgcactgttcgagtattccgatgtctattacgattcctccgatatttctggtcaactatggcggccggaaactttgtcggcagagtaaaaatctaaacttaaaatccaaaaaaaagagagaagaaagatagcaaaccaagctaaacacaagacagtcatagccgatctgtaaattttttttcagctcatgttggggtttgtgttagaaatttttttattaaaggaagttataacatacaatgtggagtagaaatttgaaatggaagatgcttgcgagcctttaccaaacacagtataagtcaattgattttgttgctaaagtggggatagtgatgaaaattgatttgtttttttttttattattttgcacgaattcagtctcatgagttttgtaaaaaacgagttgcaatgg

SEQ ID NO: 1661 - protein, 185 aa, Gossypium hirsutum
  misc_feature: Ceres Clone ID no. 100066339
  misc_feature (1)..(185): Bit score of 384.3 for HMM based on sequences of FIGURE 11.
  misc_feature: Functional Homolog Of SEQ ID NO. 953
MDELNSKKRARDDSNESGLDSPDVKRLRDDLFLDDSDSLPLNQDLASVMKSFEEEIAAVPSTSTGSMPVVDLTSDSSDSQPDLGYLFEASDDELGLPPPTASTTDTEGRSEATDLVRADSNSSGIDDLWGFEEQNPNYDSFEFGFVNNFNDGTVAYDALFEYSDVYYDSSDISGQLWRPETLSAE

SEQ ID NO: 1662 - DNA, 659 bp, Gossypium hirsutum
  misc_feature: Ceres Clone ID no. 1798705
  misc_feature: Encodes the peptide sequence at SEQ ID NO. 1663
acctcaatctccctccttcgcgtttctttattcctaactctctttaccacctaaacctccttccattcatttttacgttttaatggatgagttaaacagcaagaagcgggctagggacgactccaatgagtcgggtctggactcgcccgacgtgaagagactcagagatgatttatttcttgatgattcagattccttgcctcttaatcaagaccttgcatccgtaatgaagagttttgaagaggagatatcagccgtcccatcgacttcgacggaatctatgccggttgtggatctcacttcggattctggtgactcacaaccggatcttggttaccttctcgaggcttccgatgatgaacttggtctgcctccccctacggcttccacaactgatgctgagggaaggtccgaagcgactgatttggtgcgagctgactcaaactcctcgggaatccatgatttgtgggggttcgaggaacaaaaccccaactacgattctttcgagtttggattcgttgataatttcaatgatggcaccgttgcatatgatggactgttcgagtattccgatgtctattacgattcctccgatatttctggtcagctatggcggccggaaactttgtcggcgaagtaaaaatccaaacttaaaatcc

SEQ ID NO: 1663 - protein, 185 aa, Gossypium hirsutum; identical to SEQ ID NO: 1661
  misc_feature: Ceres Clone ID no. 1798705
  misc_feature (1)..(185): Bit score of 384.3 for HMM based on sequences of FIGURE 11.
  misc_feature: Functional Homolog Of SEQ ID NO. 953

SEQ ID NO: 1664 - DNA, 1000 bp, Panicum virgatum
  misc_feature: Ceres Clone ID no. 1724781
  misc_feature: Encodes the peptide sequence at SEQ ID NO. 1665
gcaaaacacctcgctttttgtagtcttccgtctttgccctcgcgctctcgcctctcgcccccgtttgctcggccggcgcgtgtacgtgtgtacagcgagcggagcagggagaacggaaaagaaagaaaaagaaagtcttgccctgccttggctctcctccttggggttgagctcaaccgttgttcgttcatggagagctcttcctcctccacccacaagcgggcgcgggaggcggccgacctcgccgccgccggcgacggcgcgctgccggaggccggcgccaagaggctgcggcccgaggacctactcgacctgctcgacgatgacgccgacgcggcggccgccggcgacctggcgtccgtcatgcggagcctcgaggaggagatagggagcttcgacgaggccggggccgccgacgccgccgccgtgccgccggtgcaccagccggagctggggttcctgctggaggcctctgacgacgagctgggcctgccgccggcgggcgcctcctcctcgtcggaggaggccggagccgccggggcgcccgacgtggccgccggccttgacggccagatctgggggttcgaggacgagatcgacggcggcttcggcggctactcgccggaggccgcggccgctgccgccgccgccacggtgtgggacgacgacggcttcgacgccgggctgttcgcgttcggcgacgacgcctgcgggccctcggatctcgcggccctgcgccacgagaccatgccggccgtctgattacgggccccggccggccggccagtggattagcgttctttttctggcttttttttaaccttgggctaaccttagctggtactacccttttctttaaccttggtgtaaagtttttagaagggtaaaaacagaggcgtggaaacctggggaaggttccgaccggggaaaagaatctgaaaatggtttccctttttgcccttgggaattattttctcgcttattattattattatatacg

SEQ ID NO: 1665 - protein, 190 aa, Panicum virgatum
  misc_feature: Ceres Clone ID no. 1724781
  misc_feature (1)..(190): Bit score of 360.1 for HMM based on sequences of FIGURE 11.
  misc_feature: Functional Homolog Of SEQ ID NO. 953
MESSSSSTHKRAREAADLAAAGDGALPEAGAKRLRPEDLLDLLDDDADAAAAGDLASVMRSLEEEIGSFDEAGAADAAAVPPVHQPELGFLLEASDDELGLPPAGASSSSEEAGAAGAPDVAAGLDGQIWGFEDEIDGGFGGYSPEAAAAAAAATVWDDDGFDAGLFAFGDDACGPSDLAALRHETMPAV

SEQ ID NO: 1666 - DNA, 657 bp, Panicum virgatum
  misc_feature: Ceres Clone ID no. 2022596
  misc_feature: Encodes the peptide sequence at SEQ ID NO. 1667
gcgcaaaacacctcgctttttgtactcttccgtctttgccctcgcgctctcgcctcgcccccgttcgctcggccggcgcgtgtacgtgcgtacagcgagcggagaagggaaaagaaagagagagagagaaaaaaaaagaaaagagtcttgcggctcttgccttgccttgccttgcgttgagctcattcgctgttcgttcatggagagctcctcctcctcctcccacaagcgggcgcgggaggcggccgacctcgccgccgccggagacggcgcgctgccggagaagaggctgcggcccgaggacctgctcgacctgctcgacgatgacgccgacgcggccgccgccggcgacctggcgtccgtcatgcggagcctcgaggaggagttagggagcttcgacgaggccgggccccccgacgccgccgccgcgccgccggcgcaccagccggagctggggttcctgctcgaggcctcggacgacgagctggggctgccgccggcgggcgcctcctcgtcgtcggaggaggccggcgccgccggggcgccggacgtggccgacgggctcgacggccagatctgggggttcgaggacgagattgacggcggcttcggcggctactcgccggaggcggccgccgccgcccgcgcggcggcggc

SEQ ID NO: 1667 - protein, 152 aa, Panicum virgatum
  misc_feature: Ceres Clone ID no. 2022596
  misc_feature (1)..(152): Bit score of 226.1 for HMM based on sequences of FIGURE 11.
  misc_feature: Functional Homolog Of SEQ ID NO. 953
MESSSSSSHKRAREAADLAAAGDGALPEKRLRPEDLLDLLDDDADAAAAGDLASVMRSLEEELGSFDEAGPPDAAAAPPAHQPELGFLLEASDDELGLPPAGASSSSEEAGAAGAPDVADGLDGQIWGFEDEIDGGFGGYSPEAAAAARAAA

SEQ ID NO: 1668 - DNA, 777 bp, Zea mays
  misc_feature: Ceres Clone ID no. 1564277
  misc_feature: Encodes the peptide sequence at SEQ ID NO. 1669
gcgcaaaacacctcgccttttgtactcttgcgtctctgccctcgcgttatcgccttcgtcacgctcgctcgcctggctggcttgtgccttgccttgctcggcgtacgcgaacgcagcgagagggaggagcaaggaaatagagagagacagagagagagagagaaaaaatcaagtcatccccctttcctctgagctcgttccatggagaactcttctcacaagcgggcgcgggaggcgggcgacctcgtcgccggcggctgcggagaggagggctcgccgcaggccgacgccaagaggctgcggccgcaggacctgctcgacatgctggaggacgacaccgacgcggccgcggccggcgacctagcgtcggtcatgcggagcctggaggaggagatagccagcttcgacgaggccgcggaggcgccggcgccggcgccggagctgggcttcctgctcgaggcctcggacgacgagctggggctgccgcccgcctcctcttcggaggaggaggaggccgggcgcgcgggggcgccgttcccgcccgcgctcgacggccagatctggggcttcgaggacgagatcgtggacggaggcggcttcggcggctactcgccggaagccgcggccgcggccgctgcctccgcgccgccgccgcgtgggacgacgacggcttcggcgccggcctcttcgcgttcggcggcgacgacgcgtgtgggcccgtcggatctcgcggccctgcgccacgagacccatgcccgcgtctgatggccatcccca

SEQ ID NO: 1669 - protein, 187 aa, Zea mays
  misc_feature: Ceres Clone ID no. 1564277
  misc_feature (1)..(187): Bit score of 209.2 for HMM based on sequences of FIGURE 11.
  misc_feature: Functional Homolog Of SEQ ID NO. 953
MENSSHKRAREAGDLVAGGCGEEGSPQADAKRLRPQDLLDMLEDDTDAAAAGDLASVMRSLEEEIASFDEAAEAPAPAPELGFLLEASDDELGLPPASSSEEEEAGRAGAPFPPALDGQIWGFEDEIVDGGGFGGYSPEAAAAAAASAPPPRGTTTASAPASSRSAATTRVGPSDLAALRHETHARV

SEQ ID NO: 1670 - DNA, 440 bp, Triticum aestivum
  misc_feature: Ceres Clone ID no. 919496
  misc_feature: Encodes the peptide sequence at SEQ ID NO. 1671
acccgaagcaaagggaaagagaaggaagaatagtgtgtgcatcggccatggagagctcctcctcgtctctgttgttgccgagttcgtatgccggcaacaacaagagggccagggatgccggccttgaggcggaggcggaggccgccaagaggatgcggccggaggacctgctggacctgctcgacgacgacaccgacgccgcggcggccggcgacctggcctccgtcatgcggagccttgaggaggagatatgcgccgacgacctgacgccgccgcagccagagctagggttcctgctcgaggcctcggacgacgagcttggcctgccgccggccgccggtgcgtcctcctcgtcggacgacgctgggggctgggaaccagaggagcscgcccgcgtgttcggggagcagatatggagcttcgaggacgagattgagggc

SEQ ID NO: 1671 - protein, 131 aa, Triticum aestivum
  misc_feature: Ceres Clone ID no. 919496
  misc_feature (1)..(131): Bit score of 157.9 for HMM based on sequences of FIGURE 11.
  misc_feature: Functional Homolog Of SEQ ID NO. 953
  misc_feature (114)..(114): Xaa is any aa, unknown, or other
MESSSSSLLLPSSYAGNNKRARDAGLEAEAEAAKRMRPEDLLDLLDDDTDAAAAGDLASVMRSLEEEICADDLTPPQPELGFLLEASDDELGLPPAAGASSSSDDAGGWEPEEXARVFGEQIWSFEDEIEG

SEQ ID NO: 1672 - DNA, 513 bp, Triticum aestivum
  misc_feature: Ceres Clone ID no. 917938
  misc_feature: Encodes the peptide sequence at SEQ ID NO. 1673
acaacacgcaccgctttttgtactctgatctctcccatcttgtgcgcccttcgcgtttcgcgcccagagtgctctttgcttacgttcacgtccgttgccttgcacccacccacccctcgacgggaaacaagatagagaaggaagaaaaaaaagctcgtctgccggccatggagagctcctcctcgtctctgctgctgagctcgtataccggcggcaacaagagggccagggaggccgacctggacgcggcctcgtccgccgaggcggaggccgccaagaggatgcggcccgaggacctgctggacctgctcgacgacgacgccgacgccgcggcggccggcgacctggcctccgtcatgcgcagcctggaggaggagatatgcgccggcgacctggccccgccgcagcccgagctgggcttcctgctcgaggcctcggacgacgagctcggcctgccgccggcggcggccgcggcgtcctcctcgtcggacgacgccgggggctgggagccgg

SEQ ID NO: 1673 - protein, 115 aa, Triticum aestivum
  misc_feature: Ceres Clone ID no. 917938
  misc_feature (1)..(115): Bit score of 105.9 for HMM based on sequences of FIGURE 11.
  misc_feature: Functional Homolog Of SEQ ID NO. 953
MESSSSSLLLSSYTGGNKRAREADLDAASSAEAEAAKRMRPEDLLDLLDDDADAAAAGDLASVMRSLEEEICAGDLAPPQPELGFLLEASDDELGLPPAAAAASSSSDDAGGWEP

SEQ ID NO: 1674 - DNA, 995 bp, Zea mays
  misc_feature: Ceres Clone ID no. 295180
  misc_feature: Encodes the peptide sequence at SEQ ID NO. 1675
gcgcaaaacacctcgccttttgtactcttgcgtctctgccctcgcgttatcgccttcgtcacgctcgctcgcctggctggcttgtgtgccttgccttgctcggcgtacgcgaacgcagcgagagggaggagcaaggaaatagagagagacagagagagagagagaaaaaatcaagtcatccccctttcctctgagctcgttccatggagaactcttctcacaagcgggcgcgggaggcgggcgacctcgtcgccggcggctgcggagaggagggctcgccgcaggccgacgccaagaggctgcggccgcaggacctgctcgacatgctggaggacgacaccgacgcggccgcggccggcgacctagcgtcggtcatgcggagcctggaggaggagatagccagcttcgacgaggccgcggaggcgccggcgccggcgccggagctgggcttcctgctcgaggcctcggacgacgagctggggctgccgcccgcctcctcttcggaggaggaggaggccgggcgcgcgggggcgcatgagccgcgcccgccctcgacggccagatctggggcttcgaggacgagatcgtggacggaggctgcttcggcggctactcgccggaggccgcggccgccgcbtcsgccgccgccgccgcgtgggacgacgacggcttcggcgccggcctcttcgcgttcggcggcgacgacgcgtgtggcccgtcggatctcgcggccctgcgccacgagaccatgcccgccgtctgatgacgatccccagggcccaggcagccgcagccagtcgattagccttcctttttttatttttattatttttacctttgttggctmaccttagcgagcgggcacccttttttttgacctggatgtaaagtttttagaagggtaaaaaaacagggggcgtggaaacttgggacgttgggaggaaggttcagagcaaggggagaagaagaaaaaaaaatctggagatggattctcc

SEQ ID NO: 1675 - protein, 216 aa, Zea mays
  misc_feature: Ceres Clone ID no. 295180
  misc_feature (1)..(216): Bit score of 105.9 for HMM based on sequences of FIGURE 11.
  misc_feature: Functional Homolog Of SEQ ID NO. 953
  misc_feature (145)..(145): Xaa is any aa, unknown, or other
  misc_feature (146)..(146): Xaa is any aa, unknown, or other
  misc_feature (215)..(215): Xaa is any aa, unknown, or other
MENSSHKRAREAGDLVAGGCGEEGSPQADAKRLRPQDLLDMLEDDTDAAAAGDLASVMRSLEEEIASFDEAAEAPAPAPELGFLLEASDDELGLPPASSSEEEEAGRAGAHEPRPPSTARSGASRTRSWTEAASAATRRRPRPPXXPPPPRGTTTASAPASSRSAATTRVARRISRPCATRPCPPSDDDPQGPGSRSQSISLPFFIFIIFTFVGXP

SEQ ID NO: 1676 - DNA, 449 bp, Triticum aestivum
  misc_feature: Ceres Clone ID no. 888125
  misc_feature: Encodes the peptide sequence at SEQ ID NO. 1677
aacccgaagcaaagaggcgaagggaaagagaaggaagaatagtctgtgcatcggccatggagagctcctcctcgtctctgttgcttagttcgtacgccggcaacaacaagagggccagggatgccgaccatgaaccggtctcgtccgcggaggctgacgccgccaagaggatgaagccggagtacctgctggacctgctcgacgacgacaccgacgccgcggcggccggcgacctggcctctgtcatgcggagccttgaggaggagatatgcgccgacgacctgacgcctccgcagcctgagctggggttcctgctcgaggcctcggacgacgagctcggcctgccgccggccgccggggcgtcctcctcgtcggacgacgccgggggctgggagccggaggagcccgccggcgtgttcggggagcagatatggggcttcggggacgag

SEQ ID NO: 1677 - protein, 131 aa, Triticum aestivum
  misc_feature: Ceres Clone ID no. 888125
  misc_feature (1)..(131): Bit score of 147.2 for HMM based on sequences of FIGURE 11.
  misc_feature: Functional Homolog Of SEQ ID NO. 953
MESSSSSLLLSSYAGNNKRARDADHEPVSSAEADAAKRMKPEYLLDLLDDDTDAAAAGDLASVMRSLEEEICADDLTPPQPELGFLLEASDDELGLPPAAGASSSSDDAGGWEPEEPAGVFGEQIWGFGDE

SEQ ID NO: 1678 - DNA, 907 bp, Glycine max
  misc_feature: Ceres Clone ID no. 1107598
  misc_feature: Encodes the peptide sequence at SEQ ID NO. 1679
atttacctcacttctttgcatgacttcctaaactctctctatactcttctctcttctacactttgctctaccctctttcccttccctcaagtactatcatacacatcacacacacaagcaaaaactcttgctttccttttcaagttcttaaactcatcacttacctcaggagtttgcatattttctttgtatggatggatccttccagtggacaacaccagcaaatgtctagccagtcattggagaacatgttggcatgttcaaaagcacagcaagagaggaagccaaggcctcagccagaacaggctctgaagtgtcccagatgtgactccaccaacaccaaattctgctactacaataattacagcctctcccaaccaaggtatttctgcaagtcctgcaggagatattggaccaaaggaggtacacttaggaatgtccctgtgggaggagggtgcaggaagaacaaaaggtcatcatcatcatcatcttcaacatcaaagagagttcaagaccaagcattcacaccaaatcctaactctctcattggccttccttcattgtcctatgactcaagtgacctcactcttgcattggcaaggcttcaaaagcagtcatgtgggcaattggggtatgatgagcatgatctttcaatgttggggaaccaccacccaagcaccccatgtgataatatccttggcatgcatcatcactcatcatcatccacaaacccagggttcttggatgccctcagaagtgggttccttggaacacaaagtagtaatatgcagcagaatctgtactatggatatgggaatggagacatgggggaggtggacaatggaaatgcttcttgtggtggagagatgatgatgatgccttataatgattaagaaatgagtgttga

SEQ ID NO: 1679 - protein, 232 aa, Glycine max
  misc_feature: Ceres Clone ID no. 1107598
  misc_feature (1)..(232): Bit score of 377.1 for HMM based on sequences of FIGURE 23.
  misc_feature (34)..(96): Pfam Name: zf-Dof Pfam Description: Dof domain, zinc finger
  misc_feature: Functional Homolog Of SEQ ID NO. 606
MDPSSGQHQQMSSQSLENMLACSKAQQERKPRPQPEQALKCPRCDSTNTKFCYYNNYSLSQPRYFCKSCRRYWTKGGTLRNVPVGGGCRKNKRSSSSSSSTSKRVQDQAFTPNPNSLIGLPSLSYDSSDLTLALARLQKQSCGQLGYDEHDLSMLGNHHPSTPCDNILGMHHHSSSSTNPGFLDALRSGFLGTQSSNMQQNLYYGYGNGDMGEVDNGNASCGGEMMMMPYND

SEQ ID NO: 1680 - DNA, 1316 bp, Glycine max
  misc_feature: Ceres Clone ID no. 543840
  misc_feature: Encodes the peptide sequence at SEQ ID NO. 1681
attacctcacttctttgcatgactacttcctaaactcttctcttctacactttgctctctaccctctttctttctctttctttttcccttccctcaagtactatcatacacaaacacaaggtacttcacatacccacatacacacacataagcaaaaactcttacttccctttttcaagttcttaaactcatcactacttaactcaggagtgtgcatattttcgttgtatggatggatccttctagtggacaacaccagcaaatgtctagccagtcattggagaacatgttggcatgttcaaaagcccaccaagagagaaaaccaacgcctcagccagaacaagctctaaagtgccccagatgtgactccaccaacaccaaattctgctactacaacaattacagcctttcccagccaaggtacttctgcaagtcatgcaggagatattggaccaaaggaggtacacttaggaatgtccctgtgggaggagggtgcaggaagaacaaaaggtcatcatcatcatcttcaacatcaaagagagttcaagatcaagcattcacaccaaatgttaaccctctcactggccttccttcattaatgtcttatgactccaatgacctcactcttgcattggcaaggcttcaaaagcagtcatgtgggcaattagggtatgatgatcatgatctttcaatgttggggaaccaccacacaaacaccccatgtggtgataatatccttggcatgcatcaccactcatcatcctcatccacaaacccagggttcttggatgccctcagaagtgggttccttggaacacaaagtaataataatatgcatcagaatatgtactatggatatgggaatggggacatgggggaggtggacaatggtggtggggttggggttagtagtagtggagagatgatgatgatgatgatgccttataataatgatcaagaaatgagtattgcatccacacaggcagtgacagtcaccaccatgaagcaagagatttgcaacggaagggaacaaaaggtgttgtggggttttccatggcaactcaatggagacacaaacatgggtgaacttgactcaggaagagctagtaattggaatggcatcaattcatcatggcatggacttctcaacagtcccctaatgtagacaacaaccacagggcctctactactgataattttatttccttaatttctcatgttttgttttactaaaaatgttattagtctaattaggattttcaatatccttttgagtgctgggttaattaattacaggggtttggttgattcccttg

SEQ ID NO: 1681 - protein, 310 aa, Glycine max
  misc_feature: Ceres Clone ID no. 543840
  misc_feature (1)..(310): Bit score of 611.8 for HMM based on sequences of FIGURE 23.
  misc_feature (34)..(96): Pfam Name: zf-Dof Pfam Description: Dof domain, zinc finger
  misc_feature: Functional Homolog Of SEQ ID NO. 606
MDPSSGQHQQMSSQSLENMLACSKAHQERKPTPQPEQALKCPRCDSTNTKFCYYNNYSLSQPRYFCKSCRRYWTKGGTLRNVPVGGGCRKNKRSSSSSSTSKRVQDQAFTPNVNPLTGLPSLMSYDSNDLTLALARLQKQSCGQLGYDDHDLSMLGNHHTNTPCGDNILGMHHHSSSSSTNPGFLDALRSGFLGTQSNNNMHQNMYYGYGNGDMGEVDNGGGVGVSSSGEMMMMMMPYNNDQEMSIASTQAVTVTTMKQEICNGREQKVLWGFPWQLNGDTNMGELDSGRASNWNGINSSWHGLLNSPLM

SEQ ID NO: 1682 - protein, 286 aa, Vitis vinifera
  misc_feature: Public GI ID no. 157337439
  misc_feature (1)..(286): Bit score of 542.5 for HMM based on sequences of FIGURE 23.
  misc_feature (23)..(85): Pfam Name: zf-Dof Pfam Description: Dof domain, zinc finger
  misc_feature: Functional Homolog Of SEQ ID NO. 606
MDTQSLESMLVCSKAQQERKPRPPEQALKCPRCDSTNTKFCYYNNYSLSQPRYFCKSCRRYWTKGGTLRNVPVGGGCRKNKRSSSSSSSKRTQDQPLTTNPNPLNVLPPLTYDSNDLTLAFARLQKQTGGQLGYDDHHHDLALMGNPNNTHCDVLGNQCVNTCGTTTPGLLDALRTNFLETPSGYHNLYYGFGNGGMGGEVENGGVGGEHMVLPYEEMSGATTTAVTVTTMKQELCHGREGENRVLWGFPWQQLNPDGSMGEVDSGRESWNGLASSWHGLLNSPLM

SEQ ID NO: 1683 - DNA, 1368 bp, Solanum lycopersicum
  misc_feature: Ceres Annot ID no. 8460854
  misc_feature: Encodes the peptide sequence at SEQ ID NO. 1684
atggagttatacggtgggtcacactccgatcgacagtcggaatgggttcctgttggacccgagaccggtcttgaagaatcaatgaggaggttggggttgtggaggagggaaccatacccggaaaggtccgggacatcgaactgttctttctatatgcgtacagggtcttgtggatatggtgctaaatgccggtataatcatcctcctgatcgtagctctgttggtgctgtgctgttggaaagtagtgaatatccagaacgaataggagagcctacatgccagtactatctaagaacagcaacctgtaaatttggtgcatcatgcaagttccaccatccaagaaacttaggtggatcgttgagcaatatatcactaaatgtttatggatacccattacatccggaggaaagagaatgctcctattatttgaaaacggggcaatgcaaatttggtataacatgtaaattccatcatcctgaccatgctgaggtatcagcgccagtgactgcacgtccattttatccaacatcgccttctcttcctgttcctcctgaagaatataacagtacatcaactagctctagagtagcaggacctcaactcttacccggtccttatgtacctggtacttatggtccagttttgcttcacccaggagtggtgaccattcagaactggagcacttactcgggaccagtgagtcctgcactttctcctggtgctcaaccctctgctgggatggcaactatttatgggatgccacaactagcatcttctacggctgcctttgcagcaccttactctccgttacactctgctgctggcccttcaagcagtgcactgagagaaaatcgttttccagaaagaccaggccaaccagtatgtcaatattacatgaaaactggggactgtaaatttggatcgtcctgtaaatttcatcatcctgctgactggattgcatcaaagacagattgtactttcagtcccttaggccttcctttgcgtccgcatatcttccaacttcagaacactagagatgtcagtctccttggattgttccaggggtgcagtcttgttccttttacatgcaaagaggattctgcaaatttggtggcacatgtaaattcgatcatcctatgggaacagtacgatatagtccatcagcttcttctcttcctgatataccgaatgccccttagatgtcgggatcttcccttactttggctcctatttcatcgccagagtaacaacccggatttgttacaggatccaaggcggatcccttctcatagtgcagcatctggtacttcttcaatcccgaatatgcaactgttgagtcggggaagttggccagtgaagttaatgtaa

SEQ ID NO: 1684 - protein, 455 aa, Solanum lycopersicum
  misc_feature: Ceres Annot ID no. 8460854
  misc_feature (1)..(455): Bit score of 311.9 for HMM based on sequences of FIGURE 17.
  misc_feature (290)..(316): Pfam Name: zf-CCCH Pfam Description: Zinc finger C-x8-C-x5-C-x3-H type
  misc_feature (43)..(69): Pfam Name: zf-CCCH Pfam Description: Zinc finger C-x8-C-x5-C-x3-H type
  misc_feature (134)..(160): Pfam Name: zf-CCCH Pfam Description: Zinc finger C-x8-C-x5-C-x3-H type
  misc_feature (88)..(114): Pfam Name: zf-CCCH Pfam Description: Zinc finger C-x8-C-x5-C-x3-H type
  misc_feature: Functional Homolog Of SEQ ID NO. 1457
MELYGGSHSDRQSEWVPVGPETGLEESMRRLGLWRREPYPERSGTSNCSFYMRTGSCGYGAKCRYNHPPDRSSVGAVLLESSEYPERIGEPTCQYYLRTATCKFGASCKFHHPRNLGGSLSNISLNVYGYPLHPEERECSYYLKTGQCKFGITCKFHHPDHAEVSAPVTARPFYPTSPSLPVPPEEYNSTSTSSRVAGPQLLPGPYVPGTYGPVLLHPGVVTIQNWSTYSGPVSPALSPGAQPSAGMATIYGMPQLASSTAAFAAPYSPLHSAAGPSSSALRENRFPERPGQPVCQYYMKTGDCKFGSSCKFHHPADWIASKTDCTFSPLGLPLRPHIFQLQNTRDVSLLGLFQGCSLVPFTCKEDSANLVAHVNSIILWEQYDIVHQLLLFLIYRMPLRCRDLPLLWLLFHRQSNNPDLLQDPRRIPSHSAASGTSSIPNMQLLSRGSWPVKLM

SEQ ID NO: 1685 - DNA, 1185 bp, Sorghum bicolor
  misc_feature: Ceres Annot ID no. 8687439
  misc_feature: Encodes the peptide sequence at SEQ ID NO. 1686
atggctggcccgccgaaagggttcgacagccgatctcgagcgccagagtcagggatccccagcgagcggtcgaagatcgaggcccgcctcgaggactcgctggcgatgttcaaggctgttgctgctgcaagaatgaagggagaatatcctcaaagaattgggcagcctgaatgtcaatactacctgaagactggcacatgcaagtttggagcaacttgcaagtttcaccatccccgagaaaaggctgcaatggcaactcgagttcagttgaatgaactgggctacccactccgcgcgaatgaaaaggagtgtgcttattatttaagaacagggcagtgcaagttcggaagcacatgtaagtttcaccatccacaaccatccaccatgatggttgctgtacgtggctctgtttattcacctggacagtctgcaacttctcctggccagcatgcttaccaaggggctgtaacaagctggcccttgtcgagatctgcttctttcattgcaagtccaaggtggccaggtcattcaagctatgcacaagtgattgttcctcctgggcttgttcaggtcccagggtggagtccttatactattggttcttcatcctcggatgaccaacaacggacacccggagctgcccaatactatactggctcacgccagagtggaacagctggcataggcgatcaaggaatgttttcatcctaccaagcaggttctgttcccgttggactttatgcagtacagagggagaatgtatttccagagagacctgaccaacctgaatgtcagttctatatgaagaccggagactgcaagtttggtgctgtatgcaagttccatcatcctagggagcgaataattcctactcccaattgtgcactgagtccattaggcctacccttgcgcccgggagaaccaatatgcagtttctataatcgctatggcatgtgcaagtttggtccaaattgcaaattcgatcatccaatgggaagtgctatgtatggccatgcttcatcgccaactagtgaggccccaacttctctgcgtatgctggcacatgtaccatcgcatccagaagtatcacctgacagtggctcgggaaggtctaggaggattgcccattctgattcccagcaaataccctctgttgaaaggagcactgagagagaggcgtcctaa

SEQ ID NO: 1686 - protein, 394 aa, Sorghum bicolor
  misc_feature: Ceres Annot ID no. 8687439
  misc_feature (1)..(394): Bit score of 765.0 for HMM based on sequences of FIGURE 17.
  misc_feature (259)..(285): Pfam Name: zf-CCCH Pfam Description: Zinc finger C-x8-C-x5-C-x3-H type
  misc_feature (305)..(331): Pfam Name: zf-CCCH Pfam Description: Zinc finger C-x8-C-x5-C-x3-H type
  misc_feature (53)..(79): Pfam Name: zf-CCCH Pfam Description: Zinc finger C-x8-C-x5-C-x3-H type
  misc_feature (99)..(125): Pfam Name: zf-CCCH Pfam Description: Zinc finger C-x8-C-x5-C-x3-H type
  misc_feature: Functional Homolog Of SEQ ID NO. 1457
MAGPPKGFDSRSRAPESGIPSERSKIEARLEDSLAMFKAVAAARMKGEYPQRIGQPECQYYLKTGTCKFGATCKFHHPREKAAMATRVQLNELGYPLRANEKECAYYLRTGQCKFGSTCKFHHPQPSTMMVAVRGSVYSPGQSATSPGQHAYQGAVTSWPLSRSASFIASPRWPGHSSYAQVIVPPGLVQVPGWSPYTIGSSSSDDQQRTPGAAQYYTGSRQSGTAGIGDQGMFSSYQAGSVPVGLYAVQRENVFPERPDQPECQFYMKTGDCKFGAVCKFHHPRERIIPTPNCALSPLGLPLRPGEPICSFYNRYGMCKFGPNCKFDHPMGSAMYGHASSPTSEAPTSLRMLAHVPSHPEVSPDSGSGRSRRIAHSDSQQIPSVERSTEREAS

SEQ ID NO: 1687 - DNA, 1387 bp, Zea mays
  misc_feature: Ceres Clone ID no. 100845183
  misc_feature: Encodes the peptide sequence at SEQ ID NO. 1688
gccgagagaagagtcggcaggaagcaaccgagaccgcgaggaagcagcgagctgcactgcagcggcgcagagaaaaaaaaaagaaattctggaatagtttttttcttccctttggctccgtgaggttcctgtgcttgctcgctcgctcgcctgagcttcgatcgagccgtacgcgggccgtcgggagctcaatcaccgctctccgggagcttccgagggccgtcggatggagccgtacgcggcgacgaagggcggcgagtccgacgccggcaccggcctggaagagtcgatgcggaagctggggctcggcgaggacgacgaagcgggggaggagaagcttccggagcggccgggcgaggcggactgcacctactacctccgcactggcgcctgcggctacggggagcgctgccgctacaaccacccccgggatcggccggctccggttaatggcgttgggaagaccacaggtatggagtacccagagcgccctggacagccactctgtgagtactatgcaaagaatggcacatgcaaatttggttccaattgcaagtttgatcatcccagggaaagtggttttgtacctgtcgctttaaacaacagtggattccctctacgtctgggtgaaaaggaatgttcgtattacatgaaaactggacattgcaaatttggaggtacatgtaaattccatcacccagaacttggttttcttacagagacgcctggcatgtacccaccagttcaaccatcacctatttcctccccacatccatatccacatcattccaactggcaaatggggaggcctgctgttgtgccagggtcatttttaccaggcccatatccaccaatgatgcttccacctacagttatgccaatgcagggatggaacccttatgtttcacctatgaaccaaactacaccagctgggggccagcaagctgttccagcagggccatcttatggcttgtcgcaccaggagccaacctctgcagtgacttatggcagtcattatgcgcaattgtattcttcttctgggacttcaagcagcaacatacaagaatatgtgtttccagagcggcctgggcagcctgaatgtgaacattacatgaagacaggaacctgtaaatatggagcagcctgcaaatatcatcatcctcaatacttcagtggaccaaagtctaactgtatactgagccctctgggtcttcccctgcgtcctggttctcagcgatgtgcttactacgcacaccatggcttttgcaagtttgggccgacatgcaagtttgatcacccgatgggtactccaaactacagtcttccagcaccatcacttactgatgtgccagtcgctccatatcctcacactttctctgttactcct

SEQ ID NO: 1688 - protein, 387 aa, Zea mays
  misc_feature: Ceres Clone ID no. 100845183
  misc_feature (1)..(387): Bit score of 323.7 for HMM based on sequences of FIGURE 17.
  misc_feature (287)..(313): Pfam Name: zf-CCCH Pfam Description: Zinc finger C-x8-C-x5-C-x3-H type
  misc_feature (89)..(115): Pfam Name: zf-CCCH Pfam Description: Zinc finger C-x8-C-x5-C-x3-H type
  misc_feature (42)..(68): Pfam Name: zf-CCCH Pfam Description: Zinc finger C-x8-C-x5-C-x3-H type
  misc_feature (133)..(159): Pfam Name: zf-CCCH Pfam Description: Zinc finger C-x8-C-x5-C-x3-H type
  misc_feature (333)..(359): Pfam Name: zf-CCCH Pfam Description: Zinc finger C-x8-C-x5-C-x3-H type
  misc_feature: Functional Homolog Of SEQ ID NO. 1457
MEPYAATKGGESDAGTGLEESMRKLGLGEDDEAGEEKLPERPGEADCTYYLRTGACGYGERCRYNHPRDRPAPVNGVGKTTGMEYPERPGQPLCEYYAKNGTCKFGSNCKFDHPRESGFVPVALNNSGFPLRLGEKECSYYMKTGHCKFGGTCKFHHPELGFLTETPGMYPPVQPSPISSPHPYPHHSNWQMGRPAVVPGSFLPGPYPPMMLPPTVMPMQGWNPYVSPMNQTTPAGGQQAVPAGPSYGLSHQEPTSAVTYGSHYAQLYSSSGTSSSNIQEYVFPERPGQPECEHYMKTGTCKYGAACKYHHPQYFSGPKSNCILSPLGLPLRPGSQRCAYYAHHGFCKFGPTCKFDHPMGTPNYSLPAPSLTDVPVAPYPHTFSVTP

SEQ ID NO: 1689 - DNA, 1648 bp, Arabidopsis thaliana
  misc_feature: Ceres Clone ID no. 149496
  misc_feature: Encodes the peptide sequence at SEQ ID NO. 1690
aattctctgtctgtgataaaagaaaaattgaatttttttcttctatctatctacctctgttcttcctcgtcatttcttacccagaaaaatagaggataacaaaaatctgtttctttcgatgatcatcgtgacactttctctgtgatttttcctttcttctgttgttgttgatcatcgtgatcatcgtctttccttacatgcgaacccccatgtcagacactcagcatgtacagagctctttggtgtcgattcgatcttccgacaaaatcgaagatgcctttaggaagatgaaagtaaatgagaccggcgtggaggaactgaatccgtatccagatcgtcccggtgaaagagattgccaattctatttaagaactggtctctgtggctatggaagcagttgccgttacaatcatcctactcatcttccacaggatgttgcttattacaaggaggagctccctgagagaattggacagccggattgtgagtattttctgaagacaggagcttgtaagtacggcccaacttgtaaatatcatcatccaaaggacaggaacggtgcacaacctgtaatgttcaatgttatcggtttacctatgcgtctgggtgagaagccatgtccatattacctgcgaacgggaacttgcagattcggagttgcttgcaaattccaccatcctcaacctgataatggacattctactgcatatggaatgtctagctttcctgctgcagatttacgatatgctagtggtttaacaatgatgtctacatatggaactttgcctcgtccgcaagttccccagtcctatgtgccaatcctggtttcaccctctcaaggctttttacctcctcaaggctgggccccttacatggctgcatctaactccatgtacaatgtgaagaatcaaccttattactccggtagtagtgcatccatggccatggctgtggcattgaaccgtggtttgtcagaaagttctgaccaaccagaatgtcggttttttatgaacaccgggacatgtaaatacggagacgattgcaaatacagccatcccggagtaaggatttcacaaccaccaccaagtcttataaaccctttagttcttccagcgagacctggacaaccagcttgtggtaacttcaggtcttatggattctgcaagtttggaccaaactgcaaattcgaccaccctatgctgccatatccgggcctgaccatggctacttctctgcctactccttttgcttcacctgttacaacccatcagaggatctcaccaacaccaaaccgctctgattcaaagtctctttctaatggtaaacctgatgtgaagaaagaaagctcagagactgagaaaccagacaatggagaagtgcaggatttgtctgaggatgcgtcatcaccatgatcatgattcttaaaaaccccaatgatctctctctgcccttttttgtggaagaggaggggaggtgaaaagtgtttctcttttctttttttttcttttttttttggcttggagatggccatggctgaaaacaatataggatgaaaccagtgatgttgtcacaggtttctcttctgtttttgactctgttaataaattttaatcagacttatcagaggaaaaatagagtttgtgttgtg

SEQ ID NO: 1690 - protein, 404 aa, Arabidopsis thaliana
  misc_feature: Ceres Clone ID no. 149496
  misc_feature (1)..(404): Bit score of 280.5 for HMM based on sequences of FIGURE 17.
  misc_feature (136)..(162): Pfam Name: zf-CCCH Pfam Description: Zinc finger C-x8-C-x5-C-x3-H type
  misc_feature (262)..(288): Pfam Name: zf-CCCH Pfam Description: Zinc finger C-x8-C-x5-C-x3-H type
  misc_feature (48)..(74): Pfam Name: zf-CCCH Pfam Description: Zinc finger C-x8-C-x5-C-x3-H type
  misc_feature (91)..(117): Pfam Name: zf-CCCH Pfam Description: Zinc finger C-x8-C-x5-C-x3-H type
  misc_feature (308)..(334): Pfam Name: zf-CCCH Pfam Description: Zinc finger C-x8-C-x5-C-x3-H type
  misc_feature: Functional Homolog Of SEQ ID NO. 1457
MRTPMSDTQHVQSSLVSIRSSDKIEDAFRKMKVNETGVEELNPYPDRPGERDCQFYLRTGLCGYGSSCRYNHPTHLPQDVAYYKEELPERIGQPDCEYFLKTGACKYGPTCKYHHPKDRNGAQPVMFNVIGLPMRLGEKPCPYYLRTGTCRFGVACKFHHPQPDNGHSTAYGMSSFPAADLRYASGLTMMSTYGTLPRPQVPQSYVPILVSPSQGFLPPQGWAPYMAASNSMYNVKNQPYYSGSSASMAMAVALNRGLSESSDQPECRFFMNTGTCKYGDDCKYSHPGVRISQPPPSLINPLVLPARPGQPACGNFRSYGFCKFGPNCKFDHPMLPYPGLTMATSLPTPFASPVTTHQRISPTPNRSDSKSLSNGKPDVKKESSETEKPDNGEVQDLSEDASSP

SEQ ID NO: 1691 - DNA, 1993 bp, Panicum virgatum
  misc_feature: Ceres Clone ID no. 1858827
  misc_feature: Encodes the peptide sequence at SEQ ID NO. 1692
gacggacgcctgccgcttggcttggctcctctccacctccacctccacctcctctcgcggtctcgcctcgcgtcgcttctcccccactccactccgcctcccccaccccccctcgcgccgcggcgccctctgatctgatgccggggaggccctgatggcggcggcgggagctggagcggccggcgggggagccgggggcggggagggctcctcctccccggcgggcgtcgcgatcgggccccaccaccacggggccgcggaagaggtcatgtggcaaatgactttaggaggaggagaatctatggaacatggtcccttccctgagagaattggagaaccagactgtagttattatatgaggactggactttgtagatttggggcaacgtgcaagttcaatcacccgccaaacaggaagctggctgttgctgctgcaaggatgaaaggggagtatccttatagagttggtcaaccagagtgtcaatattatctgaagaccgggacatgcaagtttggagcaacatgcaagtttcatcacccccgagaaaaggctgcgattgcaacgcgagtacagttgaatgttctaggttacccaataaggccgaatgagaaggaatgtgcttattatttgcgaacagggcagtgcaaatttgcaagcacatgtaagtttcatcatccaccgccctccaatacgatggttgctgtacgcggctctatttattcacctgggcaatctgcaacctctcctggtcaacatacatatcctggggctgttactaattggactttgtcaagatctgcatcatttattgcaagtcctcgatggcctggtcattcaggctatgcacaagtgattgttccccagggccttgttcaagttcccaggtggaatccttatgctgcacaaatgggctcttcttcgccagatgatcaacaacgaacacctggaacaactcaatactatgctagctcacatcaaagtgaaacaactggtatgggtgaacatggagtgtatccgtcataccaaccaggttctgttcctcttggactttatgcagtacaaggagagaacatatttcctgagagacctgaccagcctgagtgtcagttctatatgaaaaccggagactgcaagtttggtgctgtttgcaagtttaatcaccctaaggagcgtctgattcctgctccaaactgtgcattgagtccattaggtcttccacttcgcccgggagaacctgtctgcaccttctattctcgttacggcatctgcaagttcggtccaaattgcaaatttgaccatcctatgggaacccttatgtacggaaccgcaacctcaccgacaggtgatgcgccaaccatgcactaccagttggcatcctcaccagggcattctgaaagattgctcgacggagggtccggaaggtctcataggatttcccaaactgattcccagcaaataccctctggcaatggaagcactgagagagaggcgtcataagccgccctcctcagcctttcctcatgcttattcccattcttgtctcttcagtaattatctcccaacacattcaaagagctgaagctgtacaggtcctcgtccatccttcctccgctgttctgagcttccgcattccggtgcttcgccatgtatcacattcaagcaggaaaaagttcttgctcaccccaccctggtgcccgtttgccctctgaaaaataatggggtaaccattcatatttatccgtccgtacacagacacaagatacactcactccctgatccctttgttgtagttatacaggtgacctgcggtgaacaaagcttaccaaactgactactggggttgcaacttcttcctatctttccttttgctcttattcctttttaggcaattggggtgagggcaggacgtgctgctcgtgcaagtctgcatgttcaaaacagcgggaataataccctgccttcaatgtaataattgtaatctatgtatgaccc

SEQ ID NO: 1692 - protein, 409 aa, Panicum virgatum
  misc_feature: Ceres Clone ID no. 1858827
  misc_feature (1)..(409): Bit score of 867.9 for HMM based on sequences of FIGURE 17.
  misc_feature (274)..(300): Pfam Name: zf-CCCH Pfam Description: Zinc finger C-x8-C-x5-C-x3-H type
  misc_feature (320)..(346): Pfam Name: zf-CCCH Pfam Description: Zinc finger C-x8-C-x5-C-x3-H type
  misc_feature (21)..(47): Pfam Name: zf-CCCH Pfam Description: Zinc finger C-x8-C-x5-C-x3-H type
  misc_feature (66)..(92): Pfam Name: zf-CCCH Pfam Description: Zinc finger C-x8-C-x5-C-x3-H type
  misc_feature (112)..(138): Pfam Name: zf-CCCH Pfam Description: Zinc finger C-x8-C-x5-C-x3-H type
  misc_feature: Functional Homolog Of SEQ ID NO. 1457
MWQMTLGGGESMEHGPFPERIGEPDCSYYMRTGLCRFGATCKFNHPPNRKLAVAAARMKGEYPYRVGQPECQYYLKTGTCKFGATCKFHHPREKAAIATRVQLNVLGYPIRPNEKECAYYLRTGQCKFASTCKFHHPPPSNTMVAVRGSIYSPGQSATSPGQHTYPGAVTNWTLSRSASFIASPRWPGHSGYAQVIVPQGLVQVPRWNPYAAQMGSSSPDDQQRTPGTTQYYASSHQSETTGMGEHGVYPSYQPGSVPLGLYAVQGENIFPERPDQPECQFYMKTGDCKFGAVCKFNHPKERLIPAPNCALSPLGLPLRPGEPVCTFYSRYGICKFGPNCKFDHPMGTLMYGTATSPTGDAPTMHYQLASSPGHSERLLDGGSGRSHRISQTDSQQIPSGNGSTEREAS

SEQ ID NO: 1693 - DNA, 1893 bp, Gossypium hirsutum
  misc_feature: Ceres Clone ID no. 1925986
  misc_feature: Encodes the peptide sequence at SEQ ID NO. 1694
atttttagagagcgaaagaagcaaagctcacacatagtgaaaaggattctcttttctctcttcttcttcttcttagcaaatttcagctctcgattgagctcttttcgatctttctagaacattccatttatctccgttgaaccttccattttctttttttgtttgatttttttccggcgaagtcggtaaggttattattgttctacggaccaccctcgcccccacccacacaatcaaatcccgtttcgatggagttgtacggtcgtaacccgactcgtaatgggtctcaatccggttatcaacccgaatggagccccgctgggcccgaaactggactggaagaatcgaggtggcaattgtcggtgaggggcgtcgaatcgtacccggaacggctcggggtgactgattgtgtttactacatgcgaacggggttttgtggttacggtaatagttgccgttacaatcatccccgcaaccgtgccgcggttgagtctgcagtaagagcaacaggggagtaccctgaacgaccaggggaacctgtatgtcagttttatttaaaaaccggaacctgtaaatttggtgcatcctgtaagttccatcatccaaaagatggaggtggatcctttagccatgtttcattgaacatgcatggatacccattacggccgggtgagaaagaatgctcctactatttgaaaacggggcagtgcaaatttggtataacttgtaaattccatcatcctcaaccatctggaacatcaatgtcagcatctgcacctcaattttatcagccggtgcagtctccttcagtccctgtacctgaacagtatgggggggcatctaccaatgtgagagtggcaaggcctccacctttacctggttcatacgttcaagggggggcttatggtcctgtactgttttccccaggagtggttcctattccgggttggagtcactacttggcacctgtaagcccagtgctctctcctggtgtacaacctgctgttggagcaacctctctctatggactaacgcacctatcttcttcaacaccttcacttgcaggtccttattcctcattgccctcttctactggcctttcaagcagtaaccagaaggaacatacatttccagagagacctggtgaacctgaatgccaatactatttgaggactggggactgtaaatttggatcatcttgtaggtatcatcatcctagagacagggttgtgccacaaacaaattgcgtcctcagcccaatgggacttcctttacgtccaggggtgcagccttgtgctttctacttgcagaatgggcactgcaagtttgggtccacatgcaaatttgatcatccggtgggaacaatgagatttagtccatagcggcgtttcttattgatacaccagttgctccgtgttctattgggtctttactggctacattggcctatcctgttcccctttcagattttcagctttcaagcacgagacaggattgtgaggtttgtcactcaaatcgatgcaaaatgctagagccatttttcattttcttgccgatgtgatttcaccatccttgatatattttctgttgatagatctcagtatattatagtcaattgtgcaaagttatatttctcagaagcaagggttgtcaacaaatctgccttaccacacaatcggaccactattttatgcctctcttgtctttatttactgtcaaatataatctggaataagcttttgtagcaaacagtgtatgaactcctatctaccgctctcttccaaataaatcgaagcagagagccgttatatcaggttagcctctgactgtactttcaacttgatgttttatatactttgttcatttgcaatgaggaattgaagaatgatttcc

SEQ ID NO: 1694 - protein, 377 aa, Gossypium hirsutum
  misc_feature: Ceres Clone ID no. 1925986
  misc_feature (1)..(377): Bit score of 366.1 for HMM based on sequences of FIGURE 17.
  misc_feature (94)..(120): Pfam Name: zf-CCCH Pfam Description: Zinc finger C-x8-C-x5-C-x3-H type
  misc_feature (298)..(324): Pfam Name: zf-CCCH Pfam Description: Zinc finger C-x8-C-x5-C-x3-H type
  misc_feature (140)..(166): Pfam Name: zf-CCCH Pfam Description: Zinc finger C-x8-C-x5-C-x3-H type
  misc_feature (344)..(370): Pfam Name: zf-CCCH Pfam Description: Zinc finger C-x8-C-x5-C-x3-H type
  misc_feature (49)..(75): Pfam Name: zf-CCCH Pfam Description: Zinc finger C-x8-C-x5-C-x3-H type
  misc_feature: Functional Homolog Of SEQ ID NO. 1457
MELYGRNPTRNGSQSGYQPEWSPAGPETGLEESRWQLSVRGVESYPERLGVTDCVYYMRTGFCGYGNSCRYNHPRNRAAVESAVRATGEYPERPGEPVCQFYLKTGTCKFGASCKFHHPKDGGGSFSHVSLNMHGYPLRPGEKECSYYLKTGQCKFGITCKFHHPQPSGTSMSASAPQFYQPVQSPSVPVPEQYGGASTNVRVARPPPLPGSYVQGGAYGPVLFSPGVVPIPGWSHYLAPVSPVLSPGVQPAVGATSLYGLTHLSSSTPSLAGPYSSLPSSTGLSSSNQKEHTFPERPGEPECQYYLRTGDCKFGSSCRYHHPRDRVVPQTNCVLSPMGLPLRPGVQPCAFYLQNGHCKFGSTCKFDHPVGTMRFSP

SEQ ID NO: 1695 - DNA, 1312 bp, Arabidopsis thaliana
  misc_feature: Ceres Clone ID no. 20745
  misc_feature: Encodes the peptide sequence at SEQ ID NO. 1696
tgagttcagatgaaacaatggaaactggttcttaccctgaacgaccaggagagcctgattgttcttattacataagaactggtctttgtagatttggctctacttgtcggttcaaccatcctcgtgatcgggaactggttatagctactgcaaggatgagaggagaataccctgaaaggattggtcagcctgaatgcgagtactatttgaagacaggaacctgcaagtttggagtaacatgtaagtttcatcatccaaggaacaaagctgggattgctggaagagtctctctcaatatgttaggctatcctctacgctcgaatgaggttgattgtgcttatttcctaagaaccggacactttaaatttggtggtacttgtaaattcaaccaccctcagcctcaaccaaccaacatgatggttcctacctcagggcaacagtcttatccttggtcaagagcttcttttattgccagccctcgttggcaagatccgtctagctacgcttccttaatcatgcctcaaggagttgtcccggttcaaggatggaacccttacagtggtcagctcggctcagtttctccttcaggtaccggaaatgatcaaaactacagaaatttacagcagaacgagacaatagagtcaggctctcagtctcaaggatcattctcgggttacaatccgggatcctctgttccgctaggagggtattatgcattgccgagggaaaatgtgttcccggagagaccaggacaacccgaatgccaattctacatgaagacaggtgactgcaaatttggcacagtttgcaaatttcaccatcctagagacagacaagctcctcctcctgattgtctcttaagttccattggcctccccttacgcccgggagaaccgttgtgtgtgttctatacacgctatggaatctgcaaatttggtccaagctgtaaatttgatcacccaatgcgagtattcacatacgacaacacagcttcagagacagatgaggtagtggaaacatcaacagggaaatctagaagactctctgtgtctgaaacaagacaagcagcaacaacatcctctggtaaagacactaccattgataatacacagcagtgaagaaacaaaggaagaagaagaagagcttttaaacaagagcttttgatttttcaaaagaggaatctgtaaattctcattttcatttagtctctcaagcatttattaataatgtatagaggtgatttatacaactgatcttgatcttgatctgatcgccattgttgtaatattcttttggcgaatcaggttcaatg

SEQ ID NO: 1696 - protein, 366 aa, Arabidopsis thaliana
  misc_feature: Ceres Clone ID no. 20745
  misc_feature (1)..(366): Bit score of 741.9 for HMM based on sequences of FIGURE 17.
  misc_feature (244)..(270): Pfam Name: zf-CCCH Pfam Description: Zinc finger C-x8-C-x5-C-x3-H type
  misc_feature (290)..(316): Pfam Name: zf-CCCH Pfam Description: Zinc finger C-x8-C-x5-C-x3-H type
  misc_feature (10)..(36): Pfam Name: zf-CCCH Pfam Description: Zinc finger C-x8-C-x5-C-x3-H type
  misc_feature (55)..(81): Pfam Name: zf-CCCH Pfam Description: Zinc finger C-x8-C-x5-C-x3-H type
  misc_feature (101)..(127): Pfam Name: zf-CCCH Pfam Description: Zinc finger C-x8-C-x5-C-x3-H type
  misc_feature: Functional Homolog Of SEQ ID NO. 1457
METGSYPERPGEPDCSYYIRTGLCRFGSTCRFNHPRDRELVIATARMRGEYPERIGQPECEYYLKTGTCKFGVTCKFHHPRNKAGIAGRVSLNMLGYPLRSNEVDCAYFLRTGHFKFGGTCKFNHPQPQPTNMMVPTSGQQSYPWSRASFIASPRWQDPSSYASLIMPQGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLPLRPGEPLCVFYTRYGICKFGPSCKFDHPMRVFTYDNTASETDEVVETSTGKSRRLSVSETRQAATTSSGKDTTIDNTQQ

SEQ ID NO: 1697 - DNA, 1948 bp, Triticum aestivum
  misc_feature: Ceres Clone ID no. 787996
  misc_feature: Encodes the peptide sequence at SEQ ID NO. 1698
gagcgggggctgcgactgcaagggagggagagggaagggggagaagaggagtccggaggaagcaacacccaagagcgagagagattttgcttcgctttcgcccctgctcgagccgtcctctgctcgcgcggcagccgggcgagcgcggtccggcccgatccccgcccgatcgccgcggcgggaggagcattcggggagctgctcgatgatggagtcgtacgccgcgtcccccaaggacggcggcgccgagggcggccgcgccgacgctgccactggcctggaagagtcgatgtggaggctggggctggccggcggagaggaggccgccggggaggggctgccggagcgcccgggcgaggccaactgcgtctactacctccgcacgggggcctgcggctacggggagacctgccgctacaaccaccctcgcgatcgcgccgccgcgtttgatggagggacaaggaccgcacgcacagtggagtacccagaacgcccaggtcagccaccgtgtgagtactacatgaagaatgggacttgtaagtttggctctaattgcaagtataatcatcccagagaaggcggttctgtacaaccagttgtcttaaattcctgtggttaccctctgcgtctgggtgagaaagagtgttcctactatatcaaaactggccattgcaaatttggatcaacatgtaaatttcatcacccagaagggccagaacatggtgttgtttcagagacaccaaacatgtatccacaagtgcaacaactgcctgtctcttcccctcttccatacccacctctagccagttggcaattggggagaccttctgttctgccaggatcatttttcccgggctcttatcctccaatgatgcacccatctgcagtcatgccaatgcagggatggaacccttacatgccacctatcaaccaagtcgcgtcagctgggggacagcaaactgttcaggcaggaccattgtatggcttatcacaccaagggcctccatctgcagttgcttatggcagtaattatgcatcgttgtcttcttcaacatggccttcaagtgacaaacaagaagttgtctttccagagcggcctgggcagcctgaatgccaccactacatgaagacagggacctgtaaatttggatccacatgtaaatacaatcatcctcaatacctgagtacacctaggtccaactatatgctgagccctctaggtcttccaattcggccgggtgcccagccatgtctgtactattcacagcatgggttttgcaaatttggtcccggatgcaaatttgatcacccactgggtgctctaagctacagcccttcagcatcatcgcttggtgacgtgcctattgctccatatcctctcagtctccctgttgctcctatggccccatctccattatcttctggtctgcggccagattacattctggccaaggactcttcagcaaatcagccagcgtcacctggaactacatttggaaatgctgggcagttgtcaaaaatttatgctccacacatgcttctccgtcctccaacttctgcaaccggtgccactgtcaccatccatggtggagagttctgatcccattgctgggatgaaaatggatgttcagaaagcttctcaagatgtttattttggcgtagatgagatgagatctcggctcgtttttgctcagattcggttctacagcaaatctgtttccacttcccctctcagcatcttcaccctgaattcccacccaatgtgaatatggctggagctgacatagacaacgacggccaaggtggcagtctttgccatctgaataaatgcatagatggggagtggcaagctcgtaccctgccatttttctgttcattgctgaattggaagagggagaatcctgaaatccacttaactggtgcccattctatcggtacataattatcg

SEQ ID NO: 1698 - protein, 464 aa, Triticum aestivum
  misc_feature: Ceres Clone ID no. 787996
  misc_feature (1)..(464): Bit score of 388.6 for HMM based on sequences of FIGURE 17.
  misc_feature (298)..(324): Pfam Name: zf-CCCH Pfam Description: Zinc finger C-x8-C-x5-C-x3-H type
  misc_feature (97)..(123): Pfam Name: zf-CCCH Pfam Description: Zinc finger C-x8-C-x5-C-x3-H type
  misc_feature (49)..(75): Pfam Name: zf-CCCH Pfam Description: Zinc finger C-x8-C-x5-C-x3-H type
  misc_feature (142)..(168): Pfam Name: zf-CCCH Pfam Description: Zinc finger C-x8-C-x5-C-x3-H type
  misc_feature (344)..(370): Pfam Name: zf-CCCH Pfam Description: Zinc finger C-x8-C-x5-C-x3-H type
  misc_feature: Functional Homolog Of SEQ ID NO. 1457
MMESYAASPKDGGAEGGRADAATGLEESMWRLGLAGGEEAAGEGLPERPGEANCVYYLRTGACGYGETCRYNHPRDRAAAFDGGTRTARTVEYPERPGQPPCEYYMKNGTCKFGSNCKYNHPREGGSVQPVVLNSCGYPLRLGEKECSYYIKTGHCKFGSTCKFHHPEGPEHGVVSETPNMYPQVQQLPVSSPLPYPPLASWQLGRPSVLPGSFFPGSYPPMMHPSAVMPMQGWNPYMPPINQVASAGGQQTVQAGPLYGLSHQGPPSAVAYGSNYASLSSSTWPSSDKQEVVFPERPGQPECHHYMKTGTCKFGSTCKYNHPQYLSTPRSNYMLSPLGLPIRPGAQPCLYYSQHGFCKFGPGCKFDHPLGALSYSPSASSLGDVPIAPYPLSLPVAPMAPSPLSSGLRPDYILAKDSSANQPASPGTTFGNAGQLSKIYAPHMLLRPPTSATGATVTIHGGEF

SEQ ID NO: 1699 - protein, 478 aa, Vitis vinifera
  misc_feature: Public GI ID no. 157336316
  misc_feature (1)..(478): Bit score of 441.4 for HMM based on sequences of FIGURE 17.
  misc_feature (304)..(330): Pfam Name: zf-CCCH Pfam Description: Zinc finger C-x8-C-x5-C-x3-H type
  misc_feature (50)..(76): Pfam Name: zf-CCCH Pfam Description: Zinc finger C-x8-C-x5-C-x3-H type
  misc_feature (96)..(122): Pfam Name: zf-CCCH Pfam Description: Zinc finger C-x8-C-x5-C-x3-H type
  misc_feature (142)..(168): Pfam Name: zf-CCCH Pfam Description: Zinc finger C-x8-C-x5-C-x3-H type
  misc_feature (350)..(376): Pfam Name: zf-CCCH Pfam Description: Zinc finger C-x8-C-x5-C-x3-H type
  misc_feature: Functional Homolog Of SEQ ID NO. 1457
MDRYGRAPAMEGSPSDPSQEWTGPVAETGLEEPLWQLGLGGGGEAYPERPDEADCIYYLKTGFCGYGARCRFNHPRDRGGVGGTVRPGGGEFPERVGQPVCQFYMKTGTCKFGASCKYHHPRQGGGTVSPVTLNYFGYPLRPGEKECSYYVKTGLCKFGETCKFHHPQPDSIQLSTPGPAALPAPVPAHTLYPTVQSPSVPSSQQYGLVVARPPLLPSSYFHGPYSPVLIPPGMVPFPGWSHYPAPVSPVASPSTQPTVGSGQMYGLTPLSPSAPAYTGPYTPLPSSVGPSSSSQKEQIFPERPGQPECQYYMRTGDCKFGSSCKYHHPPEWDTPKTNCVLSPMGLPLRPGAPQCTHYAQRGICKFGPTCKFDHPMGTLSYSPSASSLADMPVAPYPVGSSMGTLAPSSSSSDLRPELISGSSKESLSTRMSSSMSTSSGSVGSIFSKSGPGHSSTQQPVQSSGPSTGSSSSEAHTSS

SEQ ID NO: 1700 - protein, 442 aa, Vitis vinifera
  misc_feature: Public GI ID no. 157347815
  misc_feature (1)..(442): Bit score of 422.2 for HMM based on sequences of FIGURE 17.
  misc_feature (61)..(87): Pfam Name: zf-CCCH Pfam Description: Zinc finger C-x8-C-x5-C-x3-H type
  misc_feature (309)..(335): Pfam Name: zf-CCCH Pfam Description: Zinc finger C-x8-C-x5-C-x3-H type
  misc_feature (263)..(289): Pfam Name: zf-CCCH Pfam Description: Zinc finger C-x8-C-x5-C-x3-H type
  misc_feature (107)..(133): Pfam Name: zf-CCCH Pfam Description: Zinc finger C-x8-C-x5-C-x3-H type
  misc_feature (16)..(42): Pfam Name: zf-CCCH Pfam Description: Zinc finger C-x8-C-x5-C-x3-H type
  misc_feature: Functional Homolog Of SEQ ID NO. 1457
MWRLGLSSRESYPERPGVADCVYYMKTGFCGFGSRCRYNHPRDRSSVSTLRSGGGEYPERIGEPACQFYLKTGTCKFGASCRFHHPRNGGGSMSHVSLNIYGYPLRLGEKECSYYLKTGQCKFGITCKFHHPQPAGTSLPASAPTFYPTVQSPSVPTPTQYGGTSTSWRVPRPPVLPGSYVQGPYGPVLFPPGVVPIPGWSPYSTPVSPVLSPGAQPTVGAGSVYGVTQLPSTHTLAGPYASLPSSAGPSSSNQKEQVFPERPGQQECQYYLRTGDCKFGSSCRYHHPREWVVPKTNCVLSPLGLPLRPGVQPCTFYLQNGYCKFGSTCKFDHPLGNMRYSPSASSLTDMPVAPYPVGSSLATLAPSFSSSDLRPDFISGSKKDSHSTRMPSSGNTTSSSVGLIFSQTGSVSLSDVQLSGQSSAPLSSSRSTRQGGEVRRSN

SEQ ID NO: 1701 - protein, 404 aa, Vitis vinifera
  misc_feature: Public GI ID no. 157348279
  misc_feature (1)..(404): Bit score of 850.4 for HMM based on sequences of FIGURE 17.
  misc_feature (310)..(336): Pfam Name: zf-CCCH Pfam Description: Zinc finger C-x8-C-x5-C-x3-H type
  misc_feature (264)..(290): Pfam Name: zf-CCCH Pfam Description: Zinc finger C-x8-C-x5-C-x3-H type
  misc_feature (110)..(136): Pfam Name: zf-CCCH Pfam Description: Zinc finger C-x8-C-x5-C-x3-H type
  misc_feature (21)..(47): Pfam Name: zf-CCCH Pfam Description: Zinc finger C-x8-C-x5-C-x3-H type
  misc_feature (64)..(90): Pfam Name: zf-CCCH Pfam Description: Zinc finger C-x8-C-x5-C-x3-H type
  misc_feature: Functional Homolog Of SEQ ID NO. 1457
MWQMNLRSSETMESGPYPERPGEPDCSYYIRTGLCRFGITCRFNHPPNRKLAIATARMKGEEWDSQNVRHYYLKTGTCKFGATCKFHHPRDKAGIAGRVSLNILGYPLRPDEIDCAYYLRTGQCKFGSTCKFHHPQPSSMMVSLRGSPVYPSVPSPTTPGITNWPLSRASFIPSPRWQAPSSYAPLMLPQGVVSVPGWNAYSGQLGSPSESQQQTGGNNQIYGTSRQSEQPNTGSQGTFSPYRSGSVPIGFYALQRENVFPERPGQPECQFYMKTGDCKFGAVCRFHHPRERLIPTPDCVLSPIGLPLRPGEPLCIFYSRYGICKFGPSCKFDHPMGIFAYNLSASSSADAPVVRRLLGSSSGSAALTLSSDGLVEAGSTKPRRLSLPETRQMPPGDDNIDTEG

SEQ ID NO: 1702 - protein, 423 aa, Vitis vinifera
  misc_feature: Public GI ID no. 157348991
  misc_feature (1)..(423): Bit score of 334.0 for HMM based on sequences of FIGURE 17.
  misc_feature (135)..(161): Pfam Name: zf-CCCH Pfam Description: Zinc finger C-x8-C-x5-C-x3-H type
  misc_feature (258)..(284): Pfam Name: zf-CCCH Pfam Description: Zinc finger C-x8-C-x5-C-x3-H type
  misc_feature (48)..(74): Pfam Name: zf-CCCH Pfam Description: Zinc finger C-x8-C-x5-C-x3-H type
  misc_feature (304)..(330): Pfam Name: zf-CCCH Pfam Description: Zinc finger C-x8-C-x5-C-x3-H type
  misc_feature (90)..(116): Pfam Name: zf-CCCH Pfam Description: Zinc finger C-x8-C-x5-C-x3-H type
  misc_feature: Functional Homolog Of SEQ ID NO. 1457
MLDNRQVQSNGVSNPSSENVEEAILRLKIHDNQEEGSVGHSSPYPDRPGEPDCIYYLRTGLCGYGSNCRFNHPAYSEQGAQYRGELPERVGQPDCGYFLKTGTCKYGSTCKYHHPRDRHGAGPVSLNIVGLPMRQEEKPCSYYMRTGLCKFGAACKFHHPQPASAGTVLPATGSSILPSSGLPTIYTWPAYARSTDLHAYCIVPAQGWNTYMGNMSPISSTGILGSNLVYNSRNQSESGSSGQVHLLSSLIPHLPERPDQPECRYFMSTGSCKYGSDCKYHHPKERIAQLATNTLGPLGLPLRPGQAVCSHYNLYGLCKYGPTCKFDHPLTGYSSYNYCLSLPPLSILDPSLLPYQRNSSTVHSSETSPSKSSKFPDWVQKTESGSTKSQNPDTKAPEGPPEQAGSLLHSSPNSSEPPQDQSD

SEQ ID NO: 1703 - protein, 418 aa, Medicago sativa
  misc_feature: Public GI ID no. 186477892
  misc_feature (1)..(418): Bit score of 873.8 for HMM based on sequences of FIGURE 17.
  misc_feature (325)..(351): Pfam Name: zf-CCCH Pfam Description: Zinc finger C-x8-C-x5-C-x3-H type
  misc_feature (279)..(305): Pfam Name: zf-CCCH Pfam Description: Zinc finger C-x8-C-x5-C-x3-H type
  misc_feature (76)..(102): Pfam Name: zf-CCCH Pfam Description: Zinc finger C-x8-C-x5-C-x3-H type
  misc_feature (31)..(57): Pfam Name: zf-CCCH Pfam Description: Zinc finger C-x8-C-x5-C-x3-H type
  misc_feature (122)..(148): Pfam Name: zf-CCCH Pfam Description: Zinc finger C-x8-C-x5-C-x3-H type
  misc_feature: Functional Homolog Of SEQ ID NO. 1457
MEYDAIPQEAMWQMSLRPSETMESGPYPEHPGEPDCSYYIRTGLCRFGATCRFNHPPNRKLAIATARMKGEFPERLGQPECQYYLKTGTCKFGATCRFHHPKDKAGVAGRVALNILGYPLRPNESECAYYLRTGQCKFGNTCKFHHPQPSNMVLPMRGSPVYPTVQSPTTAGQQSYAAGITNWSTSSYIPSPRWQGPSSYAPLILPQGVVSVPGWSTYNGQMGSDSPQQTMRNDQTYGTSHQGDPENAGLPGVYSQYRSGSVPVGFYALQRENIFPERPDQPECQFYMKTGDCKFGAVCRFHHPRERTIPAPDCVLSPLGLPLRPGEPLCVFYSRYGICKFGPSCKFDHPMGIFTYNVSASPLAEAAGRRLLGSSSGTAALSLSSEGLVESGSVKPRRLSLSETRPNPSGDDDIDDEG

SEQ ID NO: 1704 - protein, 430 aa, Zea mays
  misc_feature: Public GI ID no. 194695656
  misc_feature (1)..(430): Bit score of 798.5 for HMM based on sequences of FIGURE 17.
  misc_feature (363)..(389): Pfam Name: zf-CCCH Pfam Description: Zinc finger C-x8-C-x5-C-x3-H type
  misc_feature (317)..(343): Pfam Name: zf-CCCH Pfam Description: Zinc finger C-x8-C-x5-C-x3-H type
  misc_feature (74)..(100): Pfam Name: zf-CCCH Pfam Description: Zinc finger C-x8-C-x5-C-x3-H type
  misc_feature (119)..(145): Pfam Name: zf-CCCH Pfam Description: Zinc finger C-x8-C-x5-C-x3-H type
  misc_feature (165)..(191): Pfam Name: zf-CCCH Pfam Description: Zinc finger C-x8-C-x5-C-x3-H type
  misc_feature: Functional Homolog Of SEQ ID NO. 1457
MDDAGRPPPHAPVAVTASASASATAAPAPPQPSATAAVDRSSPDPDALYEEGMWQQMAMDSGATMQPGSYPERPGEPDCTYYLRTGLCRFGMSCRFNHPPDRNLAIASARMKGEYPERAGQPECQYYLKTGTCKFGPTCKFHHPREKAGIAGRVQLNTSGYPLRPNEKECAYYLKTGHCKYANTCKFHHPELFNVVPSSRGSPIYTSVHSSASAGPQSYTGTMPSWAFPRASFIPSPRWQSPSNYAPMIVPQGLVQMPSWNSYTGQLQSPGAQQTYGSSQQGEASTGNQGMLSPYRSSSFPVPQYALQRENVFPERPDEPECQYYMKTGDCKFGAVCKFHHPRVRSLPPPDCVLSPMGLPLRPGEELCKFYSRYGICKFGANCKFDHPTVVAPMVYAYGFSASASPASASTNVPMARRLLGSPPGSGYTS

SEQ ID NO: 1705 - protein, 443 aa, Zea mays
  misc_feature: Public GI ID no. 194702984
  misc_feature (1)..(443): Bit score of 981.0 for HMM based on sequences of FIGURE 17.
  misc_feature (307)..(333): Pfam Name: zf-CCCH Pfam Description: Zinc finger C-x8-C-x5-C-x3-H type
  misc_feature (353)..(379): Pfam Name: zf-CCCH Pfam Description: Zinc finger C-x8-C-x5-C-x3-H type
  misc_feature (100)..(126): Pfam Name: zf-CCCH Pfam Description: Zinc finger C-x8-C-x5-C-x3-H type
  misc_feature (146)..(172): Pfam Name: zf-CCCH Pfam Description: Zinc finger C-x8-C-x5-C-x3-H type
  misc_feature (55)..(81): Pfam Name: zf-CCCH Pfam Description: Zinc finger C-x8-C-x5-C-x3-H type
  misc_feature: Functional Homolog Of SEQ ID NO. 1457
MAAPSGGGGGGAGEGSSSAAAAATIGVHGVDQVAEAMWQMNLEEAMELGPYPERVGEPDCSYYMRTGMCRFGMTCKFNHPADRKLAVAAARMKGEYPQRIGQPECQYYLKTGTCKFGATCKFHHPREKAAMATRVQLNELGYPLRPNEKECAYYLRTGQCKFGSTCKFHHSQPSTMMVAVRGSVYSPGQSATSPGQHAYQGAVTSWPLSRSASFIASPRWPGHSSYAQVIVPPGLVQVPGWSPYTAQIGSSSSEDQQRTPGAAQYYTGSRQSGTSIGDQGMFSSYQAGSVPVGLYAVQRENLFPERPDQPECQFYMKTGDCKFGAVCKFHHPRERIIPTPNCALSPLGLPLRPGEPICSFYNRYGMCKFGPNCKFDHPMGNAMYGQAPSPASEAPAPRRMLAHVPPSHPEASPDGGSGRSRRIAHSDSQQIPSGERSAEREAS

SEQ ID NO: 1706 - DNA, 842 bp, Gossypium hirsutum
  misc_feature: Ceres Clone ID no. 100057601
  misc_feature: Encodes the peptide sequence at SEQ ID NO. 1707
ctctctctggctttgagaaatctcaagttttcagcttcctttccttcaaaaacccaaaacccttgaagcgaaattttcaaaccccaaaatcccaaaatggggaagtacattaggaaggccaaaacggcagggggagttgccgtaatggatgtctcgcaggcttccctcggtgttcggacccgagccaaaaccctcgcacttcaacgccagaaatcgtcgacttctccggctacggttgcttcggctccggcttcaggagacggctcgtatctacagcttcggagtcgacggttagagaagccgccgcttgtggtgcaccaccatgattcgaagaggcacaagcagcagcaacagcaacaacaggggtgtaagaaggataactttggacagaatcctaaccctaactcgaattctagggttcgagtgggtagcgaaaagaaaaagaaaggtgaagttggaagccaagacactgtgcaagaagacaatggaaatgataatattattaactacagcaatcttaacaacgataataataatgaaagcaatgattttggtggtgttgaaacttcttttggagaaaatgttttggatattgaagctagagagaggggcactagggaatcaactccattcagcttgataagggacccagacagtataagaaccccgggttcaactactaggccaaccagatcagccgagactaaccaaagagtaaagaattcaacgcggcgacacatcccaacatcacatgaaatggatgagttctttactcttgcagaagtagaccagcaaagacaattcatcgagaagtacaactttgatccagtgaaagataagcc

SEQ ID NO: 1707 - protein, 248 aa, Gossypium hirsutum
  misc_feature: Ceres Clone ID no. 100057601
  misc_feature (1)..(248): Bit score of 376.2 for HMM based on sequences of FIGURE 2.
  misc_feature (211)..(248): Pfam Name: CDI Pfam Description: Cyclin-dependent kinase inhibitor
  misc_feature: Functional Homolog Of SEQ ID NO. 70
MGKYIRKAKTAGGVAVMDVSQASLGVRTRAKTLALQRQKSSTSPATVASAPASGDGSYLQLRSRRLEKPPLVVHHHDSKRHKQQQQQQQGCKKDNFGQNPNPNSNSRVRVGSEKKKKGEVGSQDTVQEDNGNDNIINYSNLNNDNNNESNDFGGVETSFGENVLDIEARERGTRESTPFSLIRDPDSIRTPGSTTRPTRSAETNQRVKNSTRRHIPTSHEMDEFFTLAEVDQQRQFIEKYNFDPVKDK

SEQ ID NO: 1708 - DNA, 686 bp, Zea mays
  misc_feature: Ceres Clone ID no. 100832874
  misc_feature: Encodes the peptide sequence at SEQ ID NO. 1709
ggctgacggcaccacaaggcaagcccgcccgctctcggctctcgctctgctcctgccccccttctctctctctctctctctctctctcggtctctccctctttcagcctgcagcgctagcgagccctcgccttcccttccccattattcccaggattccccttgcgactgcaccacgccccacccaaacccacctaccgcctccgctcccctctccagcgagtcgggggcacggacgggaccagacgaccaggccatggggaagtacatgcgcaagggcaaggtgtccggggaggtcgccgtcatggaggtacccggcggcgcgctgctcggcgtccgcacccgctcccgcacgctcgcgctgcagcgcgcgcagaggccgctcgacaagggcgacgcggaggacgccgccgcggagtacctcgagctcaggagccggaggctcgagaagccgcacaaggagcatccgtcgccgcccgcgaccgcgaccaagaggggcgccgggaggaaggccgccgccgccgccgcggtgcagcacgtgctgatgcaggacgaggtcgaggtcgaggtctcgttcggagacaacgtgcttgacttggacaccatggaaaggagtaccagagagacaacaccgtgcagcctgattaggaacccagagatgataagcaccccaggatccacaactaa

SEQ ID NO: 1709 - protein, 143 aa, Zea mays
  misc_feature: Ceres Clone ID no. 100832874
  misc_feature (1)..(143): Bit score of 167.7 for HMM based on sequences of FIGURE 2.
  misc_feature: Functional Homolog Of SEQ ID NO. 70
MGKYMRKGKVSGEVAVMEVPGGALLGVRTRSRTLALQRAQRPLDKGDAEDAAAEYLELRSRRLEKPHKEHPSPPATATKRGAGRKAAAAAAVQHVLMQDEVEVEVSFGDNVLDLDTMERSTRETTPCSLIRNPEMISTPGSTT

SEQ ID NO: 1710 - DNA, 733 bp, Zea mays
  misc_feature: Ceres Clone ID no. 100914999
  misc_feature: Encodes the peptide sequence at SEQ ID NO. 1711
cgcgcccgcccgcccggtctgctcctacgccctgcagagccctcgtcttcccctccccgttattcccgggattcccctgttgctgcgtgcgactgcgccccgccccacccacacccacctacctacctacctaccaccaacgcctcggctcccctctccagcgagccgcgaccgcgcggcaggggaagcttagcacggacgggaccagctgacgaccaggccatggggaagtacatgcgcaagggcaagatgtccggggaggtggccgtcatggaggtccccggcggcgcgctgctgggtgtccgcacccgctcccgcacgctcgcgctgcagagggcgcagaggccgctcgacaagggggacgcggatgacgccgccggacagtacctcgagctcaggagccggaggctcgagaagcctcataaggagcatcagccgctgccgccgccgccgcccgcccccgcagccaagaggggcgccgggaggaaggccgcctccgccgccgccgcgccgcacgcgctggcggaggacgaggtcgaggtcgaggtctccttcggggagaacgtgcttgacttggacgccatggaaaggagtaccagagagacaacaccgtgtagtttgatcaggaacccagagatgataagcaccccaggatccacaactaaaagtaaaaccagcaactcgacgacttctcgtcgcaggatggaaacctcagtctgccgtttcataccga

SEQ ID NO: 1711 - protein, 170 aa, Zea mays
  misc_feature: Ceres Clone ID no. 100914999
  misc_feature (1)..(170): Bit score of 232.8 for HMM based on sequences of FIGURE 2.
  misc_feature: Functional Homolog Of SEQ ID NO. 70
MGKYMRKGKMSGEVAVMEVPGGALLGVRTRSRTLALQRAQRPLDKGDADDAAGQYLELRSRRLEKPHKEHQPLPPPPPAPAAKRGAGRKAASAAAAPHALAEDEVEVEVSFGENVLDLDAMERSTRETTPCSLIRNPEMISTPGSTTKSKTSNSTTSRRRMETSVCRFIP

SEQ ID NO: 1712 - DNA, 1144 bp, Zea mays
  misc_feature: Ceres Clone ID no. 100965695
  misc_feature: Encodes the peptide sequence at SEQ ID NO. 1713
gtctctccctctttcagcctgcagcgctagcgagccctcgccttcccttccccattattcccaggattccccttgcgactgcaccacgccccacccaaacccacctaccgcctccgctcccctctccagcgagtcgggggcacggacgggaccagacgaccaggccatggggaagtacatgcgcaagggcaaggtgtccggggaggtcgccgtcatggaggtacccggcggcgcgctgctcggcgtccgcacccgctcccgcacgctcgcgctgcagcgcgcgcagaggccgctcgacaagggcgacgcggaggacgccgccgcggagtacctcgagctcaggagccggaggctcgagaagccgcacaaggagcatccgtcgccgcccgcgaccgcgaccaagaggggcgccgggaggaaggccgccgccgccgccgcggtgcagcacgtgctgatgcaggacgaggtcgaggtcgaggtctcgttcggggacaacgtgcttgacttggacaccatggaaaggagtaccagagagacaacaccgtgcagcctgattaggaacccagagatgataagcaccccaggatccacaactaaaagcaaaaccagcagcaactcgacgacttcccgccgcagaacggaggaaaccccgagctgccggttcataccgagctcgctcgagatggaggagttyttytcggcggccgagcaacaggagcagcatagcttcagggagaagtacaacttctgtcccgtgaacgactgtcctctccctggccggtacgaatgggcgaggctagactgctagattccccccccagcccaagagccccattgatttgattgatatgtgtctccccccccccaatgtgactagctccccccccgcccccgtggcccgtggaggaggcgcaaccaactgtggatctcgatcgcattagctttgttgtctgttgtaaaaattagagtagttagctttgtagccggaggaatgatcttgtgtaaccaccaggcggggttcacccctggtcacccaacctccctgtaacctgttaactgctcaagctgctgtaaccgaaccaatctcatgtagcgtaggcctagcgcagtcttctcatctgttcgtagctctcgaaattgattg

SEQ ID NO: 1713 - protein, 213 aa, Zea mays
  misc_feature: Ceres Clone ID no. 100965695
  misc_feature (1)..(213): Bit score of 425.0 for HMM based on sequences of FIGURE 2.
  misc_feature (163)..(212): Pfam Name: CDI Pfam Description: Cyclin-dependent kinase inhibitor
  misc_feature: Functional Homolog Of SEQ ID NO. 70
  misc_feature (176)..(176): Xaa is any aa, unknown, or other
  misc_feature (177)..(177): Xaa is any aa, unknown, or other
MGKYMRKGKVSGEVAVMEVPGGALLGVRTRSRTLALQRAQRPLDKGDAEDAAAEYLELRSRRLEKPHKEHPSPPATATKRGAGRKAAAAAAVQHVLMQDEVEVEVSFGDNVLDLDTMERSTRETTPCSLIRNPEMISTPGSTTKSKTSSNSTTSRRRTEETPSCRFIPSSLEMEEXXSAAEQQEQHSFREKYNFCPVNDCPLPGRYEWARLDC

SEQ ID NO: 1714 - DNA, 1238 bp, Glycine max
  misc_feature: Ceres Clone ID no. 1644686
  misc_feature: Encodes the peptide sequence at SEQ ID NO. 1715
attttcctttctctctcactcgaaacaaaacaaaacaacacaaccggaaaaccaaaccacctctccctgctcccgccgctgttttccgccgctgtcgccgtcgttcccgcctcaccgtggcggcgcgcgcgtctccgatgggaaagtacatgaagaaagcgaagccgaaaggagaactcgcgctcgtcgaatccaccaccagcaacaccaccacctcctacatgggggtccgaacccgcgccaaaaccctagcgcttcagaaatcgcacgcgcagcagcacgagctcgccgccacctccgactcctacctccagctccggagccgtcgcctccagaagcctccgattttggtccactctccgaagcgccctaagcacccgaaccctaaatccccaatccccgaacctcccaggctcggactcgcttcggagcgcgacgctaccctcaaccacaacaaggacaatactttgcatgagaatgccgagcctcaggaagcgtcgttcggggaaaatgttttggattttgaaggtagagagagaagcactagggaatccacaccttgcagtttgataagggactcggatactgtcaggactccgggttcaactaccaggcctacttgttcagctgaagcttatcgaagaacagagcatgcagctagaaggcaaatcccaacctcccgtgaaatggatgaattctttgctgaaattgaagaggctcagcaaaaaaaattcattgagaagtacaactttgatcctgtgaatgagaagccgctctcagggcgctatgaatgggaaaagttgaaaccctagaagggtaatgtagtgttccatcaagacatctttgaagtagcaggcaggcagcagggttagaatttgttgaagcggtggtggcgttatttcacttttccatcaccttctatttacttgtaaagaaagtaggactcttaaaactgtgtagactaatggtctgtaactttacagaggttgttgattacacaacaatacaaatcaaaggcctttgtctaacagatcattttaaggaagggggcaagggaagaaggggctgtagcgcgtaggattagggatcagtcaaattaggtcagtatgaggtacaggaatttacctaggttttctcttgttcttgtattttactcatcttttgtctatacttgtactgatggaacttgaacaaacttttagaaataaagacccgattcccccacctaaatttctgtc

SEQ ID NO: 1715 - protein, 220 aa, Glycine max
  misc_feature: Ceres Clone ID no. 1644686
  misc_feature (1)..(220): Bit score of 303.8 for HMM based on sequences of FIGURE 2.
  misc_feature (172)..(219): Pfam Name: CDI Pfam Description: Cyclin-dependent kinase inhibitor
  misc_feature: Functional Homolog Of SEQ ID NO. 70
MKKAKPKGELALVESTTSNTTTSYMGVRTRAKTLALQKSHAQQHELAATSDSYLQLRSRRLQKPPILVHSPKRPKHPNPKSPIPEPPRLGLASERDATLNHNKDNTLHENAEPQEASFGENVLDFEGRERSTRESTPCSLIRDSDTVRTPGSTTRPTCSAEAYRRTEHAARRQIPTSREMDEFFAEIEEAQQKKFIEKYNFDPVNEKPLSGRYEWEKLKP

SEQ ID NO: 1716 - DNA, 1091 bp, Miscanthus x giganteus
  misc_feature: Ceres Clone ID no. 2055661
  misc_feature: Encodes the peptide sequence at SEQ ID NO. 1717
gagcctccctccagatagccacacccacccctccctctcctctcctcctcgttattcccgggcttcctcctgtgtacaccgctcccgccccgcctaccatctaatccccgcctcccctggcctctgccgcgccgccgcacagaatcgcttggtgcacccggcgagggtgggcctccttgaaaccctagcttacccagccccgccgggccatgggcaagtacatgcgcaaggtcaaggtttccggcgaggtagccatcatggatgtgtcctccgctccgctcggagtccgcacccgcgcgcgcgccctcgcgctgcagcgcctgcagaagcagcaggcgcagggggaggagggagccggcggcgagtacctggagctaaggagccggaggctcgagaaactgccgccgccggcggcgcccatgaggaggaagacggcggccgcggccgccgctgctaaggaggaggtggaggcgtcgtacggggagaacatgctcgagttggaggccatggagaggaataccagggagatgacgccctgcagcttgattaactctgagatgattggcactcccaggactcccggatccacaacaagatctagtcactcttcccaccgcagggtgaaagctcctccggtgcaggccgtcccaagttcaagggagatgaatgagtacttcgctgctgaacagcgacgccaacaacaggctttcattgacaagtacaactttgatcctgtaaatgactgccctctcccaggcaggttcgaatgggtgaagctagactgattgattcggaggacaagagagcagcagcatggaactcacctccgctccctccaccaccgcagtgtcgtggcagaggcgcataccgttgtgttagctttgtttctgttgtaaaaacttagtgttagcctgtagccttaattgtcgtgtgttacagtacagaactgatgctgagttacaacaccctgatctgatctgatccctcaactccaatgtaacccttaacagctcattctgtaaggaacctatcaccctgttaccagttgctgaattaatggagcagagctagataatgaaatgttttatcat

SEQ ID NO: 1717 - protein, 191 aa, Miscanthus x giganteus
  misc_feature: Ceres Clone ID no. 2055661
  misc_feature (1)..(191): Bit score of 329.1 for HMM based on sequences of FIGURE 2.
  misc_feature (144)..(191): Pfam Name: CDI Pfam Description: Cyclin-dependent kinase inhibitor
  misc_feature: Functional Homolog Of SEQ ID NO. 70
MGKYMRKVKVSGEVAIMDVSSAPLGVRTRARALALQRLQKQQAQGEEGAGGEYLELRSRRLEKLPPPAAPMRRKTAAAAAAAKEEVEASYGENMLELEAMERNTREMTPCSLINSEMIGTPRTPGSTTRSSHSSHRRVKAPPVQAVPSSREMNEYFAAEQRRQQQAFIDKYNFDPVNDCPLPGRFEWVKLD

SEQ ID NO: 1718 - DNA, 1049 bp, Zea mays
  misc_feature: Ceres Clone ID no. 311199
  misc_feature: Encodes the peptide sequence at SEQ ID NO. 1719
gaccgcgcggcaggggaagcttagcacggacgggaccagctgacgaccaggccatggggaagtacatgcgcaagggcaagatgtccggggaggtggccgtcatggaggtccccggcggcgcgctgctgggtgtccgcacccgctcccgcacgctcgcgctgcagagggcgcagaggccgctcgacaagggggacgcggatgacgccgccggacagtacctcgagctcaggagccggaggctcgagaagcctcataaggaccatcagccgctgccgctgccgccgcccgcccccgcagccaagaggggcgccgggaggaaggccgcctccgccgccgccgcgccgcacgcgctggcggaggacgaggtcgaggtcgaggtctccttcggggagaacgtgcttgacttggacgccatggaaaggagtaccagagagacaacaccgtgcagtttgatcaggaacccagagatgataagcaccccaggatccacaactaaaagtaaaaccagcaactcaacgacttcccgtcgcaggatggaaacctcagtctgccgtttcataccgagttcgcttgagatggaagagttcttctcggccgctgaacaacaggagcagcataacttcagggagaagtataacttctgtcctgtgaacgactgccctctcccgggtcgatatgagtgggcgaggctagactgttagattcctccaagcacaagagcaccatttatctgatgtgtctaccacatgaccagcgccgccgacgccgccgaggaggcgtaatcaactggatcgcattagctttcttgcctgttgtaaaaattagagtagttagcctgtagttgaatggtcctgtgtaacgaaacaggcgcggttctgagttacattacaccccgatccccaacctcactgcgacccgcttgactgctcaagctgtagctgaaccatccatctcaagtagcgtaggcctagcgtattcatctgttcctagttctagttcttggattgaatgaattaatcgaatgagatcattgttagaatctgcatgcc

SEQ ID NO: 1719 - protein, 215 aa, Zea mays
  misc_feature: Ceres Clone ID no. 311199
  misc_feature (1)..(215): Bit score of 444.1 for HMM based on sequences of FIGURE 2.
  misc_feature (165)..(214): Pfam Name: CDI Pfam Description: Cyclin-dependent kinase inhibitor
  misc_feature: Functional Homolog Of SEQ ID NO. 70
MGKYMRKGKMSGEVAVMEVPGGALLGVRTRSRTLALQRAQRPLDKGDADDAAGQYLELRSRRLEKPHKDHQPLPLPPPAPAAKRGAGRKAASAAAAPHALAEDEVEVEVSFGENVLDLDAMERSTRETTPCSLIRNPEMISTPGSTTKSKTSNSTTSRRRMETSVCRFIPSSLEMEEFFSAAEQQEQHNFREKYNFCPVNDCPLPGRYEWARLDC

SEQ ID NO: 1720 - protein, 263 aa, Vitis vinifera
  misc_feature: Public GI ID no. 157352474
  misc_feature (1)..(263): Bit score of 358.6 for HMM based on sequences of FIGURE 2.
  misc_feature (213)..(262): Pfam Name: CDI Pfam Description: Cyclin-dependent kinase inhibitor
  misc_feature: Functional Homolog Of SEQ ID NO. 70
MGKYMRKAKARGEVAVMEVSQPCLGVRTRAKTLALERLQKSRPRPSPPQSPPQQQASSSSYLQLRSRRLLKPPILVSNSKKHKQNLKEVDVENPNPKVKARASSRLRVGSVRCGSVGSVSLGCLSGEDGVQSPAVDLLKLGKEEQILEDNNANDLGIEASFGENVLDFEARDRSTRETTPCSLIRDPETIRTPGSTTKPASSSGINRRMDNSRQGHVPTTQEMDQFFQSAEEEQQRVFTDKYNFDPVNDKPLSGRFEWVKLNR

SEQ ID NO: 1721 - protein, 218 aa, Vitis vinifera
  misc_feature: Public GI ID no. 157353587
  misc_feature (1)..(218): Bit score of 353.4 for HMM based on sequences of FIGURE 2.
  misc_feature (170)..(217): Pfam Name: CDI Pfam Description: Cyclin-dependent kinase inhibitor
  misc_feature: Functional Homolog Of SEQ ID NO. 70
MGKYMKKAKITGDVTVMEVSSSLGVRTRAKTLALQRLQKTTHQEGPKPDTSYLELRSRRLEKPPLLSEPNKKQNPNPKASSRVELGSVNSNSVGSVPPGEKINAVETEDVGVEASYGENVLEFEGRDRSTRESTPCSLIRDPDTIATPGSTTRPSSSSVTTRRVRSNVLGDIPTAAELEEFFTHAEEHAQKEFMDKYNFDIVNDTPLPGRFEWVQVSP

SEQ ID NO: 1722 - protein, 190 aa, Zea mays
  misc_feature: Public GI ID no. 194689190
  misc_feature (1)..(190): Bit score of 294.4 for HMM based on sequences of FIGURE 2.
  misc_feature (142)..(190): Pfam Name: CDI Pfam Description: Cyclin-dependent kinase inhibitor
  misc_feature: Functional Homolog Of SEQ ID NO. 70
MGKYMRKAKASSEVVIMDVAAAPLGVRTRARALALQRLQEQQTQWEEGAGGEYLELRNRRLEKLPPPPATTRRSGGRKAAAEAAATKEAEASYGENMLELEAMERITRETTPCSLINTQMTSTPGSTRSGHSCHRRVNAPPVHAVPSSREMNEYFAAEQRRQQQDFIDKYNFDPANDCPLPGRFEWVKLD

SEQ ID NO: 1723 - protein, 215 aa, Zea mays
  misc_feature: Public GI ID no. 194694280
  misc_feature (1)..(215): Bit score of 447.5 for HMM based on sequences of FIGURE 2.
  misc_feature (165)..(214): Pfam Name: CDI Pfam Description: Cyclin-dependent kinase inhibitor
  misc_feature: Functional Homolog Of SEQ ID NO. 70
MGKYMRKGKMSGEVAVMEVPGGALLGVRTRSRTLALQRAQRPLDKGDADDAAGQYLELRSRRLEKPHKEHQPLPPPPPAPAAKRGAGRKAASAAAAPHALAEDEVEVEVSFGENVLDLDAMERSTRETTPCSLIRNPEMISTPGSTTKSKTSNSTTSRRRMETSVCRFIPSSLEMEEFFSAAEQQEQHNFREKYNFCPVNDCPLPGRYEWARLDC

SEQ ID NO: 1724 - DNA, 1180 bp, Zea mays
  misc_feature: Ceres Clone ID no. 1420460
  misc_feature: Encodes the peptide sequence at SEQ ID NO. 1725
gccacattttacatcccaccaccagcctccttcccctttccgttccccgaagcgagagcgaagccagcgcccatcttcttcttcctcctccttgttgttggatcgcagctccttcgtcgtagcgtccgatacgccaggtttcctttcgcgagcaacaatctttggcaatggcgtccacgtcgagctcgacgccagcgccggttgaggtggacgagaggggccggaagcggaagcgtgcggccggggcggaccccgcggcgccggcgcagccgtccaagtggcggacgcggcgcgagcacgagatctactcgtccaagctcctggaggcgatccgcctcgtgcgcgcggggcccccctccgccgccgccgccggcacggcggcggccccgccgcgcagcagggccgtgcgcgaggcggccgaccgcgcgctcgccgtcgcggcgcgcgggcgcacgcactggagccgcgccatcctcgcgtcccgccgccgccgcctccaggccgcgcaccgcgcgcgcctccgcgcccccgcgtccccgcccgcgcgacacggtgccccctcggcctcggcggcgaagggcgccgccacgccgcctctggagaggaaggccaaggtgctgggccggctggtgcccggctgccggaagctgtcgttcccgacactgctcgccgagaccacggactacatcgcggcgctccagatgcaggtccgcgccatgacggccctcgccgaggcgctgtccgccgtctccgccacctcctcctccggcgccggctcctcctcgccgccgtgatcgaagccgaagcctcaacattcgtgcattcgttgtaaatttttccctctcttttctccccccacgaatttttcctcgggattagttaacctctagctttctctctctctcccctctagttttccttgtcgtcttgtttctcccagttcggtgagtggttagtgtgacgatgaagaagaagatgatgatggcgtcccagtgattaacccgtgcggtaatgtgatagaagaagtcgtaggctgtctccgctcctcccttcctccctagctcaggattcttttgtagcttgggtttattctcatctgcttcgatcgctcttcgatgaatgcatcttgaaatgttcattcagatcacaccatcatgtatgatgtatctttcatgtgctt

SEQ ID NO: 1725 - protein, 208 aa, Zea mays
  misc_feature: Ceres Clone ID no. 1420460
  misc_feature (1)..(208): Bit score of 363.4 for HMM based on sequences of FIGURE 1.
  misc_feature: Functional Homolog Of SEQ ID NO. 3
MASTSSSTPAPVEVDERGRKRKRAAGADPAAPAQPSKWRTRREHEIYSSKLLEAIRLVRAGPPSAAAAGTAAAPPRSRAVREAADRALAVAARGRTHWSRAILASRRRRLQAAHRARLRAPASPPARHGAPSASAAKGAATPPLERKAKVLGRLVPGCRKLSFPTLLAETTDYIAALQMQVRAMTALAEALSAVSATSSSGAGSSSPP

SEQ ID NO: 1726 - DNA, 1052 bp, Panicum virgatum
  misc_feature: Ceres Clone ID no. 1815696
  misc_feature: Encodes the peptide sequence at SEQ ID NO. 1727
accatcctcttccctttcccccacgccccaaaatccccttctgcgtctcagctcttcgggaaggaacaggaataaccggataaggcccagggcgggcgcgggcgcggctatgatctcctcttcgacttcgccgccgtcgtcctcgtctgccgcggcagcaagccgctccggtggcaataagccgccaccgcagcagcaggccagcaagtggcgcagcggcacgcagcagaagatctacgggcgccgcctgctagacgcgctccgcgccacgggcggcggccagccgcgcgccgtcaaggccgcggccgactcggcgctggcgctcacggcgcgcggccagacgcgctggagtcgcgcaatcctgctggccggcgccgcctgcagccgccgccgcgtgcttgtgaaggcgggcggcaagatccggcggcgccaccgccggccgcagcatgccaagagcaaagctgccgcttttgcaggggcggcggccgattcgaaggagggcggcaaggtgcaggagcggctccgtgtgctgggccgcctcgtcccgggatgccggaagctcccggcgccagagctgctcgaggaggcggtcgactacgtggcggcgctgcagatgcaggtcaacaccatgcgcgcgctcgccgacgcgctggcggccgcgcagctctccgacgcggagaggtgaggaggattgattggcctggcagcctggcaatggccccatgacatgattgattgatcaccagccgacctgcagccagctgatcgggattggggaggagggcgattgcattactctatggtaatcattgcgttccgttgctttgattgggaacgaacgattaaatgatggtgggattgtcatgaactaatgatccatgcatatgctcatggtttgtaaattcctttccttgcttgttgacacttctcttgttactgatgggtggatgatccagctaccggagacttctttgtgcaagtgaatgctgttcatcgtcttgtattgtttccgctctgctcttttttttttgaaaagcatttccgctctgctc

SEQ ID NO: 1727 - protein, 191 aa, Panicum virgatum
  misc_feature: Ceres Clone ID no. 1815696
  misc_feature (1)..(191): Bit score of 223.9 for HMM based on sequences of FIGURE 1.
  misc_feature: Functional Homolog Of SEQ ID NO. 3
MISSSTSPPSSSSAAAASRSGGNKPPPQQQASKWRSGTQQKIYGRRLLDALRATGGGQPRAVKAAADSALALTARGQTRWSRAILLAGAACSRRRVLVKAGGKIRRRHRRPQHAKSKAAAFAGAAADSKEGGKVQERLRVLGRLVPGCRKLPAPELLEEAVDYVAALQMQVNTMRALADALAAAQLSDAER

SEQ ID NO: 1728 - DNA, 812 bp, Gossypium hirsutum
  misc_feature: Ceres Clone ID no. 1899064
  misc_feature: Encodes the peptide sequence at SEQ ID NO. 1729
cttttcttccatctccatctccatctccatctcctttctgcaattattcccaactttccatggcttccttcacgcccaatctcgaacctgcccctgacacctctcttcagttcaagcccaagaaacccaggataacccttcaaaccccttcctcttgtccttccaatcaacgcacccaaagaattaagcgatggcggacccaacgagaccaacacatctactcctccaagctcttccaggctctccgtcgttctcgtcgtacctccgcctccagggaagtccacgaaacggctgacagggttctcgccggcttggccaggggcaccacgcgttggagcagagccattctcaccgctcgcaaggtgaccaaacataagaaagccaagctccctactaataacaggttgaggaagcccgatatttacagagagaggaggaaaacgccggctgttgagcggaagttgaaggttttgggacgtctcgtccccggttgccggaaactatccttctccaaccttatagaagaaactagcgattacatagcggccctagagatgcaagttcgagccatgacggctattaccgagtttctctgcggcggaactggcggtggaccgcagccgccggctgatcgccttccctctaatgtcaactcttgaaaaggtgtttattattaataattattttttttggaaactgtttatcagtgagatttttaagttgctgtattttattgtgtatacatgactttttctttctttttgagctccacttttgtttattttattttatttatttattttcggtttgtc

SEQ ID NO: 1729 - protein, 199 aa, Gossypium hirsutum
  misc_feature: Ceres Clone ID no. 1899064
  misc_feature (1)..(199): Bit score of 407.1 for HMM based on sequences of FIGURE 1.
  misc_feature: Functional Homolog Of SEQ ID NO. 3
MASFTPNLEPAPDTSLQFKPKKPRITLQTPSSCPSNQRTQRIKRWRTQRDQHIYSSKLFQALRRSRRTSASREVHETADRVLAGLARGTTRWSRAILTARKVTKHKKAKLPTNNRLRKPDIYRERRKTPAVERKLKVLGRLVPGCRKLSFSNLIEETSDYIAALEMQVRAMTAITEFLCGGTGGGPQPPADRLPSNVNS

SEQ ID NO: 1730 - protein, 219 aa, Vitis vinifera
  misc_feature: Public GI ID no. 157353042
  misc_feature (1)..(219): Bit score of 350.7 for HMM based on sequences of FIGURE 1.
  misc_feature: Functional Homolog Of SEQ ID NO. 3
MASSVISNPVTNSDRSRESSKRKKKKKNQIQSQVRDQQNQNHTKWKSQVQQQLYSSKLLQALRQVRLGSSNETPRRGRAVREAADRALAVAAKGRTRWSRAILTNRLKLKFMKHKRQRVTVTGQNRSKKPKVSILRLKGKNLPAVQRKVRVLGRLVPGCRKLPLPDILEEATDYIAALEMQVRAMTALTELLSGAGAGASTTSSNSPADTLGSSRPPTS

SEQ ID NO: 1731 - DNA, 2100 bp, Sorghum bicolor
  misc_feature: Ceres Annot ID no. 8679828
  misc_feature: Encodes the peptide sequence at SEQ ID NO. 1732
atgtcagcatcgcagtcctcgatgagcggcgccgccggggagccggggatgcggacggtggtctggttcaggcgagacctgcgcgtggaggacaacccggcgctggcggcagccgctcggacggccggagaggtcgtgccggcgtacgtgtgggcgcccgaggaggacgggccctactaccccggcagggtgtcccggtggtggctcagccaaagcctcaagcacctggacgcctcgctccgccggctcggcgccggccgcctcgtcacccgccgctccaacgacgctgtcgtcgcgctgctcgacctcgtccgcagcaccggcgccacccacctctttttcaaccacctctacgacccgctgtcgctggtccgggaccaccgcgtgaaggagcagctgacggccgagggcatcactgtgcagtccttcaacgcggatctgctgtacgagccgtgggaggtcctcgacgacgacggctgccccttcaccatgttcgcgccattctggaacaggtgcctgtgcatgccggaccccgccgcaccactgctgccgcccaagaggatcaattcaggtgacctgtcgaggtgtccgtgggacgagctgatctttgaagacgagtccgagaggggcagcaacgcgctgcttgcgcgggcgtggtcaccagggtggcagaatgctgacaaggcactgacggccttcctcaatggtccgctgatggactactccgtgaaccgcaagaaggccgacagtgccagcacgtccctgttgtctccgtacctgcacttcggcgagctcagcgtccgcaaggtcttccaccaggtccggatgaagcagctgatgtggagcaacgacggtaaccacgctggcgaggagagctgcaccctgttcctgcgctccatcggcctgcgggagtactcgaggtacctcaccttcaaccacccctgcagccacgagaagccccttctgtcgcacctcaggttcttcccctgggtcgtcaatgaggtgtacttcaaggtttggagacaagggaggactggctaccctctcgtcgacgctggcatgagggagctctgggccaccgggtgggtccatgaccggatacgtgtcgtcgtctctagcttctttgtcaaggtactccagctgccatggcgctgggggatgaagtacttctgggacaccttgctggatgctgaccttgagagtgatgcactaggctggcagtacatttctgggtctctccctgatggccgtgagcttgaccgcatcgacaaccctcagtttgaagggtacaagtttgatccgcacggggagtacgtacggcgatggctaccggagttggcgaggctgccaacagaatggatacaccacccctgggatgcacctgagtctgtgcttcaggctgcaggagttgagctaggctccaactatccacgccccattgttgagttagatgctgccaattccaggttgcaggatgccctgtcagagatgtgggagcttgaggcagcctctcgtgctgcgatggagaatggaatggaagaaggccttggcgattccacagatgagccgctgatcgacttccctcaggaattacggatggaagtggaccgacaaccggctcaacctgctatccacacaccggcagtggctggtcggagacgagaagatcagatggtgcctagcatgacttcctcattcattagagctgaaaccgaactcactgcagattttggcaacaccagtgaggacagtaggccagaagtcccgtcaaacattcatttgcaggctcgggcggagagggaagaaacagttgacggtggcactggcaatactgtcaggatgaatggcaaccatcagcagcagaatcttcagaacaacatgcaccgtgtgctaggtattgctccatcagtttcagaggcatcgagcagctggacgggcagggaaggtggagtggtaccggtctggtcacctccggcagcttcgggacattctgatccttatgctgccgatgaggctgacatttccagtaggagttatttggacaggcatccacaatcacatacgatgatgaactggagtcaactctctcagtcattgtga

SEQ ID NO: 1732 - protein, 699 aa, Sorghum bicolor
  misc_feature: Ceres Annot ID no. 8679828
  misc_feature (1)..(699): Bit score of 1643.4 for HMM based on sequences of FIGURE 18.
  misc_feature (220)..(498): Pfam Name: FAD_binding_7 Pfam Description: FAD binding domain of DNA photolyase
  misc_feature (17)..(189): Pfam Name: DNA_photolyase Pfam Description: DNA photolyase
  misc_feature: Functional Homolog Of SEQ ID NO. 1497
MSASQSSMSGAAGEPGMRTVVWFRRDLRVEDNPALAAAARTAGEVVPAYVWAPEEDGPYYPGRVSRWWLSQSLKHLDASLRRLGAGRLVTRRSNDAVVALLDLVRSTGATHLFFNHLYDPLSLVRDHRVKEQLTAEGITVQSFNADLLYEPWEVLDDDGCPFTMFAPFWNRCLCMPDPAAPLLPPKRINSGDLSRCPWDELIFEDESERGSNALLARAWSPGWQNADKALTAFLNGPLMDYSVNRKKADSASTSLLSPYLHFGELSVRKVFHQVRMKQLMWSNDGNHAGEESCTLFLRSIGLREYSRYLTFNHPCSHEKPLLSHLRFFPWVVNEVYFKVWRQGRTGYPLVDAGMRELWATGWVHDRIRVVVSSFFVKVLQLPWRWGMKYFWDTLLDADLESDALGWQYISGSLPDGRELDRIDNPQFEGYKFDPHGEYVRRWLPELARLPTEWIHHPWDAPESVLQAAGVELGSNYPRPIVELDAANSRLQDALSEMWELEAASRAAMENGMEEGLGDSTDEPLIDFPQELRMEVDRQPAQPAIHTPAVAGRRREDQMVPSMTSSFIRAETELTADFGNTSEDSRPEVPSNIHLQARAEREETVDGGTGNTVRMNGNHQQQNLQNNMHRVLGIAPSVSEASSSWTGREGGVVPVWSPPAASGHSDPYAADEADISSRSYLDRHPQSHTMMNWSQLSQSL

SEQ ID NO: 1733 - DNA, 2058 bp, Sorghum bicolor
  misc_feature: Ceres Annot ID no. 8738520
  misc_feature: Encodes the peptide sequence at SEQ ID NO. 1734
atggctgggtcggggaagactgttgtttggttcaggagagacctcaggatccacgataacccggccttggcagctgcggcgaaagagggctctgtcctccctctcttcatatggtgtcctgctgactacgagcagtattaccctggaaggtgctcccggtggtggctcaagcagtcccttgcccaccttgggaagtcactagagttgctcgggtgcccactcgtgctgatccgtgcggaggacagcactcttgcaactcttttggagtgcgtccattgcatcagtgccactagagtcgtttataatcgtctctacgaccctatttcacttgtgcttgacgacaaaatcaagaatgagctttcagcccatggcatatctgtccaaagtttcaatggtgatctactttacgagccgtgggatgtttatgatgagaatgggcaggcatttacatcctttaacaagtactgggagaaatgcatgaatgttcctattgagatatcacaatatcttgcacctacgaggctggtggcagcgccaggtctagcgaatgttcgctgttgttcaattgatgatctaggtcttgaatctagtaaggatgtggaatcaagcaatgctttgctaagcagggcctggtctcctggctggcgcaatgcagagaatatgcttgaggaatttttgtcatgtggtctcctagaatattcaaaacacggtatgaaggttgggggaactacaacgtcattattgtcaccatatctccatttcggggagttgagtgtaaggaaggtttatcaacttgttacaatgcatcatgtcaagtggcaaaatgaaggaaaatctgaagctgaggagagtgttcgattgttcctaagatcaattggttttcgggaatattcacggtacttatgttttaacttcccattcacgcacgagagatcatttctgggtaacttgaagcattatccctggctattggatgaggaccgtttcaaatcttggagacagggaatgactggatacccattagtagatgctggcatgagagaactctgggctactggttggacacataatcggataagagtgattgtttcaagtttcgctgtaaaatgtctacagataccctggatttggggaatgaagtacttttgggatgtgcttctggatgcagacctagaaagtgatattcttggttggcagtatatatctgggagtttgcctgatggacatgagctcagccgtcttgataatccagaggttcagggtcaaaagtacgatccagatggtgaatatgtaagaacttggattcctgaacttgctagaatgccaacagaatggatccattgtccatggagtgctcctaactctatattacaagttgctggagttgagttgggctttaactaccctaagcccatagtagaacttcatatggcgcgggaatgcttagatgacgccatctccacaatgtggcaactggacacagctgcaaaacttgctgcactagatggtgaagttgtggacgacaatctgaataatatcaggagttttgatatcccaaaggttgttttgaagaagaaattatctccaagcacttcatcgatgaacaaaagggtgctgtctactaatggcaagaacgaaaagtcacagcctactgaagtgaaggccccgtacaaacagattattcgagatgatatgatcaatgcctcaaacatggatgacaccggctctactgctaacttgcaagtgacaaggaaaagatctcgcagtgatagtgctttcaatgttccgtcatcttcatcctcactagtcatggaatcacggattcatgataatgacagttgttctgttcggtattcaggctacctccagcagacagcagacagggatgacactgataagttttccaaaaggttgaagataacgacagtgaagatagtggtacgagcatctctaggccatccaagagacctgcttagcactagcgcattgaagatgttgcaaatctctgatgggaactatttgccgtcacatgtaattttttgggtgcttttttattga

SEQ ID NO: 1734 - protein, 685 aa, Sorghum bicolor
  misc_feature: Ceres Annot ID no. 8738520
  misc_feature (1)..(685): Bit score of 800.4 for HMM based on sequences of FIGURE 18.
  misc_feature (212)..(490): Pfam Name: FAD_binding_7 Pfam Description: FAD binding domain of DNA photolyase
  misc_feature (5)..(176): Pfam Name: DNA_photolyase Pfam Description: DNA photolyase
  misc_feature: Functional Homolog Of SEQ ID NO. 1497
MAGSGKTVVWFRRDLRIHDNPALAAAAKEGSVLPLFIWCPADYEQYYPGRCSRWWLKQSLAHLGKSLELLGCPLVLIRAEDSTLATLLECVHCISATRVVYNRLYDPISLVLDDKIKNELSAHGISVQSFNGDLLYEPWDVYDENGQAFTSFNKYWEKCMNVPIEISQYLAPTRLVAAPGLANVRCCSIDDLGLESSKDVESSNALLSRAWSPGWRNAENMLEEFLSCGLLEYSKHGMKVGGTTTSLLSPYLHFGELSVRKVYQLVTMHHVKWQNEGKSEAEESVRLFLRSIGFREYSRYLCFNFPFTHERSFLGNLKHYPWLLDEDRFKSWRQGMTGYPLVDAGMRELWATGWTHNRIRVIVSSFAVKCLQIPWIWGMKYFWDVLLDADLESDILGWQYISGSLPDGHELSRLDNPEVQGQKYDPDGEYVRTWIPELARMPTEWIHCPWSAPNSILQVAGVELGFNYPKPIVELHMARECLDDAISTMWQLDTAAKLAALDGEVVDDNLNNIRSFDIPKVVLKKKLSPSTSSMNKRVLSTNGKNEKSQPTEVKAPYKQIIRDDMINASNMDDTGSTANLQVTRKRSRSDSAFNVPSSSSSLVMESRIHDNDSCSVRYSGYLQQTADRDDTDKFSKRLKITTVKIVVRASLGHPRDLLSTSALKMLQISDGNYLPSHVIFWVLFY

SEQ ID NO: 1735 - DNA, 2207 bp, Brassica napus
  misc_feature: Ceres Clone ID no. 1093780
  misc_feature: Encodes the peptide sequence at SEQ ID NO. 1736
aagagttcctagattgttcttgattatactttcctggttaggccaaggcttgtttcttatttagtagattttcatcttttgttttctgacagcttcgttgaatcattctctgttagctatatgtatgagcttgtggtctgaaaattaaatcatggcagaatctggacagagagtgaagctttagctgatttggtctccatctcggatcataaactatggcgacgaacagaaagactatagtgtggttcagaagagacttaaggatcgaggataaccctgcactagcagcagctgctcgcgaaggatcagtcttccctgttttcatttggtgccctgaagaagaaggtcagtttcatccaggaagggcttcaagatggtggatgaaacagtctcttgctcacttgaaccaatccttgaagtctcttggctcccacctcacgtttatcaaaacacatagcacggtttccgctatcttggactgtgtccgcgccactggtgccacaaaagtcgtcttcaaccacctctatgatcctgtttcgctagttagagaccataacgtaaaggagaaacttatggaacgtgggatctctgtgcaaggctacaacggtgatctattgtatgagccttgggagataaactccgaaaatggcaaaccttttacgagttttgctccttactggaagaaatgcttagacatgtcggttgaatccgttatgcttcctcctccttggcgtttgatgcctctaactgcagcagctgaaggggtgtgggcatgttcaatagaagaactagggctagaagacgaggcagagaagccaagcaatgcgctcttaactagagcttggtcaccaggctggagcaacgctgataagacactaaccgagttcatcgagaaacagttgatagactacgcaaagaacagcaagaaagtagttgggaactcaacctcgatgctctctccctatctccacttcggggaaataagcgtcagacgtgttttccagtgcgtccgtatgaaaaaaatcatatgggcaagagacaaaaacactgaaggagaagagagcgctgatcttttccttagagggattggtcaaagagagtattctcggtatatatgtttcaacttcccttttactcacgagcagtccttgttgagtcatcttcgtttcttcccttgggacgctgacgttggcaagttcaaggcgtggagtcaaggcaggactgggtatccgttggtggatgctgggatgagggagctttgggctactggatggatgcataacaggataagagtcattgtttcgagctttgctgtgaagtttctccttcttccgtggaaatggggaatgaagtatttttgggatactcttttggatgctgatttggaatgtgacatcattggctggcagtatatctccgggagcttacctgatggccacgagcttgatcgcttggacaatcctgcgatacaaggtgcaaaatatgatccagaaggcgagtacataaggcaatggcttcccgagctggcgagaatgccaacggaatggatccatcacccatgggacgctccttcaactgtactcaaagcttctggagtggagctcggagcaaactacgcgaaacccatcgtagatatcgacacagctcgtgagctgctaaccaaagccatatcaagaactcgtgaggcacagatcatgatcggagccgcgcctgatgagattgtagctgatagctacgaggccttagagggtaatcataccgttaaagtacctggtcttctttgcccctctgcgtcttctaatgaccagcgagtaccttcggctgttcgttacaatgggttaaagagagtgaaacctgcagaagaagaagaagaagaagaagaagaagagagggagatgaagagatgtagagaagaaagagacttgttttcaactgctgagtcttcttcttctgatggttaggagcgtgttcttggtttcgcattcttcagaagggaagaacttggaagattcttctgataaaaaaattactactagaaccttgggattaaaagctgttattataaaagcctaacatgttgtagaagtgtgtatctgtgtctctggactcgttgttacttgtgctgatgctctcccaaggacaatatttgaatactgtcaacggagatgtatgggtgaactgaaaatatatatattgtaagttgtttt

SEQ ID NO: 1736 - protein, 581 aa, Brassica napus
  misc_feature: Ceres Clone ID no. 1093780
  misc_feature (1)..(581): Bit score of 768.4 for HMM based on sequences of FIGURE 18.
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of SEQ ID NO. 1497
MATNRKTIVWFRRDLRIEDNPALAAAAREGSVFPVFIWCPEEEGQFHPGRASRWWMKQSLAHLNQSLKSLGSHLTFIKTHSTVSAILDCVRATGATKVVFNHLYDPVSLVRDHNVKEKLMERGISVQGYNGDLLYEPWEINSENGKPFTSFAPYWKKCLDMSVESVMLPPPWRLMPLTAAAEGVWACSIEELGLEDEAEKPSNALLTRAWSPGWSNADKTLTEFIEKQLIDYAKNSKKVVGNSTSMLSPYLHFGEISVRRVFQCVRMKKIIWARDKNTEGEESADLFLRGIGQREYSRYICFNFPFTHEQSLLSHLRFFPWDADVGKFKAWSQGRTGYPLVDAGMRELWATGWMHNRIRVIVSSFAVKFLLLPWKWGMKYFWDTLLDADLECDIIGWQYISGSLPDGHELDRLDNPAIQGAKYDPEGEYIRQWLPELARMPTEWIHHPWDAPSTVLKASGVELGANYAKPIVDIDTARELLTKAISRTREAQIMIGAAPDEIVADSYEALEGNHTVKVPGLLCPSASSNDQRVPSAVRYNGLKRVKPAEEEEEEEEEEREMKRCREERDLFSTAESSSSDG

SEQ ID NO: 1737 - DNA, 2601 bp, Panicum virgatum
  misc_feature: Ceres Clone ID no. 1814900
  misc_feature: Encodes the peptide sequence at SEQ ID NO. 1738
aagagcaccaacaccgaacaaaaacataatcaaattgcgagcccagaaatacaaggaaaaatattgctcctgcaactcgtgcggcgcactcctccactgttctggggaatcttgggaggaagagagtctctgagctccctgccagttcgtggcgcgagtggcttcatggtttcttgacgtcctctcctcttgatccaagaactcggggggttcttggattggccggccatgtcggtctcgtccccgtccatgtgcggcggcggggagaccgggaagaggatcgtggtgtggttccggagggacctcagggtggaggacaacccggcgctagcggcggcggcgcgcgcgggaggggaggtggtgccggcgtacgtgtggtcgccggaggaggacggcccttaccatccggggcgcgtgtcccggtggtggatcagccaaagcctgcagcacctggacgcctcgctccgccggctaggcgctggaaagctcgtcacgcggaggtcagccgacgccgtcgtcgcgctgctccagctggtccgcgacaccggcgccacgcacgtctacttcaatcatctctacgaccctatctcactggtcagggaccaccggctaaaggagatgctgacggctgagggcatcgttgtgaattctttcaatgcggatctgctgtatgagccatgggaagttgttgacgatgaagggcagccattcaccatgtttgccccattctggaacaggtgcctcagcatgccgtacgatcccccagcgccgcttctgcccccgaagaagatcaattcaggtaacttatcaatgtgcccatccgatgatctgatctttgaggatgaatcagagaggggaagcaacgctcttctggcccgagcatggacaccaggatggcagaacgcagacaaggcgctaacggccttcctcaacggtcctctggctgactattcagtgaaccgcaagaaggctgatagtgcaagcacatccctactttcacctcacctccattttggtgagcttagcgtgcgaaaggtcttccacctagttcgaatgaaacagcttgtgtggagcaacgagggcaaccacgctgctgaggaaagctgcaccctgttcctgcgttccattggcctgcgggagtactcccgctatctgagcttcaaccatccaagcagccatgagaggcccctcttggcacacctcaggttcttcccctgggtagtcaatgagtgctacttcaagatttggaggcagggaaggactggatacccgcttgtggatgctggcatgagggaactgtgggcgacagggtggttgcatgaccgaatacgtgtagtggtgtcaagcttctttgtcaaggtccttcaacttccatggcgatggggtatgaagtacttctgggacactttactggatgcagatcttgagagcgatgcactgggctggcagtacatcactggctctctccctgatgggcgagagcttgaccggattgacaaccctcagtttgaaggctacaagtttgacccgcatggggagtatgtccgacggtggattccggagcttgcaaggctgccgacagaatggatacatcacccatgggatgcacctgtttctgtgctacaagctgcaggaattgagttgggctccaactatcctctccccatagttgagctagacgcagccaaagccaggctgcaagaagccctgtcagaaatgtggcagctggaagctgcatcaagggccacaatgaacaatggaatggacgaaggtctcgatgactcctcggaggttccaccgattgagtttcctcaagaattacagatggaaatcgatcggcagccagcccaggcaacggccaatgtgtcgatgactgctcgaaggcgtgaggatcagatggtgcctaccatgacgtcttcactgaacagagctgaaacagaggtttctgccgacctggggaacagtgaggacactagagcacaggttccgtttcatgcacatttcgaacctcgagttgagagggaagatgcaatccaaaatgcagaaggccctgctcctagaatcaatggagttcaccagcacaacatctttcagcaacctcagcctcgtaggcgagaagctgttgcgccatccgtgtcagaggcttcgagtagctggaccgggagagaaggcgctgtagtcccagtttggtcacttcctgcagcgtcaggccattcagaaacttttgctgctgatgaagctgacgtttctagtaggagttatttggataggcatccacagtcgcaccggttgatgaactggagtcagttatcccagtcattgtgagttcagatgcaccgtaacccactcactgttctcagacaacaggctgggaagtggaaaattccgtgcagccaaacttaatcggttagggtcttctgaagacggattcatatgtaaattttccagtctgttgctcatagtctggtgggcatgcaaaccaggctgctcgttcctgtatgtgataatagtcgtgtaaatctaatccgctagaacttgtgtgatcgacatagggtgcttaaaaaagtcactattattgatcaaacaatgaagatttcctgc

SEQ ID NO: 1738 - protein, 698 aa, Panicum virgatum
  misc_feature: Ceres Clone ID no. 1814900
  misc_feature (1)..(698): Bit score of 1709.3 for HMM based on sequences of FIGURE 18.
  misc_feature (220)..(498): Pfam Name: FAD_binding_7 Pfam Description: FAD binding domain of DNA photolyase
  misc_feature (16)..(189): Pfam Name: DNA_photolyase Pfam Description: DNA photolyase
  misc_feature: Functional Homolog Of SEQ ID NO. 1497
MSVSSPSMCGGGETGKRIVVWFRRDLRVEDNPALAAAARAGGEVVPAYVWSPEEDGPYHPGRVSRWWISQSLQHLDASLRRLGAGKLVTRRSADAVVALLQLVRDTGATHVYFNHLYDPISLVRDHRLKEMLTAEGIVVNSFNADLLYEPWEVVDDEGQPFTMFAPFWNRCLSMPYDPPAPLLPPKKINSGNLSMCPSDDLIFEDESERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVNECYFKIWRQGRTGYPLVDAGMRELWATGWLHDRIRVVVSSFFVKVLQLPWRWGMKYFWDTLLDADLESDALGWQYITGSLPDGRELDRIDNPQFEGYKFDPHGEYVRRWIPELARLPTEWIHHPWDAPVSVLQAAGIELGSNYPLPIVELDAAKARLQEALSEMWQLEAASRATMNNGMDEGLDDSSEVPPIEFPQELQMEIDRQPAQATANVSMTARRREDQMVPTMTSSLNRAETEVSADLGNSEDTRAQVPFHAHFEPRVEREDAIQNAEGPAPRINGVHQHNIFQQPQPRRREAVAPSVSEASSSWTGREGAVVPVWSLPAASGHSETFAADEADVSSRSYLDRHPQSHRLMNWSQLSQSL

SEQ ID NO: 1739 - protein, 681 aa, Vitis vinifera
  misc_feature: Public GI ID no. 157335888
  misc_feature (1)..(681): Bit score of 1703.7 for HMM based on sequences of FIGURE 18.
  misc_feature (207)..(485): Pfam Name: FAD_binding_7 Pfam Description: FAD binding domain of DNA photolyase
  misc_feature (5)..(176): Pfam Name: DNA_photolyase Pfam Description: DNA photolyase
  misc_feature: Functional Homolog Of SEQ ID NO. 1497
MSGGGCSIVWFRRDLRVEDNPALAAGVRAGAVIPVFIWAPEEEGPYYPGRVSRWWLKQSLAHLDSSLRSLGTPLITKRSTDCVSSLLEIVKSTGATLLFFNHLYDPLSLVRDHRAKEALTAQGIAVHSFNADLLYEPWDVNDAQGHSFTTFSAFWDRCLSMPYDPEAPLLPPKRINPGDVSRCPSDTIAFEDESEKGSNALLARAWTPGWSNADKALTIFINGPLIEYSKNSRKADSATTSFLSPHLHFGEVSVRKVFHLVRIKQVLWANEGNKAGEESVNLFLKSIGLREYSRYLSFNHPYSHERPLLGHLKFFPWVVDEGYFKAWRQGRTGYPLVDAGMRELWATGWMHDRIRVVVSSFFVKVLQLPWRWGMKYFWDTLLDADLESDALGWQYISGTLPDGREFDRIDNPQFEGYKFDPNGEYVRRWLPELARLPTEWIHHPWNAPESVLQAAGIELGSNYPLPIVEIDAAKARLQEALSEMWQAVAASRAAIENGTEEGLGDSESAPIAFPQDVQMEEIPEPVRNNPTTTAVRRYEDQMVPSMTSSFLRIEGEPSLDIQNSAENSRAEVPTNVNANQEPRRETLNRGVTHSVRSNNHNLPQFNIMIGRNTAEDSTAESSSTTRRERDGGVVPVWSPSTSSYAEQFVSEENGIGTSSSYLQRHPRSHQLMNWKQLSQTG

SEQ ID NO: 1740 - protein, 643 aa, Vitis vinifera
  misc_feature: Public GI ID no. 157336718
  misc_feature (1)..(643): Bit score of 904.0 for HMM based on sequences of FIGURE 18.
  misc_feature (208)..(486): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of SEQ ID NO. 1497
MSSDSRTVVWFRRDLRVDDNPALATAAKEGSVLPVFIWCPKEEGQFYPGRVSRWWLKQSLMHLKQSLRSLGADLLLIKAESTIEALLECIHAIGATKLVYNHLYDPISLVRDHSIKQKLMELGMSVQSYNGDLLYKPWDIYDDKGNAFTTFEAYWNKCLSMQMEFVSLLPPWRLVPAAGKVNNCSIEELGLEDESEKSSNALLGRGWSPGWSNADKALTEFIEQHLFDYSKKRLKVEGNSTSLLSPYLHFGELSVRKVLHSVRMKQLLWVKEGNSVWEESVDLFLRAIGLREYSRYLCFNFPSTHERPLLSNLKHFPWHAHHVHFKAWRQGRTGYPLVDAGMRELWATGWIHNRIRVIVSSFAVKFLLLPWKWGMKYFWDTLLDADLESDILGWQYISGSLPDGHELDRLDSPEIQGSNYDPEGEYVRHWLPELARVPTEWIHHPWDAPFTVLKSAGVELGQNYPKPIIEIDLARERLTEAIFMMWEKDAATKVANSNGTNEEVVDNSDSIENLSIANVSVKEKTPCPTSSSHDQRVPTFQNSKSGLLNRKRAKCIEDEKLSQNNLHNYDHGCGTSRADEDLRSTAESSSAKKQATSRTSFSVPQSCSSSSEGNPLQEYESPGLKQPWPEQIVWEKTSSKDGE

SEQ ID NO: 1741 - protein, 700 aa, Triticum aestivum
  misc_feature: Public GI ID no. 161138112
  misc_feature (1)..(700): Bit score of 1559.4 for HMM based on sequences of FIGURE 18.
  misc_feature (221)..(499): Pfam Name: FAD_binding_7 Pfam Description: FAD binding domain of DNA photolyase
  misc_feature (17)..(190): Pfam Name: DNA_photolyase Pfam Description: DNA photolyase
  misc_feature: Functional Homolog Of SEQ ID NO. 1497
MSASPSMSGGAGERTRTRTVVWFRRDLRVEDNPALAAAARTAGEVVPAYVWAPKEDGPYYPGRVSRWWLSQSLKHLDASLRRLGATRLVTRRSTDTVAALLELVRSTGATHLFFNHLYDPLSLVRDHRVKQVLGAEGITVQSFNSDLLYEPWEVLDDHGCPFTMFTPFWNTCLCMVDPPAPMLPPKRINSGELSRCCSSDDLIFEDESERGSNALLARAWSPGWQNADKAFTAFINGPLIDYSVNRKKADSANTSLLSPYLHFGELSVRKVFHQIRMKQLTWSNESNGDGEEGCSLFLRSIGLREYSRRLAFNHPCSHEKPLLAHLRFFPWVVNEVYFKVWRQGRTGYPLVDAGMRELWATGWLHDRIRVVVSSFFVKVLQLPWRWGMKYFWDTLLDADLESDALGWQYISGSLPDGRELDRIDNPQFEGYKFDPYGEYVRRWLPELARLPTEWIHHPWDAPESVLRAAGIELGSNYPLPIVELDEAKSRLQDALSEMWELEAASRAEIENGMEEGLGDSSDEPPIAFPQELQHMEVDRATIHTPATAGRRRADQMVPSITSSLVRAETETELSAAFESEVTRPEVPSQVHFQPQTRMEVRDEGVSDGTAARYNGVQQQQQYTLHRHRVQGGIAPSTSEASSSWTGREGGVVPVWSPPAASGHSDPYAADETDISSRSYLDRHPQQSHRLMNWNQLSQSS

SEQ ID NO: 1742 - protein, 698 aa, Triticum aestivum
  misc_feature: Public GI ID no. 161138114
  misc_feature (1)..(698): Bit score of 1560.0 for HMM based on sequences of FIGURE 18.
  misc_feature (219)..(497): Pfam Name: FAD_binding_7 Pfam Description: FAD binding domain of DNA photolyase
  misc_feature (15)..(188): Pfam Name: DNA_photolyase Pfam Description: DNA photolyase
  misc_feature: Functional Homolog Of SEQ ID NO. 1497
MSASPSMSGGAGERTRTVVWFRRDLRVEDNPALAAAARTAGEVVPAYVWAPEEDGPYYPGRVSRWWLSQSLKHLDASLRRLGATRLVTRRSTDTVAALLELVRSTGATHLFFNHLYDPLSLVRDHRVKQVLGAEGITVQSFNSDLLYEPWEVLDDHGCPFTMFTPFWNTCLCMVDPPAPMLPPKRINSGELSRCCSSDDLIFEDESERGSNALLARAWSPGWQNADKAFTAFINGPLIDYSVNRKKADSANTSLLSPYLHFGELSVRKVFHQVRMKQLTWSNESNGDGEEGCSLFLRSIGLREYSRYLAFNHPCSHEKPLLAHLRFFPWVVNEVYFKVWRQGRTGYPLVDAGMRELWATGWLHDRIRVVVSSFFVKVLQLPWRWGMKYFWDTLLDADLESDALGWQYISGSLPDGRELDRIDNPQFEGYKFDPCGEYVRRWLPELARLPTEWIHHPWDAPESVLQAAGIELGSNYPLPIVELDEAKSRLQDALSEMWELEAASRAEIENGMEEGLGDSSDEPPIAFPQELQHMEVDRATIHTPAMAGRRRADQMVPSITSSFFRAETETELSAAFESEVTRPEVPSQVHFQPQTRMEVRDEVASDDTAARYNGVQQRQQYTLHRHRVQGGIAPSTSEASSSWTGREGGVVPVWSPPAASGHSDPYAADETDISSRSYLDRHPQQSHRLMNWNQLSQSS

SEQ ID NO: 1743 - protein, 650 aa, Triticum aestivum
  misc_feature: Public GI ID no. 161138116
  misc_feature (1)..(650): Bit score of 785.7 for HMM based on sequences of FIGURE 18.
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of SEQ ID NO. 1497
MGGSERTVVWFRRDLRIDDNPALAAAARDGAVLPVFIWCPAEEGRFYTGRCSRWWLKESLAHLARSLQALGCPLVLIRAQTTLAALLQCVDSIGATRVVYIHLYDPISLVRDDKIKNELLGLGISMQSFNGDLLYEPWEVYDENGLPFTTFKKYWEKCMKLHIDISPSLAPWRLVPVSGIENICSSSIDNLGLESSKDEESSNALLSRAWSPGWRNAEKTLEDFVSHGLLDYSKDRMKVAGTTTSLSSPYLHYGEVSVRKIYQLVRVQQIKWENEGKSGAGESDNLFLLSIGLREYSRYLCFNFPFTRERSLLGNLKHYPWRADEDRFKSWRQGMTGYPLVDAGMRELWATGWTHNRIRVIVSSFAVKFLQIPWTWGMKYFWDVLLDADIESDILGWQYISGSLPDGHELGRLDNPEVQGQKYDPDGEYVRTWIPELARMPGEWIHHPWDAPSSILEVAGVELGFNYPMPIVELHTARECLDDAISTMWQLDTAEKLAELDGEVVEDNLSHIKSFDVPKVVLKELSPHCDRKVPTDDGRNLELQPKELKGTNKQTICVDVIKASKMEDTGSIANSPISRKRSSSGSVFNVPSYSSSVEVHSQNQHPGGYLVGSSKYIQQKAERNCVGKAEDDDSADSGTNTSRASKRPAA

SEQ ID NO: 1744 - protein, 650 aa, Triticum aestivum
  misc_feature: Public GI ID no. 161138118
  misc_feature (1)..(650): Bit score of 801.4 for HMM based on sequences of FIGURE 18.
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of SEQ ID NO. 1497
MGGSERTVVWFRRDLRIDDNPALAAAARDGAVLPVFIWCPAEEGRFYTGRCSRWWLKESLAHLARSLQALGCPLVLIRAQTTLAALLQCVDSIGATRVVYNHLYDPISLVRDDKIKNELLGLGISMQSFNGDLLYEPWEVYDENGLAFTTFKKYWEKCMKLHIDISPSLAPWRLVPVSGIENICSSSIDNLGLESSKDEESSNALLSRAWSPGWRNAEKTLEDFVSHGLLDYSKDRMKVAGTTTSLLSPYLHYGEVSVRKIYQLVRVQQIKWENEGKSGAGESVNLFLLSIGLREYSRYLCFNFPFTHERSLLGNLKHYPWRADEDRFKSWRQGMTGYPLVDAGMRELWATGWTHNRIRVIVSSFAVKFLQIPWTWGMKYFWDVLLDADIESDILGWQYISGSLPDGHELGRLDNPEVQGQKYDPDGEYVRTWIPELARMPGEWIHHPWDAPSSILEVAGVELGFNYPMPIVELHTARECLDDAISTMWQLDTAEKLAELDGEVVEDNLSHIKSFDVPKVVLKELSPHCDRKVPTDDGRNLELQPKELKGTNKQTICVDVIKASKMEDTGSIANSPISRKRSSSGSVFNVPSYSSSVEVHSQNQHPGGYLVGSSKYILQKAERNCVGKAEDDDSADSGTNTSRASKRPAA

SEQ ID NO: 1745 - protein, 612 aa, Arabidopsis thaliana
  misc_feature: Public GI ID no. 166007537
  misc_feature (1)..(612): Bit score of 797.2 for HMM based on sequences of FIGURE 18.
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of SEQ ID NO. 1497
MKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVSSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSKRVKPEEEEERDMKKSRGFDERELFSTAESSSSSSVFFVSQSCSLASEGKNLEGIQDSSDQITTSLGKNGCK

SEQ ID NO: 1746 - protein, 612 aa, Arabidopsis thaliana
  misc_feature: Public GI ID no. 166007547
  misc_feature (1)..(612): Bit score of 799.8 for HMM based on sequences of FIGURE 18.
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of SEQ ID NO. 1497
MKMDKKTIVWFRRDLRIEDNPALAAAAHEGSVFPVFIWCPEEEGQFYPGRASRWWMKQSLAHLSQSLKALGSDLTLIKTHNTVSAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVEKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLGKAISRTREAQIMIGASPDEIVADSLEALEANTIKEPGLCPSVSSNDQQVPSAVRYNGSKRLKPEEEEERDMKKSRGFDERELFSTAESSSSSSVFFVSQSCSLASEGKNLEGIQDSSDQITTSLGKNGYK

SEQ ID NO: 1747 - DNA, 960 bp, Glycine max
  misc_feature: Ceres Clone ID no. 642857
  misc_feature: Encodes the peptide sequence at SEQ ID NO. 1748
aatcccaataactttgagaaagctagctagtgagctatatctaactttgaaaattgcccaatatacatgttctactttgcctactgcaacatatcctagttagttagcttcttggttcttaattacactacatacatggaacttgagtcgggtcttgctctccccactcacaattccgttgaggaattcaagcttaacaagtcgaaacagatagtgagtttagagttatggagacccagttgcggttcagatagcgaaaagcgtgtcaaacacaataagcgcagcttcgaagagtcctttggacaatttttgaaaccttttcctttactagtatggagtggacagccaaatgaagaagaagaccgtaatgaaaaggtgcaaagaaacattcacacaccaaacaagaacggtgatgaagaaaaccatttggtggggtggccaccagttaaatcatggaggaggaaagagctccatcggcagcagtatcctgcgagaggccaaattaggaacgataggattcaagctaatgagaatcaaagtagaagaccaaactctttatatgtaaaggttaacatggaaggggtagccataggaaggaaaatcaatttgaggcttttcaattcttatcagacacttacaagcagcttgatcagcatgtttgctaaataccaaaaatttgaggaagttggagaaagttacacactcaactttcaaaacgaacaaggggattggctgcaagtaggacatgttccatggcaatccttcattggtactgtgcggcgtttggtgatactgaggaatggaagtgaaactatttgacacagattttaatttgtgctctaatgttgtttatggtgtcggttcgggaaaaagagtatttgcttgaataggttgtagagagcaaaagcaaagtatgaaaagtcgaattacaagtgacttgcttcagctttgattcttttt

SEQ ID NO: 1748 - protein, 227 aa, Glycine max
  misc_feature: Ceres Clone ID no. 642857
  misc_feature (1)..(227): Bit score of 284.3 for HMM based on sequences of FIGURE 16.
  misc_feature (1)..(227): Pfam Name: AUX_IAA Pfam Description: AUX/IAA family
  misc_feature: Functional Homolog Of SEQ ID NO. 1347
MELESGLALPTHNSVEEFKLNKSKQIVSLELWRPSCGSDSEKRVKHNKRSFEESFGQFLKPFPLLVWSGQPNEEEDRNEKVQRNIHTPNKNGDEENHLVGWPPVKSWRRKELHRQQYPARGQIRNDRIQANENQSRRPNSLYVKVNMEGVAIGRKINLRLFNSYQTLTSSLISMFAKYQKFEEVGESYTLNFQNEQGDWLQVGHVPWQSFIGTVRRLVILRNGSETI

SEQ ID NO: 1749 - DNA, 1186 bp, Triticum aestivum
  misc_feature: Ceres Clone ID no. 644455
  misc_feature: Encodes the peptide sequence at SEQ ID NO. 1750
accaccaccacaccacacttgctcgtctccctctgcccctccccttcctcctatagcaatcaaaccaccagctccactcccccctccccttcctccgtcctcaccctccccctcctgctactccccagttcatgtcctgctgcttcccatgtcgccgcctctcgagctcgactacataggcctctcggccgccgccggcggccgcccggacgacgacctgaaaggcaccgagctccgcctcggacttcccggctgcgagtcgcccgaccgccgcccggtcgccgccaccaccacactggagctgctgcccgccaagggggccaagcgagggttttcggacgaggtcgtgccgcctgcgccgatttccgccgccgggaaaggcaaggaggcgtccggggatgagaaggacaagaaggtcgccgccccgccgcagcctgctgccaaggctcaggtggtgggatggccaccagtccgcagctaccgcaagaacacgatggcaaccaccaccaaccagctgaagagcagcaaggaggattctgacacgaagcaggggcaagagtttctgtatgtcaaggtcagcatggatggtgcgccttacctgaggaaggttgacctcaagacatacaagaactataaggacatggttgtggcgctagggaaaatgttcattggcttcaggaccgggaaggatggtgcatctgagaacagaaaggatggtgaatatgtgatgacttacgaagacaaggatggagactggatgctggttggtgacgtcccatgggagatgttcaccgaggcttgccggaggatcagggtcatgaaaagttcagatgtagttgggcttggagttacaagggcaggggttaagtccaagaataagaactaaaacggtcgctgcccacggtttgaagacgaggtcgcacatgccgtctgtactactgcatggttttcctatcccacaagtaaaatcacccgttactctaccgtttaagatttgcgacatctcctagagacttatgctctatattttgttgtgcccacgttgttgtacgcgtgttatttccatccgtgtaaatggttggtaagcagtgcgagagctactgctgtgtttgatgactcctatgtattttgccactcttgtcctgaaccggtcgttcgtcgtaaatgtgaaggttgcaagactatc

SEQ ID NO: 1750 - protein, 245 aa, Triticum aestivum; identical to SEQ ID NO: 247
  misc_feature: Ceres Clone ID no. 644455
  misc_feature (1)..(245): Bit score of 385.6 for HMM based on sequences of FIGURE 16.
  misc_feature (23)..(235): Pfam Name: AUX_IAA Pfam Description: AUX/IAA family
  misc_feature: Functional Homolog Of SEQ ID NO. 1347

SEQ ID NO: 1751 - protein, 192 aa, Vitis vinifera
  misc_feature: Public GI ID no. 157336601
  misc_feature (1)..(192): Bit score of 249.7 for HMM based on sequences of FIGURE 16.
  misc_feature (11)..(192): Pfam Name: AUX_IAA Pfam Description: AUX/IAA family
  misc_feature: Functional Homolog Of SEQ ID NO. 1347
MEGAVAYESDLNLKATELRLGLPGRDEAEKEALSGVRNNKRASPDTSDECGSKGSSNGDRENAPATKAQVVGWPPIRSFRKNSFQPKKTEAEAAGMFVKVSMDGAPYLRKIDLKVYKGYPELLQALQNMFKFTIGDYSEREGYKGSEYVPTYEDKDGDWMLVGDVPWDMFMSSCKRLRIMKGSDARGLGCGA

SEQ ID NO: 1752 - protein, 246 aa, Zea mays
  misc_feature: Public GI ID no. 194708620
  misc_feature (1)..(246): Bit score of 547.6 for HMM based on sequences of FIGURE 16.
  misc_feature (25)..(238): Pfam Name: AUX_IAA Pfam Description: AUX/IAA family
  misc_feature: Functional Homolog Of SEQ ID NO. 1347
MSPPLELDYIGLSPPAAAAAAENDELKGTELRLGLPGSGSPDRRVVAATATTLDLLPAKGAKRGFSDEAPPPSPVATAGKGKKVAEEEYDEKKVAATPQPAAKAQVVGWPPVCNYRKNTMTTTQLEGSKEDGDAKQGQGFLYVKVSMDGAPYLRKIDLKTYKNYKDLSTALEKMFSGFSTGKDGSSEYRKDGEYVLTYEDKDGDWMLVGDVPWEMFAGSCRRLRIMKGSDAIGLAPRAADKSKNRN

SEQ ID NO: 1753 - DNA, 1161 bp, Solanum lycopersicum
  misc_feature: Ceres Annot ID no. 8463339
  misc_feature: Encodes the peptide sequence at SEQ ID NO. 1754
atggcaatggcactaacactcaacttccaattttcgtggatgcgaatggtttccagtatcctcctagtgcaccaaatcaacttcaattattcggaagctccattattgtgctgtaatgttgtatttgtactaacaagccttgggttgtgctcggtaagtcaagatttacaggaaaggccaaaggtattagcaggcatatctcagctattcaatgttttaagcagggtggtgccacttggatcctctgctgatcctgtaaattattttgtaaatgagcatgctacgcctatgattcggcataatcgaggaagcgaagcaggtgtttccaggcagcaaaagcttcaattttccttgaatcataatttggttcatgatgacactgaacggccagcaaatgttcctgcccaaaatcctgtatctactggtttaaagctatcatatgatgacgatgaacccaactcttctctctcttctgcaagtggaagtatcaatgcatcagcatcagttataatgtcccttggtgacaacattaaaacagaaatggaacgccagaagaaggaatttgatcagtatcttaagactcagtggaacttggtaatattgtctacctgcttcccacagtctgaagaaacttgggctagaggtgttagagacataaagcagagacatatggcttcgttactgagtgcagtcgagaagaatgttggcactaagttgcaagagaaggatattgagttagagaacataaatcagaagaacagagaactagttgaacggatgaagcaagttacagctgaggcgcaaaattggtgttacagagccaagtgtaacgaatctttagtcaacactttaaaaacgaaccttcagcaagcgatgcaatctgctgaacaaggaaaagaagggatgggagacaatgagctagatgatgctgcatcctacattgatcgaaacaataggctcagcaatattcctagtggttctggtaagtgtgcatcgacgaaaaaaggcattatctgcaaggtatgcaaattaaaggaggtatgcatcttattgatgccttgtagacacttgtgtttgtgtaaagattgtgaaggattagttagtgtatgtcctatctgccagttgatgacaactgctagtgttgaagtgttcttgtcttga

SEQ ID NO: 1754 - protein, 386 aa, Solanum lycopersicum
  misc_feature: Ceres Annot ID no. 8463339
  misc_feature (1)..(386): Bit score of 129.6 for HMM based on sequences of FIGURE 13.
  misc_feature: Functional Homolog Of SEQ ID NO. 1047
MAMALTLNFQFSWMRMVSSILLVHQINFNYSEAPLLCCNVVFVLTSLGLCSVSQDLQERPKVLAGISQLFNVLSRVVPLGSSADPVNYFVNEHATPMIRHNRGSEAGVSRQQKLQFSLNHNLVHDDTERPANVPAQNPVSTGLKLSYDDDEPNSSLSSASGSINASASVIMSLGDNIKTEMERQKKEFDQYLKTQWNLVILSTCFPQSEETWARGVRDIKQRHMASLLSAVEKNVGTKLQEKDIELENINQKNRELVERMKQVTAEAQNWCYRAKCNESLVNTLKTNLQQAMQSAEQGKEGMGDNELDDAASYIDRNNRLSNIPSGSGKCASTKKGIICKVCKLKEVCILLMPCRHLCLCKDCEGLVSVCPICQLMTTASVEVFLS

SEQ ID NO: 1755 - DNA, 1122 bp, Sorghum bicolor
  misc_feature: Ceres Annot ID no. 8679266
  misc_feature: Encodes the peptide sequence at SEQ ID NO. 1756
atggcggtcgcccacgccttccaccatgattcccgcgccatcaggccagcgctggagaacgcgacgaccaccgcatcggccgtcctcggcgaccacgacaccgccgccggcggctgcggccacctgctgctgctgcccggcgtagtgcagcgccaggctgcggcagtggctggccacacggcgttcagcgacccacgcagcgagctcacctgcaacaacaacaacaagtacgacgccacttggtccgtcgtcgtgcccaggaagcgcgcgcggatcggcggcgcggtggacgccgccggcctggtcatggaggggcaccgccaccgcgcgctgctgcccgtgccgcaggcgttcgcgcccggcggaggcggagagggtgccctgggcggcggcagcagcagcagcagcagggtgctctgctccggcgccgcgtccaccagcggacgcccaagcaccgccgcgccggtgtcgcagtcgcagcacggcatactggcgcacctctaccgccacagcgtcgaggtcgacgcgcttgtccgtatcgagaacgagaggctgcgggcggggctggaggaggcgcggcggcggcacgtccgggccgtggtgtcggccgtggagcgcggcgcggcgcggcgcctgcgggcggcggaggccgaccttgcgcgcgcgctggcgcgcaatgcggagctcggcgagagggtccgcgagatgggcgcggaggggcaagcgtggcagggcatcgccagcggccacgaggctgccgccgccggtctgcgcgccacgctcgagcagctcctcctccagcaggcgccgtgcgcgggcgcggctgacgaggagggccagggagagggagaggcggtggtggaggacgcgcggtcgtgctgcttcgagccggagcgggagcggcggcacgaaggcggcccggacgacgacgacgacgacaagcaggcccgtggcagtggctgcacgagggcggcgtgccgggcgtgcggcgcggcggatgcgtgcgtgctgctgctgccgtgccggcacctgtgcctttgcggttggtgcgaggcggttgtcgaggcgtgccccgtgtgcgccgccaccaagaacgcctcgctccacgtcctcctctcctga

SEQ ID NO: 1756 - protein, 373 aa, Sorghum bicolor
  misc_feature: Ceres Annot ID no. 8679266
  misc_feature (1)..(373): Bit score of 293.3 for HMM based on sequences of FIGURE 13.
  misc_feature: Functional Homolog Of SEQ ID NO. 1047
MAVAHAFHHDSRAIRPALENATTTASAVLGDHDTAAGGCGHLLLLPGVVQRQAAAVAGHTAFSDPRSELTCNNNNKYDATWSVVVPRKRARIGGAVDAAGLVMEGHRHRALLPVPQAFAPGGGGEGALGGGSSSSSRVLCSGAASTSGRPSTAAPVSQSQHGILAHLYRHSVEVDALVRIENERLRAGLEEARRRHVRAVVSAVERGAARRLRAAEADLARALARNAELGERVREMGAEGQAWQGIASGHEAAAAGLRATLEQLLLQQAPCAGAADEEGQGEGEAVVEDARSCCFEPERERRHEGGPDDDDDDKQARGSGCTRAACRACGAADACVLLLPCRHLCLCGWCEAVVEACPVCAATKNASLHVLLS

SEQ ID NO: 1757 - DNA, 999 bp, Sorghum bicolor
  misc_feature: Ceres Annot ID no. 8691102
  misc_feature: Encodes the peptide sequence at SEQ ID NO. 1758
atggccgtgcaagcgcaattcggcggcctcctgctccccccacccttcgcggccgaggaggagcagcagatgctggcgctcaaggactacggcgcgctcctctccgccgccgcggcgacgcccggtgtcgccggtggctacgcgtggcagcactacgactactgcgccgcgcagagcgagctcacgtgcaacggcggtggcggggcggcgctgtccgtgcccgtgccctcgcgcaagcgcggcagggaggaggacgagggcgacgacctccttcactacgcgccgttcctgcctctcccggtgacgcggcggccgcactccgccacgccgccggcggcggctgcggcgtcgacgagcggccgggaagaagagatgtcggcggagcacgcgctgtggcggcggctgcagcacggcgcggaggtggacgcgctggtgcgcgccgagtgcgaccgcctgcgcgcggggctggagctggcgcggagacggcagcgccaggcgctggtccgcgccgcggccgtgtccgtctcggcgatggccgggcgggtgcgtgacgccgaggcgcagctggaggccgcccggcgccgcgccgcggagctcgaggagggggtccggcttgcggccgccgaggcgcaggcgtggcgcggcgtctcgcggggcaacgaggccgtcgccgcggggctccaagccacgctcgacgcgctcctcctccgttcctcctcggccgagggattcggcgactccgaccccgacgacgcgcagtcgtgctgctgcttctacgtcgaggaggcgccggacaccgccgccgccgccacggcctcgtcgtcctcgacttggagcggcaagtgggcgtgcaaggcgtgcggcgtgggggaggcgtcggtgctgctgctgccgtgccggcacctgtgcctgtgcaaggcgtgcgagcggcggacggacgcgtgccccgtctgctccggcgacaagaacgcggccatccacatcgcgccgcccatctga

SEQ ID NO: 1758 - protein, 332 aa, Sorghum bicolor
  misc_feature: Ceres Annot ID no. 8691102
  misc_feature (1)..(332): Bit score of 200.0 for HMM based on sequences of FIGURE 13.
  misc_feature: Functional Homolog Of SEQ ID NO. 1047
MAVQAQFGGLLLPPPFAAEEEQQMLALKDYGALLSAAAATPGVAGGYAWQHYDYCAAQSELTCNGGGGAALSVPVPSRKRGREEDEGDDLLHYAPFLPLPVTRRPHSATPPAAAAASTSGREEEMSAEHALWRRLQHGAEVDALVRAECDRLRAGLELARRRQRQALVRAAAVSVSAMAGRVRDAEAQLEAARRRAAELEEGVRLAAAEAQAWRGVSRGNEAVAAGLQATLDALLLRSSSAEGFGDSDPDDAQSCCCFYVEEAPDTAAAATASSSSTWSGKWACKACGVGEASVLLLPCRHLCLCKACERRTDACPVCSGDKNAAIHIAPPI

SEQ ID NO: 1759 - DNA, 1074 bp, Sorghum bicolor
  misc_feature: Ceres Annot ID no. 8700147
  misc_feature: Encodes the peptide sequence at SEQ ID NO. 1760
atggccgtgcaggcgcggcacttcccccacaacagcttggccccggcggcgggcgcctccctgttcctggacgcctacgccgggcgcgtgccggcaccggccccgatcggggacgccaggacggtgctcaacgacgacttcccgcgcagcgacctcgcctggccgtgcaaccacggccgcttcctgcccaggaagcggccgcgcctggaggcggcggaccaggcacaggcagcgctagcagcgggtggtgatctcttccaagatcaacgcgtgggtatgcgtatgcctccggcgtgcacggagcgcctgctgcagccagcagtgccaccgccgttcgtcgacgtgcaggtgcagggccgggcggtgggctccggcgccgcgtccaccagcgggaggatgggaaatggcgcgacgccgcccgccgtcgtctcgctggagctcctgccgtcgtggacacaccgccacggcgtggagatcgacgcgctcgttcgactcgaggcggagaggatgcgcgcggcgctgaaggaggcgcggcggaggcacgcccgcgcgctgctggccgccgtggcgcgcgccgcgtcggggtcggggcggctgcgcgcgtcggaggccgacctcgagcgcgcgctccgccgcaacgcggagctggaggagaaggcacggcaggcgggcgccgagtgccaggcgtgggtgggcgtcgcccggagccacgaggccgtcgccgcggggctccgcgccacgctggaccaggtcctcctgcggtcgtcaccctgcggtgctggtgcgcgtgcgcccgcggccggcggtggctgccaggccgaggacgcgcagttgtgctgcttcgaggcgcacgccaccgaggacgacgacgccgacgacggcgcgtgcgcgtgcgcgtccagcaccagcaggtccaagtcgttggcgtgcaagtcgtgtggcggcggcgaggcgtgcgtgctgctgctcccgtgccggcacctgtgcctgtgccgcgtgtgcgaggacgccgtggacgcttgccccgtctgcgcgaacaccaagaacggctcgctccacgtcctcttctcctga

SEQ ID NO: 1760 - protein, 357 aa, Sorghum bicolor
  misc_feature: Ceres Annot ID no. 8700147
  misc_feature (1)..(357): Bit score of 260.8 for HMM based on sequences of FIGURE 13.
  misc_feature: Functional Homolog Of SEQ ID NO. 1047
MAVQARHFPHNSLAPAAGASLFLDAYAGRVPAPAPIGDARTVLNDDFPRSDLAWPCNHGRFLPRKRPRLEAADQAQAALAAGGDLFQDQRVGMRMPPACTERLLQPAVPPPFVDVQVQGRAVGSGAASTSGRMGNGATPPAVVSLELLPSWTHRHGVEIDALVRLEAERMRAALKEARRRHARALLAAVARAASGSGRLRASEADLERALRRNAELEEKARQAGAECQAWVGVARSHEAVAAGLRATLDQVLLRSSPCGAGARAPAAGGGCQAEDAQLCCFEAHATEDDDADDGACACASSTSRSKSLACKSCGGGEACVLLLPCRHLCLCRVCEDAVDACPVCANTKNGSLHVLFS

SEQ ID NO: 1761 - DNA, 1219 bp, Zea mays
  misc_feature: Ceres Clone ID no. 100935394
  misc_feature: Encodes the peptide sequence at SEQ ID NO. 1762
ttcactccatcaccccctctcccccagtcccccgtccctttcccctcagccatctccttccccctcacctcgccatggcgttcttctctcaccaccatctccagcagccacacccgcagcaggcaccgcccccgaatcagcagcagccggtgcttccttccttcaggaacgcgctaccggtgcctgtggatggccagatcccagcgcccctcaccttcttcaacccgccgcctgccttcccggagcagcccgcgcagacaacgctggtggatgcggtggggctgacggcagctgctgggcttgggtggaggcagccgagggagcaggaactgcttggagaaaactcccagatgtcgtccatcgattttctgcagacgggctcggcggtatcgacggggctggcgctgtctctggaggaccggcgccacggcggcggcggggctgggaactcctccggcgattcaccgctgctcctgctgcccatgctggacgatgacatttcacgcgaggtccagcggcttgacgctgatatggaccgcttcattaaagctcagagtgaacggctgaggcaatctatactggagaaagttcaggcaaagcaatttgaggcactggcctcagttgaggacaagatattcagaaaaatacgggataaagaggcggaagtggaaaccatcaacaaaaggaactytgaactagaggaccagattaagcatttgggagtggaagttggtgcttggcagcaaagggccaagtacaatgagagcctgatcaatgcactcaagtacaacttggaacaagtatgtgctccccagagcaaggacttcaaggaaggctgcggtgatagcgaggtagatgacccggcgtcctgtccctatggtggtgctgtcaatttgcaactgatgccaaaggagaacagacaaccgaagaatttaacggcttgcagggtctgtaaatcaagtgaggcatgcatgctcttgctgccgtgtcggcatctttgtttatgcaaggagtgcgagagcaagctgagcatttgccccctgtgccagtcctccaagatacttggcatggagatatattatgcatagaatataatttatgtatcccattagtatcgtacgagatactgctatgttaatacgtcaatctattgccgaagttcagaacctatgtacccctattgacttgcccctggatcaaaaaaagactgccgtttatg

SEQ ID NO: 1762 - protein, 337 aa, Zea mays
  misc_feature: Ceres Clone ID no. 100935394
  misc_feature (1)..(337): Bit score of 288.2 for HMM based on sequences of FIGURE 13.
  misc_feature: Functional Homolog Of SEQ ID NO. 1047
  misc_feature (206)..(206): Xaa is any aa, unknown, or other
MAFFSHHHLQQPHPQQAPPPNQQQPVLPSFRNALPVPVDGQIPAPLTFFNPPPAFPEQPAQTTLVDAVGLTAAAGLGWRQPREQELLGENSQMSSIDFLQTGSAVSTGLALSLEDRRHGGGGAGNSSGDSPLLLLPMLDDDISREVQRLDADMDRFIKAQSERLRQSILEKVQAKQFEALASVEDKIFRKIRDKEAEVETINKRNXELEDQIKHLGVEVGAWQQRAKYNESLINALKYNLEQVCAPQSKDFKEGCGDSEVDDPASCPYGGAVNLQLMPKENRQPKNLTACRVCKSSEACMLLLPCRHLCLCKECESKLSICPLCQSSKILGMEIYYA

SEQ ID NO: 1763 - DNA, 1125 bp, Gossypium hirsutum
  misc_feature: Ceres Clone ID no. 1834568
  misc_feature: Encodes the peptide sequence at SEQ ID NO. 1764
aaaaaaccaaagccaaagccaaagcaaaatccaactcgaaacgctatcttctttttgctctgtaaaaagatatctatggctgttgaagctaggcatcttaatcttttcccccctgagtttacaggaaacaggttggtttccaatatccaattctccaattaacggattattattttttgaatcgtttgaaagactgaaaatcggttttttttctttggaaccttttacagggagacgatgaatccaattcaaggaaacgggaatatgtatcaaaccgagattggatatggggttccgttatcgggaaccacgacggtggcggaagggttgcttccgttgtataagtataactctacggctacggcggcgatgaaatcggagagtagcttgacgtacaacaacaatgttcttcctttaccgaggaagcgttcgagggattcgattaatccgatcctttcgtttccttcaccggttcaacaacaaagcaataataacaacggcaataataagacttgttttcttggtcatgatatttcttttcatatggagcaacaacagttggatattgatcgcatcatctcccaacatatggagaaaatgagggtggaaatggaggaaagaaggaagagacaagccaggaagataatggaagcaatcgaaggtggagtgatgaagaaactaaaagccaaagaagaagagattgaaaagattgggaaattaaattgggcactcgaaggaagggtgaaatcactatgcgtagagaaccaaatatggcgagatttggctcaaaccaacgaggcaactgccaacgcgttacggaccaacttagaacaagtactcgccgccgctgccaacacccgtgaggaggcggaagcggcggcggcagacgaggtggacgatgcacaatcttgttgcgggagcaactgggaagcaactgcggagaaaaccgtcgccggcggtggaggacgggagtgtaggaattgcgggaaggaagaagcgtgtgtgttgctgttgccgtgtaggcatttgtgcttgagtacgatttgtgggtccacacttcacgtttgccccgtttgtaaatccactaaaaatgctagtgttcatgttaacttgtgataaaccccc

SEQ ID NO: 1764 - protein, 292 aa, Gossypium hirsutum
  misc_feature: Ceres Clone ID no. 1834568
  misc_feature (1)..(292): Bit score of 354.0 for HMM based on sequences of FIGURE 13.
  misc_feature: Functional Homolog Of SEQ ID NO. 1047
MNPIQGNGNMYQTEIGYGVPLSGTTTVAEGLLPLYKYNSTATAAMKSESSLTYNNNVLPLPRKRSRDSINPILSFPSPVQQQSNNNNGNNKTCFLGHDISFHMEQQQLDIDRIISQHMEKMRVEMEERRKRQARKIMEAIEGGVMKKLKAKEEEIEKIGKLNWALEGRVKSLCVENQIWRDLAQTNEATANALRTNLEQVLAAAANTREEAEAAAADEVDDAQSCCGSNWEATAEKTVAGGGGRECRNCGKEEACVLLLPCRHLCLSTICGSTLHVCPVCKSTKNASVHVNL

SEQ ID NO: 1765 - DNA, 1229 bp, Zea mays
  misc_feature: Ceres Clone ID no. 895080
  misc_feature: Encodes the peptide sequence at SEQ ID NO. 1766
gtcgtcttcttatataagacgccaacgacgcatgtcctcggagcctgccgaggccaggatatagaggcgtcgccgggccgggccactgcacggtcggcggatatggctgtcgaagcgcacagcctcctcttagcaggagggcacaagcaactcaccagcgcgggatggccttggacgaccggcgacgaagctagatgcgcgacggcgcgaccgagccaccagcaggctttccagctccagcaggcctcgtgtgtgggcgtgggcgtgggcctgccggcggcggctccggtctcgtcggccgcggcggcgccaccagcgccgatgatagcgcagcagtacgctgctggcggacggctgttcgtgggagacgcggcggagagcggcgtcacgttcggaggaggaggtgcggtgcagcaggaggcgccccggaagcggaagcgcgccgagcaggggcagacgccgccgccggttcttgggaccggcgcggccgacgtggcggcgcagtttcaacagcagctcgtcgacgtcgaccgtctcgtcctccaacacaccgccaagatgtgggcggggctcaccgagcagcggcggcggcacgcccggcaggtcgtggccaccgtggaggccgccgcggcgccgcggctgcgcgcaaaggaggaggagatccagcggatgcggcgcgtcaactgggcgctcgaggagcgggtcaagagcatgtacgtcgaggcgcacatgtggcgtgacttggcgcagtccaacgacgccgcggtcaccgcgctccgcggcgagctgcagcaggcgctcgacgcccagcagacgcgccgccgcgccgaagacgccgactcgtgctgctgcggggagaacgacgtcttcatcaccgaagcaggcgcggcggagaacgaagaggaggccgggacgtcgtcgtcgtcgggccacgtcatcagggcgtgcgccgtgtgcggcgacaacgcggccgacgtgctgctgctgccgtgccgccacctttgcgcgtgcgcgccgtgcgcggccgcggcgagggcgtgcccggcgtgcgggtgcgccaagaatggcagcgtctgcgtcaacttttcgtgatggtcctgaaaccgatagaattactggatagactagaattttttttggagacggatgcatcttttgcacttgccttcccccctccccccctccaaaaaccctcgagcgagaagaaaaaatatagtcccaaagttcgg

SEQ ID NO: 1766 - protein, 329 aa, Zea mays
  misc_feature: Ceres Clone ID no. 895080
  misc_feature (1)..(329): Bit score of 580.8 for HMM based on sequences of FIGURE 13.
  misc_feature (282)..(316): Pfam Name: zf-C3HC4 Pfam Description: Zinc finger, C3HC4 type (RING finger)
  misc_feature: Functional Homolog Of SEQ ID NO. 1047
MAVEAHSLLLAGGHKQLTSAGWPWTTGDEARCATARPSHQQAFQLQQASCVGVGVGLPAAAPVSSAAAAPPAPMIAQQYAAGGRLFVGDAAESGVTFGGGGAVQQEAPRKRKRAEQGQTPPPVLGTGAADVAAQFQQQLVDVDRLVLQHTAKMWAGLTEQRRRHARQVVATVEAAAAPRLRAKEEEIQRMRRVNWALEERVKSMYVEAHMWRDLAQSNDAAVTALRGELQQALDAQQTRRRAEDADSCCCGENDVFITEAGAAENEEEAGTSSSSGHVIRACAVCGDNAADVLLLPCRHLCACAPCAAAARACPACGCAKNGSVCVNFS

SEQ ID NO: 1767 - protein, 337 aa, Populus balsamifera subsp. trichocarpa
  misc_feature: Public GI ID no. 118482316
  misc_feature (1)..(337): Bit score of 567.8 for HMM based on sequences of FIGURE 13.
  misc_feature: Functional Homolog Of SEQ ID NO. 1047
MAHPQHQFQQHYQPQQQQQQPKNLRNLYAIDSQISPAVAYFNPSNLQDQSQHPPYVPPFHVEGFAPGPGNDGSDGGLELQWNYGLEPKRKRLKEQDFLENNSQISSVDFLQARSVSTGLGLSLDNTRVSSSGDSALLSLIGDDIDSELQRQDVEVDKFLKIQGDRLRQTILEKVQADQLQTISLVEEKVLQKLRQKEAEVESINKKNMELEEKMEQLSMEAGAWQERARYNENMINAIKFNIQQVYAQSRDSKEGCGDSEVDDTASCCNGRAIDFHLLSNDNNDMKELMTCKACRVNEVCMLLLPCKHLCLCKDCESKLSFCPLCHSSKFIGMEVYM

SEQ ID NO: 1768 - protein, 334 aa, Populus balsamifera subsp. trichocarpa
  misc_feature: Public GI ID no. 118486096
  misc_feature (1)..(334): Bit score of 674.9 for HMM based on sequences of FIGURE 13.
  misc_feature: Functional Homolog Of SEQ ID NO. 1047
MAVEAPHTNLNFPSHLLPNRDFAKVNQANMSLYNTQMDSGLVFNEPMPETLLSFYQSSLGCDPVSAKASNKDDSGLTYNVPAVVAPRKRSRDSINDNFDAFHASQKTKVCPFSSFIDQDIIFQIQQQQSEIDRFIAEHNQKVRMELEDRRKRQSRMLVSAIQGGMVRKLIEKDEEIQRMGKLNWVLQEKVKSLYVETQIWRDLAQANEATANSLRSNLEQVLAHVSEDRYINGGGATVADDAESSCGSSDHGRCPIAGGEEGAVKDKLVVVKDNNSSKNINHNRMCKKCGERESSVLLLPCRHLCLCTLCGSNLIGTCPVCDSVMDASVHVNMA

SEQ ID NO: 1769 - protein, 340 aa, Populus x generosa
  misc_feature: Public GI ID no. 118488869
  misc_feature (1)..(340): Bit score of 442.8 for HMM based on sequences of FIGURE 13.
  misc_feature: Functional Homolog Of SEQ ID NO. 1047
MAVEARHLNLFPPQLISSRDITNPIEANTNMYNTQMGYGVPLSGGTTTTTADTLLPMYSSVITDSISHKTPIKSDSGLTYNVPVQRKRPRDSINPLLSYPTLVQSNKTCAPFSFLGQDLSFQIQQQQLDIDCLVSQHMEKVRMEIEEKRRRQARRIIEAIETGMMKRLRAKEEEIEKIGKLNWALEEKVKSLCVENQIWRDLAQSNEATANTLRSNLEQVLAAQVKEDRTLGAGLDDQTAALLDDAQSCCGSNGGDGDDGWEEKVSERCTLANGAQDNNGAGPRGTGTSSWLCRNCNKAESCVLLLPCRHLCLCTVCGSSLHTCPICKATKNASVHVNLS

SEQ ID NO: 1770 - protein, 330 aa, Vitis vinifera
  misc_feature: Public GI ID no. 157335531
  misc_feature (1)..(330): Bit score of 523.2 for HMM based on sequences of FIGURE 13.
  misc_feature: Functional Homolog Of SEQ ID NO. 1047
MAMPHHPFQQESKPYRNLYTNEGQISQQAAFYSTTNFQDQSHHPPYIPPFHVEGFAPGPFAAADGDDGGGELRWNYGLESKKKRLKEQDFLENHSQISSVDFLQPRSVSTGLGLSLDHGRMASSGDSAFIHLIGDDIDLELQRQDAEIDRFLKVQSDRMRQAILEKVQASQLQTMSLLEDKVLRQLRDKEVEVESINKKNMELEERMEQLTVEAGAWQQRAKYNENMITALKFSLQRVYAQSRDSKEGCGDSEVDDTASCCNGRAIDFHLLCKENNDMRELMTCKVCKVNGVCMLLLPCKHLCLCKDCESKFSFCPLCQSSKFIGMEVYM

SEQ ID NO: 1771 - protein, 286 aa, Vitis vinifera
  misc_feature: Public GI ID no. 157340580
  misc_feature (1)..(286): Bit score of 112.9 for HMM based on sequences of FIGURE 13.
  misc_feature: Functional Homolog Of SEQ ID NO. 1047
MAIQAQLYSENLGFSLGGSQEWVDNGCVGFNGSCFNLQQHQQQYMQQLQSQQEQIQSQRNYQNFFLDNSLMGSTLKNSPNYGSSHSLASQFDNQRQEIDQFITLQSERLRLVLQEQRKQQLAALMRKVESKALALLRQKDEEIAKATNRAMELEDFLRKLEMENQAWQRVAKENEAKVMSLNHTIEQIKEKACGIFSEDAESCCDDNMGNREEGTGENRRGGGGEGEEHEEDSTSNMVCRGCNSRNSCVLLLPCRHFCSCKACEGFFDHCPVCQTEKKGWIEARIF

SEQ ID NO: 1772 - protein, 364 aa, Vitis vinifera
  misc_feature: Public GI ID no. 157342198
  misc_feature (1)..(364): Bit score of 185.9 for HMM based on sequences of FIGURE 13.
  misc_feature: Functional Homolog Of SEQ ID NO. 1047
MLLLLLLSLLTVIGLINSWNYRVVFNCNRNMFGGNNNNPVFPVFLEENRYQYDTNAMPQLQLFGDFPVGCGGNPLNYMRNDHANALHGPIKRSREAESFSRHQKLHISLNNNNLCHDEAGQSGSILNPNPVSTGLKLSYEEDEHNSSITSASDSMTAALPVISSLGDNLKSEIDRQKEEFDHYIRVQEENIIKGVRELKQRQTVSFLSSIEKGVGKKLREKEFEIENMNRKNKELVERVKQVTMEVQSWHYRAKYNESLVNVLKSNLKQVLAQGAMQGKEGCGDSEVDDAASYTDHIQLGVVGCSGNPTSMKKQVNCRACKVREVSVLLLPCRHLCLCMDCEGFIDVCPVCRVMKTASVQVFMS

SEQ ID NO: 1773 - protein, 353 aa, Vitis vinifera
  misc_feature: Public GI ID no. 157358441
  misc_feature (1)..(353): Bit score of 163.2 for HMM based on sequences of FIGURE 13.
  misc_feature: Functional Homolog Of SEQ ID NO. 1047
MLGGSNSNHMLPVFLGESGFQCHTNASNQLQLFGNLPAGCGVDPVNYFGNELNTSMLQPNKRGREAEDFTRRQKLHISLNEAEEISRRQKHQISFKYNISQDEADRSASFLNQNPVSTGLKLSYDDDEHNSSVTSSGSMTAAPSIILSLGDSIGAELDRQKEEFDQYIKIQEEHLVKGVRNMRQRHMTSFLAPIEKVVRKKLREKDLELENMNRKNRELVERIKQAAVEAQNWHYKAKYNESVVNLLKNNLQHAISQGADQGKEGFGDSEVDDAASYIDPHNMVIPGGPGRANSQNKEGLKEQMICRACKSKEVSILLIPCRHLCICKECEGLISVCPVCQSMKTTGVQVYLS

SEQ ID NO: 1774 - protein, 283 aa, Arabidopsis thaliana
  misc_feature: Public GI ID no. 186478335
  misc_feature (1)..(283): Bit score of 118.6 for HMM based on sequences of FIGURE 13.
  misc_feature: Functional Homolog Of SEQ ID NO. 1047
MIRPNKRGREAESISNNIQRQQQKLQMSLNYNYNNTSVREEVPKENLVSTGLRLSYDDDEHNSSVTSASGSILAASPIFQSLDDSLRIDLHRQKDEFDQFIKIQAAQMAKGVRDMKQRHIASFLTTLEKGVSKKLQEKDHEINDMNKKNKELVERIKQVAMEAQNWHYRAKYNESVVNVLKANLQQAMSHNNSVIAAADQGKEGFGDSEIDDAASSYIDPNNNNNNNMGIHQRMRCKMCNVKEVSVLIVPCRHLSLCKECDVFTKICPVCKSLKSSCVQVFFS

SEQ ID NO: 1775 - protein, 335 aa, Nicotiana alata
  misc_feature: Public GI ID no. 187942401
  misc_feature (1)..(335): Bit score of 628.6 for HMM based on sequences of FIGURE 13.
  misc_feature: Functional Homolog Of SEQ ID NO. 1047
MALPHHHLQLHSIQQQQQQSNSFRDIYNNMDGQISTPVAYFNGSNLPEQSQHPPYIPAFQVVGLAPGPADEGGLDLQWNYGLEPKKRRLKEQDFLENNNSQISSVDFLQQRSVSTGLGLSLDNGRLGSCGDSAFLGLVGDDIERELQRQDADIDRYIKVQGDRLRQAILEKVQANQLQTITCVEEKVIQKLREKEAEVEDINKKNMELELRMEQLALEANAWQQRAKYNENLINTLKVNLQHVYAQSRDSKEGCGDSEVDDTASCCNGRATDFHLLCRDSNEMKELMTCKVCRVNEVCMLLLPCKHLCLCKECESKLSLCPLCQSTKYIGMEVYV

SEQ ID NO: 1776 - protein, 328 aa, Zea mays
  misc_feature: Public GI ID no. 194691922
  misc_feature (1)..(328): Bit score of 266.7 for HMM based on sequences of FIGURE 13.
  misc_feature: Functional Homolog Of SEQ ID NO. 1047
MAVHTQYLSHAFPYDHSTIRPALDNARNASVFISSAVVTRSRPNSVLSDLTGNNNNSNGCFLPRKRARVGDLAGATLNLDMQGQRALLPLVSAPVPLPLPAGDVQNRLLCSASASTSGHPTPSVAPVSQGLLSHLYRHGVEIDALVRIEKERLRAGLQEARRRHFRTVVLAAERAAARRLRAAEAELERAMLRNVALEETLRHTGAEGQAWQDIARRHEGVAAGLRATLDNLTQMQSPCAGAEAAGAAADGDAEDAQSCCFELEQEQGEGAEAYGGRARACRSCGQAEACVLLLPCRHLCLCRGCEAGVWACPVCAVTKNASLHVLLN

SEQ ID NO: 1777 - protein, 310 aa, Zea mays
  misc_feature: Public GI ID no. 194697422
  misc_feature (1)..(310): Bit score of 243.1 for HMM based on sequences of FIGURE 13.
  misc_feature: Functional Homolog Of SEQ ID NO. 1047
MAVHAQYHAHAFPHDLRAIPSCPALDNATSASAFLVADADPAPAAGGNTALSGLTRNGNSHGRGCLGGARKRARVTMDLQLQGQRALLPPVPQALASAGGVQSRALCSGSASTSQRPASAAPVSQGLLPHIYRHSVEIDLLLRVETERLQAGLQDARRRHARAVLSAVGRGAARRLRAAEAGLERALARNAELDDRLRQTVAEGQAWQGVAAGLRATLDSLTQAQAPCAGEGDVEDAQSCCFDLVEQEQGADEASGGRTRACRSCGDAEACVLLLPCRHLCLCRGCEAAAGEACPVCAATKNGSLHVLLS

SEQ ID NO: 1778 - protein, 323 aa, Zea mays
  misc_feature: Public GI ID no. 194703744
  misc_feature (1)..(323): Bit score of 349.5 for HMM based on sequences of FIGURE 13.
  misc_feature: Functional Homolog Of SEQ ID NO. 1047
MAVEAHRLLLAGGHRQQQQQQQLASAGWPWAGADEDRCATTARPSQHHHHQQQQPQQELRLHNASCVGVLAPRVSTIAAGGQMFLGDAAESDVTFGGGGAAARQEVTAVAPAPKRRKRAEQQQTPPVFQVCAADDVAAQFQQHIVDVNRLVFQQTANMWAALTELRRRQARQVVAAVEAAAATRLRAREEEVQRTARINGTLEERARSLYVEAQLWRDLARANEATANELRAELQQALDDQRTRGAPGAGADADDAGSCCRGGEDGGTGTSLARTCAVCGLSAADVLLLPCRHLCACAPCAGAARACPACGCAKNGSVCVNFS

SEQ ID NO: 1779 - DNA, 1116 bp, Oryza sativa
  misc_feature: Ceres Annot ID no. 1731456
  misc_feature: Encodes the peptide sequence at SEQ ID NO. 1780
atgatggagttgcgcaagtactggggcgtcggcgggcggcggtgcggtgcgtgcgaggcgtcgccggcggccgtgcactgccgcggctgcggcggggtgtacctgtgcacggcgtgcgacgcgcgcccgggccacgcgcgggcggcgcacgagcgggtgtgggtgtgcgaggtctgcgaggtggcgcccgccgccgtcacctgcaaggccgacgccgcggtgctctgcgccgcctgcgacgccgacatccacgacgccaacccgctggcccgccgccacgcgcgcgtccccgtcgcgcccatcggctccgccgccgccgccgccgtggccgccgaggccatgctgttcggcgtcgccgccgccggggccgaggccgaggcggtggaggataaggccgcggccgagcaccaccaccaccagcagcggcagcagcacggcgcgctcaacctcaacgtggaggcgaaggacatgaagctcgactacctcttctccgacctcgacccttacctcaacgtcgagttcgcccgcttcccccacgccgacagcgtcgtccccaacggcgccggcgccggcgccgccatagagctcgacttcacctgcggcctaggcgtcggcgtcggcggcgccaagcagtcctacagctcctacaccgccaccgacctcgctcacagcggctcgtcgtcggaggtgggcgtggtgccggaggccatgtgcggcggcggcggcgccatcgatctcgacttcacgaggccgaagcctcaaccctacatgccgtacacggcgactcctcctccgagccacagcgtagtaagcgcgcagatgtcgtcgtcggtggtcgacgtgggcgtggtgccggagcgggcggcggcgatgggggaagggagggaggcgaggctgatgaggtacagggagaagcggaagaaccggcggttcgagaagacgatccggtacgcgtcgcgcaaggcctacgccgagacgcgcccccggatcaagggccgcttcgccaagcgcgccgaccacgacgccgacgacgccgacgccgacgccgacgaccccgccgccgtcccatcctcctacatgctcgacttcggctacggcgtcgtcccgtccttctga

SEQ ID NO: 1780 - protein, 371 aa, Oryza sativa
  misc_feature: Ceres Annot ID no. 1731456
  misc_feature (1)..(371): Bit score of 282.2 for HMM based on sequences of FIGURE 6.
  misc_feature (295)..(339): Pfam Name: CCT Pfam Description: CCT motif
  misc_feature (51)..(98): Pfam Name: zf-B_box Pfam Description: B-box zinc finger
  misc_feature: Functional Homolog Of SEQ ID NO. 456
MMELRKYWGVGGRRCGACEASPAAVHCRGCGGVYLCTACDARPGHARAAHERVWVCEVCEVAPAAVTCKADAAVLCAACDADIHDANPLARRHARVPVAPIGSAAAAAVAAEAMLFGVAAAGAEAEAVEDKAAAEHHHHQQRQQHGALNLNVEAKDMKLDYLFSDLDPYLNVEFARFPHADSVVPNGAGAGAAIELDFTCGLGVGVGGAKQSYSSYTATDLAHSGSSSEVGVVPEAMCGGGGAIDLDFTRPKPQPYMPYTATPPPSHSVVSAQMSSSVVDVGVVPERAAAMGEGREARLMRYREKRKNRRFEKTIRYASRKAYAETRPRIKGRFAKRADHDADDADADADDPAAVPSSYMLDFGYGVVPSF

SEQ ID NO: 1781 - DNA, 1077 bp, Solanum lycopersicum
  misc_feature: Ceres Annot ID no. 8457547
  misc_feature: Encodes the peptide sequence at SEQ ID NO. 1782
atgggaacggagaattggagtttaacggcgaagttatgtgactcatgcaaaacgtcgccggcgacggtgttctgccgggcagattcagcatttctctgcttaggatgtgactgcaaaatccacgcagcgaacaagttagcgtcacgtcacgcgcgtgtctgggtttgtgaagtgtgtgagcaagctccggcgagtgtcacgtgtaaagcggatgccgctgctctctgcgttacgtgtgaccgtgatattcattcagcaaatccgttagctcgtcgccatgagcgttttccggtagttccgttctatgatttcgccgtcgcgaaatctcacggcggtggtgataccgatgccgatgctgttgatgatgagaagtactttgatagtactaatgagaatccttctcaaccagaggaagaagctgaagcagcgtcgtggatacttccgacgccgaaagaaggaactgatcagtataaatctgctgattacttgtttaatgatatggattcatatttagatatagatctaatgtcatgtgagcaaaaaccacatattcttcatcatcaacagcatcaacacaaccattacagctccgacggagttgtaccagtacagaacaacaacgaaactactcatttacccggtccagtcgttgatggattccctacatacgaactcgatttcactggatctaaaccttatatgtacaatttcacctctcaatcgatcagccaaagtgtttcatcatcatctcttgacgtcggagttgtaccagaccacagcacaatgacggatgtatcaaacacttttgtgatgaactcatcttccggtgctattgccggcgccggcgccgacgttgtaccgaatgcagtttccggtttagacagagaagcaagggtaatgaggtacagagagaagaggaagaatagaaagttcgagaagacgattcgatatgcttctagaaaagcttatgctgagactcggcccagaatcaaagggagattcgctaaacgtactgaaactgaaatcgattcactcatcaccgtcgatgcatcatacggtgtcgttccatcgttttaa

SEQ ID NO: 1782 - protein, 358 aa, Solanum lycopersicum
  misc_feature: Ceres Annot ID no. 8457547
  misc_feature (1)..(358): Bit score of 570.4 for HMM based on sequences of FIGURE 6.
  misc_feature (295)..(339): Pfam Name: CCT Pfam Description: CCT motif
  misc_feature (56)..(98): Pfam Name: zf-B_box Pfam Description: B-box zinc finger
  misc_feature (8)..(55): Pfam Name: zf-B_box Pfam Description: B-box zinc finger
  misc_feature: Functional Homolog Of SEQ ID NO. 456
MGTENWSLTAKLCDSCKTSPATVFCRADSAFLCLGCDCKIHAANKLASRHARVWVCEVCEQAPASVTCKADAAALCVTCDRDIHSANPLARRHERFPVVPFYDFAVAKSHGGGDTDADAVDDEKYFDSTNENPSQPEEEAEAASWILPTPKEGTDQYKSADYLFNDMDSYLDIDLMSCEQKPHILHHQQHQHNHYSSDGVVPVQNNNETTHLPGPVVDGFPTYELDFTGSKPYMYNFTSQSISQSVSSSSLDVGVVPDHSTMTDVSNTFVMNSSSGAIAGAGADVVPNAVSGLDREARVMRYREKRKNRKFEKTIRYASRKAYAETRPRIKGRFAKRTETEIDSLITVDASYGVVPSF

SEQ ID NO: 1783 - DNA, 1125 bp, Sorghum bicolor
  misc_feature: Ceres Annot ID no. 8671780
  misc_feature: Encodes the peptide sequence at SEQ ID NO. 1784
atggaggccctggtggcggggaggtactggggtgtcgggggacggcggtgcgaggcgtgcgggggctcgccggcggcggtgcactgccggacgtgcccgggcggcggggcgtacctgtgcgcggggtgcgacgcgggccacgcgcgggccgggcacgagagggtgtgggtgtgcgaggtgtgcgagcgcgcgccggccgccgtcacgtgccgcgccgacgcggccgcgctctgcgccgcgtgcgacgccgacatccacgacgcgaacccgctggcgcgccgccacgagcgcgtgcccgtgcagcccatcggcgcggccgcggccgcgcccgccgcggagacgctgctgttcggcgccgccgcggaagagaatcaggacgacgacgacggcgccgccgcggcggctaaggtcgtcggcgtcgacgccggtaagctggcggacttcctgttcgcggacgtcatggacccgttcttcggccaagacttcactggtggcaccaggttcccgcacgccgacagcgttgtgcctaaccagggatcctgcggcgccgtcgctgccaagccgtcctacagctcctacaccgcggcgtcgctcggccacagcggctcgtcgtcggaggtcggcctggtcccagacgcgatgtgcggccgcggcgggagcgtgaccggcggcgtcatcgagctcgacttcgcgcagtccaaggccgcctacctgccttacgctgcaactccgacccacagtatgtcatctttggacgtgggtgcggtgccggaacgcggtgacggggtcatggcgggcagggtcgcgacgccgccggcggcggcggccgcggagagcagggaggcgcggctgatgcggtaccgcgagaagcggaagaaccggcggttcgagaagacgatccgctacgcgtcccggaaggcctacgcggagtcgcggccgcgcatcaagggccgcttcgcgaagcgcgcggacgacaacgacgccgacgccgacgccgacttcgacttcgacgcgggtgccgcggcggcgacggcgccggcgcggtcgcggtcgcagcagcagcagccatcgtacccctatgtgctcgacttcgccgccggctacggcgtcgtgcccacattctga

SEQ ID NO: 1784 - protein, 374 aa, Sorghum bicolor
  misc_feature: Ceres Annot ID no. 8671780
  misc_feature (1)..(374): Bit score of 287.3 for HMM based on sequences of FIGURE 6.
  misc_feature (280)..(324): Pfam Name: CCT Pfam Description: CCT motif
  misc_feature (53)..(100): Pfam Name: zf-B_box Pfam Description: B-box zinc finger
  misc_feature: Functional Homolog Of SEQ ID NO. 456
MEALVAGRYWGVGGRRCEACGGSPAAVHCRTCPGGGAYLCAGCDAGHARAGHERVWVCEVCERAPAAVTCRADAAALCAACDADIHDANPLARRHERVPVQPIGAAAAAPAAETLLFGAAAEENQDDDDGAAAAAKVVGVDAGKLADFLFADVMDPFFGQDFTGGTRFPHADSVVPNQGSCGAVAAKPSYSSYTAASLGHSGSSSEVGLVPDAMCGRGGSVTGGVIELDFAQSKAAYLPYAATPTHSMSSLDVGAVPERGDGVMAGRVATPPAAAAAESREARLMRYREKRKNRRFEKTIRYASRKAYAESRPRIKGRFAKRADDNDADADADFDFDAGAAAATAPARSRSQQQQPSYPYVLDFAAGYGVVPTF

SEQ ID NO: 1785 - DNA, 990 bp, Sorghum bicolor
  misc_feature: Ceres Annot ID no. 8701721
  misc_feature: Encodes the peptide sequence at SEQ ID NO. 1786
atggagggcgacgagaagtcggcgggcggggccccggcgtactggggcctgggcgcgcggccctgcgacgcgtgcggcgccgatgcggcgcgcctctactgccgcgcggactcggcgttcctgtgcgccgggtgcgacgcgcgggcgcacggggccgggtcgcccaacgcgcgggtctggctctgcgaggtctgcgagcacgcgccggcggcggtcacgtgccgcgccgacgccgccgcgctctgcgcctcctgcgacgccgacatccactcggccaacccgctggcgcgacgccacgagcgcctccccgtggcgcccttcttcggcgcgctggccgacgcgcccaagcccttcgcctcgtcggcggcggccgtgccgcccaaagcgacggccggggccgacgacgacgggagcagcgaggccgaggcggcgtcgtggctcctccccgagcccgaccacgggcacaaagaagaaggcgccaccacggaggtgttcttcgcggactccgacccgtacctcgacctcgacttcgcgcgttccatggacgacatcaagaccatcggcgtccagggcgggccaccagagctcgacctcaacggcgccaagctcttctactccgaccactccatgaaccacagtgtgtcatcgtcggaggcagcggtggtgcccgacgcggcggctggcgcggcgcccgtggtggcagtggtcagcaggggcctggagcgggaggcgcggctgatgcggtaccgggagaagcgcaagagcaggcggttcgagaagacgatccggtacgcgtcccgcaaggcgtacgcggagacgcggccgcgcatcaagggccggttcgccaagcgcacgccgggggctggggaggacccgctggaggagcacgaggagatgtactcctcggccgcggcggccgtggctgcgctcatggcccccggcggagccgacgcggactacggcgtcgacggcgtcgtgcccacatattga

SEQ ID NO: 1786 - protein, 329 aa, Sorghum bicolor
  misc_feature: Ceres Annot ID no. 8701721
  misc_feature (1)..(329): Bit score of 443.5 for HMM based on sequences of FIGURE 6.
  misc_feature (242)..(286): Pfam Name: CCT Pfam Description: CCT motif
  misc_feature (57)..(104): Pfam Name: zf-B_box Pfam Description: B-box zinc finger
  misc_feature: Functional Homolog Of SEQ ID NO. 456
MEGDEKSAGGAPAYWGLGARPCDACGADAARLYCRADSAFLCAGCDARAHGAGSPNARVWLCEVCEHAPAAVTCRADAAALCASCDADIHSANPLARRHERLPVAPFFGALADAPKPFASSAAAVPPKATAGADDDGSSEAEAASWLLPEPDHGHKEEGATTEVFFADSDPYLDLDFARSMDDIKTIGVQGGPPELDLNGAKLFYSDHSMNHSVSSSEAAVVPDAAAGAAPVVAVVSRGLEREARLMRYREKRKSRRFEKTIRYASRKAYAETRPRIKGRFAKRTPGAGEDPLEEHEEMYSSAAAAVAALMAPGGADADYGVDGVVPTY

SEQ ID NO: 1787 - DNA, 1131 bp, Sorghum bicolor
  misc_feature: Ceres Annot ID no. 8743875
  misc_feature: Encodes the peptide sequence at SEQ ID NO. 1788
atggagctgcacaagtactggggcgtgggtggccggcggtgcggcagctgcgaggcggcgccggcggcggtgcactgccgcacgtgcgtcggcgggtcgtcgtcgttcctctgcacgacgtgcgacgcgcgccccgcgcacgcgcgcctggcccacgagcgcgtgtgggtgtgcgaggtctgcgagctggcccccgccgccgtcacgtgcaaggccgacgccgccgtgctctgcgccgcctgcgacgccgacatccacgacgccaacccgctggcgcgccgccacgcgcgggtccccgtcgcgcccatcggctccgaggccgccgccgcggccgtcgaggccatgctgttcgggaccggcgacgcggccgaggccgacgaccagcacaacaacgcggcggcggcggccgagcagcatcagcatcagcaccacgctcaccacgcgcacgcgctgaacctcaacgtggaggcgaaggacatgaagctggactacctcttctctgagctggatccctacctcagcgtcgagatcccgcgcttccaccacgccgacagcgtcgtccccaacggcgccggcgctgccggcgccgtcgagctcgacttcacgtgcggcatcggcgtcaagcactcctcctacagctcctacaccgccacctccctcgatctcgcgcatagcggctcctcgtcggaggtcggcgtggtgccagaggccttcggcggcggcggcggcggcggcggcgggagctttgagctcgacttcacaaggccaaagcctcaggcctacatgccatacacggcgactccccagagccacagcgtgtcgtccgtggacgtggaggtggtgccggagcggggagacttgccggcggtgaggccggtgccgctgatgggggagagccgggaggcgcggctgatgcggtaccgtgagaagaggaagaaccggcggttcgagaagaccatccggtacgcgtcccggaaggcctacgccgagacgcggccgcggatcaaggggaggtttgccaagcgcgccgaccacgacggcgacggcgacgccgacgacgccgaggccgaggccgccgtgccgtcgtcgtacgtgctcgacttcggctacggcgtcgtgccgagcttctga

SEQ ID NO: 1788 - protein, 376 aa, Sorghum bicolor
  misc_feature: Ceres Annot ID no. 8743875
  misc_feature (1)..(376): Bit score of 297.9 for HMM based on sequences of FIGURE 6.
  misc_feature (300)..(344): Pfam Name: CCT Pfam Description: CCT motif
  misc_feature (53)..(100): Pfam Name: zf-B_box Pfam Description: B-box zinc finger
  misc_feature: Functional Homolog Of SEQ ID NO. 456
MELHKYWGVGGRRCGSCEAAPAAVHCRTCVGGSSSFLCTTCDARPAHARLAHERVWVCEVCELAPAAVTCKADAAVLCAACDADIHDANPLARRHARVPVAPIGSEAAAAAVEAMLFGTGDAAEADDQHNNAAAAAEQHQHQHHAHHAHALNLNVEAKDMKLDYLFSELDPYLSVEIPRFHHADSVVPNGAGAAGAVELDFTCGIGVKHSSYSSYTATSLDLAHSGSSSEVGVVPEAFGGGGGGGGGSFELDFTRPKPQAYMPYTATPQSHSVSSVDVEVVPERGDLPAVRPVPLMGESREARLMRYREKRKNRRFEKTIRYASRKAYAETRPRIKGRFAKRADHDGDGDADDAEAEAAVPSSYVLDFGYGVVPSF

SEQ ID NO: 1789 - DNA, 1240 bp, Brassica napus
  misc_feature: Ceres Clone ID no. 1040847
  misc_feature: Encodes the peptide sequence at SEQ ID NO. 1790
agaaaggaatgagaaacacagttagagagagctctgtgacaaactcagtccggtcggcgatgagaaacagagtacgataacatctaataggatcaagaagacgaaacacatggaatcaacttccatatacaagtctccttcaaatctcgaaacgtctcgtactcgtaagctcagaaagaacacgaaaaagctcaaatttctcagcctcaagctcgaactcacgaaacagagcaagacgaaaggagctgatacgacgccgtctaaggagaagaaaagagcggagactgtgggagaagagaaagaagaagagcttgcagcttacctctttaactccgccaacgacagtacattctcttcgatcaacgatctcctcccttcctcctcctcggccgtccggttagactgcgacggagaaaagaacctgtctccgtacgataggcaggagcacgtgtcgtcttcttcttcttcttcgcttctaaggacggcgatgaagaaaggagcgagcgaggagggagagacgacggaggagcggtgggtgagttattcggaggtgatgagtcggagcggaactccacggtgttgcggcggagatggaaacgacggacggtcctcgctggctttgaagcttgattatgagcagatcatggaggcttggttggataaagggactctttatgtcgacggagaaccgccgcagacggtgccggacttgcatgcttccgctgacgtgtttacaagcggcggagaggcattatgggcggtgccggagatggagacaatggagaggttatggagagtgcatagagaagctagtttgcttcggtataaagagaaacggcaaagcctccttttctctaagcggattcgataccaagttcgtaagctcaacgctgagaaacgtcctcgtattaaaggccggtttgtgaagagagatgatttatagaccactaaaaactggtggtttggacttgcgggttgttggacaaactactagtcttttcgaaataaccaagcagcggatgtttggtagtataatattagagacggtagggccgaaccggagaataccgagatatgaaaggtgttggtctgtataggggtattgaccagctcggttatgcagaagtttcggtttgtttgcccgttttagttctattatcatagaaaacttttaactaatcttgtaccaaatcatctgaacgaataataataatgaaagtggatattaacgtttagagat

SEQ ID NO: 1790 - protein, 277 aa, Brassica napus
  misc_feature: Ceres Clone ID no. 1040847
  misc_feature (1)..(277): Bit score of 184.1 for HMM based on sequences of FIGURE 6.
  misc_feature (232)..(276): Pfam Name: CCT Pfam Description: CCT motif
  misc_feature: Functional Homolog Of SEQ ID NO. 456
MESTSIYKSPSNLETSRTRKLRKNTKKLKFLSLKLELTKQSKTKGADTTPSKEKKRAETVGEEKEEELAAYLFNSANDSTFSSINDLLPSSSSAVRLDCDGEKNLSPYDRQEHVSSSSSSSLLRTAMKKGASEEGETTEERWVSYSEVMSRSGTPRCCGGDGNDGRSSLALKLDYEQIMEAWLDKGTLYVDGEPPQTVPDLHASADVFTSGGEALWAVPEMETMERLWRVHREASLLRYKEKRQSLLFSKRIRYQVRKLNAEKRPRIKGRFVKRDDL

SEQ ID NO: 1791 - DNA, 1350 bp, Panicum virgatum
  misc_feature: Ceres Clone ID no. 1755065
  misc_feature: Encodes the peptide sequence at SEQ ID NO. 1792
aaccatttccgacgcagaacccccgggggccggaatccgtgacacccacccggaggagagcagagcagaggcatcaggcatggccgccgcggtggagctggagcagaagccggcggtggggtactggggcgtggccggcgcgcggccctgcgacgcgtgcgccgcggagccggcgcggctgcactgccgcgcggacggcgcgttcctgtgccccgggtgcgacgcccgcgcgcacggcgccgggtcgcgccacgcgcgcgtctggctctgcgaggtctgtgagcacgctcccgccgccgtcacgtgccgcgccgacgccgccgcgctctgcgcggcctgcgacgccgacatccactcggccaacccgctcgcgcgccgccacgagcggctccccgtcgcgcccttcttcggcgcgctcgccgacgcgccgcagccgttcccgtccgcggccttcgccaccgcggggggccagtcccagggggacgcggcggcggcggcggcggcggacgacgacgggagcaacgaggccgaggccgcctcatggctcctccccgagcccgacaccagccacgaggacagcgcagccgccaccgacgccttcttcgcggactccgacaagtacctcggcgtcgacctcgacttcgcccggtccatggacggcatcaaggccatcggcgtcccggtcgcgccgccggagctggacatcgccgctggcgctttctactaccccgaacactccatgaaccatagcgtgtcgtcatcagaggtggcggtcgtgccggacgtgctggcgggcggcgtcccggcggtgccggtggcgagccgggggaaggagcgggaagcgcggctgatgcggtaccgcgagaagcgcaagaaccggcggttcgacaagaccatccggtacgcgtcccgcaaggcgtacgccgagacgcggccgcgcatcaagggccgcttcgccaagcgctgctccgccgaggccgaggacgaggacgaggcgctgctggagcacgaggaaggggcgtgcttctcgcccgcggtgtcggcccccgcggcctcggacggcgtcgtcccgtccttctgctaagggggacgacgggtggcggccgcgcctcctcctcctccccggctcccaggcggcaaccccttaattttgccgactctgaatcgacccccaacgcatgccaacatgcgaatgcgatgcgcgcgctccgtgtagcataataattgtacagcagctcgtccgacgcaacgagctcaatcgcggtcgcacggaacgcctgtaatcctcctcaccatccgtgtaatccagccttgtacattaccatctagaggtgtttgtgcttctcttgc

SEQ ID NO: 1792 - protein, 334 aa, Panicum virgatum
  misc_feature: Ceres Clone ID no. 1755065
  misc_feature (1)..(334): Bit score of 438.2 for HMM based on sequences of FIGURE 6.
  misc_feature (253)..(297): Pfam Name: CCT Pfam Description: CCT motif
  misc_feature (64)..(106): Pfam Name: zf-B_box Pfam Description: B-box zinc finger
  misc_feature (19)..(63): Pfam Name: zf-B_box Pfam Description: B-box zinc finger
  misc_feature: Functional Homolog Of SEQ ID NO. 456
MAAAVELEQKPAVGYWGVAGARPCDACAAEPARLHCRADGAFLCPGCDARAHGAGSRHARVWLCEVCEHAPAAVTCRADAAALCAACDADIHSANPLARRHERLPVAPFFGALADAPQPFPSAAFATAGGQSQGDAAAAAAADDDGSNEAEAASWLLPEPDTSHEDSAAATDAFFADSDKYLGVDLDFARSMDGIKAIGVPVAPPELDIAAGAFYYPEHSMNHSVSSSEVAVVPDVLAGGVPAVPVASRGKEREARLMRYREKRKNRRFDKTIRYASRKAYAETRPRIKGRFAKRCSAEAEDEDEALLEHEEGACFSPAVSAPAASDGVVPSFC

SEQ ID NO: 1793 - DNA, 1283 bp, Panicum virgatum
  misc_feature: Ceres Clone ID no. 1756710
  misc_feature: Encodes the peptide sequence at SEQ ID NO. 1794
agcagccactacaagctgccgtgccgagtgagctagtgagcgagcgagctcccggcgcgcgatggagggtgacaagaagtcggcgggcggggccccggcctactggggcctgggcgcgcggccctgcgacgagtgcggcgccgaggcggcgcggctctactgccgcgcggacgcggcgttcctctgcgccgggtgcgacgcgcgcgcgcacggcgccgggtcgcgccacgcccgcgtctggctgtgcgaggtctgcgagcacgcgccggccgccgtcacgtgccgcgcggacgccgccgcgctctgcgcctcctgcgacgccgacatccactccgccaacccgctcgcgcgccgccacgagcgccagaccgtggcgcccttctacggcgcgctcgccgacgcgcccaagcccttcgcctcgtcggtggccgtgcccaaagcggccgacgacgacggaagcaacgaggccgaggcggcgtcgtggctcctccccgagcccgaccacgggcacaaggaaggcgccacgacggaggtgttcttcgcggactccgacccgtacctcgacctcgacttcgcgcgcaccatggacgacatcaaggccatcggcgcccagaacggccccgccggcgccgagctcgacctcaccggcgccaagctcttctactccgaccactccatgaactacagcgtgtcgtcgtcggaggcagcggtggtgcccgacgcggcggcgggcgcggcgcccgtcgtgcctgtggtgagcaggggcctggagcgggaggcccggctgatgcggtaccgggagaagcgcaagagccggcggttcgagaagacgatccggtacgcgtcccgcaaggcgtacgcggagacgcggccgcgcatcaagggccggttcgccaagcgcaccccggggcccggcgcggacggggaggacccgctggaggagcacgaggaggagatgtactcctccgccgcggccgccgtggccgcgctcatggcccccggcggcgccgacgccgactacggcgtcgtgcccacgtattgatcggcgccggcctgctgtacactagctagcctcgacctctcggggctgtaatttttgctgcatgccttgcatgcaaaaagctgccgtgtagcattgattacctgtaatatgattccacggaagccatgaggctggacttccaagctcttcttcctccctaatgattccgtcatgtacggatgtatattattattatttatcacgaactgctgctaatctgcaactgtaatttctaattagc

SEQ ID NO: 1794 - protein, 326 aa, Panicum virgatum
  misc_feature: Ceres Clone ID no. 1756710
  misc_feature (1)..(326): Bit score of 433.2 for HMM based on sequences of FIGURE 6.
  misc_feature (238)..(282): Pfam Name: CCT Pfam Description: CCT motif
  misc_feature (62)..(104): Pfam Name: zf-B_box Pfam Description: B-box zinc finger
  misc_feature (17)..(61): Pfam Name: zf-B_box Pfam Description: B-box zinc finger
  misc_feature: Functional Homolog Of SEQ ID NO. 456
MEGDKKSAGGAPAYWGLGARPCDECGAEAARLYCRADAAFLCAGCDARAHGAGSRHARVWLCEVCEHAPAAVTCRADAAALCASCDADIHSANPLARRHERQTVAPFYGALADAPKPFASSVAVPKAADDDGSNEAEAASWLLPEPDHGHKEGATTEVFFADSDPYLDLDFARTMDDIKAIGAQNGPAGAELDLTGAKLFYSDHSMNYSVSSSEAAVVPDAAAGAAPVVPVVSRGLEREARLMRYREKRKSRRFEKTIRYASRKAYAETRPRIKGRFAKRTPGPGADGEDPLEEHEEEMYSSAAAAVAALMAPGGADADYGVVPTY

SEQ ID NO: 1795 - DNA, 1549 bp, Panicum virgatum
  misc_feature: Ceres Clone ID no. 1769510
  misc_feature: Encodes the peptide sequence at SEQ ID NO. 1796
ctccctccactacgccgcgcgcgctccctcccacccctcccctccaccaccacaagcaccgcgtcgacaccacctgccatcgccgcgccgagctcagcctctagctagctgcgccaggagggcgcccgcctcgctccctccctgccgacgccagtgcgatggagctgcataagtactggggcgtggggggccggcggtgcggcgactgcgaggcggccccggcggcggtgcactgccgctcgtgccccgccaccgccgggggcgcgttcctctgcgctgcgtgcgacgcgcgcccggggcacgcgcggctgggccacgagcgcgtgtggatgtgcgaggtctgcgagctggcccccgccgccgtcacctgcaaggccgacgccgccgtgctctgcgccgcctgcgacgccgacatccacgacgccaacccgctggcgcgccgccatgcgcgcgtccccgtcgcgcccatcgggtccgaggccgccgcctccgccgtcgaggccatgctgttcgggaccggcgacggcgacccggccgcgcccgaggccgaggagccgcaggacgcggcggccgggcacgggcacgggcagctccagcaccaccaccagcacgcgctgaacctcaacgtggaggccaaggacatgaagctggactacctcttctccgacctggacccctacctcagcgtcgacatcccgcgcttccagcacgccgacagcgtcgtccccagcggcgtcggcgccggagccgccgccggcgccgtcgagctggacttcacgtgcggcatcggcgtcaagccctcctcgtacagctcctacacggcaacatccttcgcccacagcggctcctcctctgaggtcggcgtggtgccggaggccttctgcggcggcggcgccgggaccttcgagctcgacttcacccggcccaagcctcaagcctacatgccgtacaccgcgactcctcagagccacagcgtgtcgtcggtggacgtggaggtggcggcggcggagcggggggacatggcggcggcgaggccggtgccgctggtgggggagagccgggaggcgcggctgatgcgctaccgggagaagcggaagaaccggcggttcgagaagaccatccggtacgcgtcccggaaggcctacgccgagacgcggccgcggatcaagggccggttcgccaagcgcgccgaccacgacgccgacgacgccgaggccgaggccgccgtgccgtcgccggcgtcgtacgtgctcgacttcggctacggcgtcgtgcccagcttctgatcgatcgacgacggtccggcgggcggcggcgcgcctgacccggcactggcgcgcgcgccttgtgtacttgtatcgatgcatgatgtataggggaggaatagtaaatcccatgtactactctctttttggagctgtgctagccttgcgcacgctagtgatgtataatttgtatactacgcgctgctacttactactagcatgttcttgctggaattagccccggctatttttgaatcaaatctatgcaagaaatttgtaacggt

SEQ ID NO: 1796 - protein, 375 aa, Panicum virgatum
  misc_feature: Ceres Clone ID no. 1769510
  misc_feature (1)..(375): Bit score of 289.8 for HMM based on sequences of FIGURE 6.
  misc_feature (301)..(345): Pfam Name: CCT Pfam Description: CCT motif
  misc_feature (54)..(101): Pfam Name: zf-B_box Pfam Description: B-box zinc finger
  misc_feature: Functional Homolog Of SEQ ID NO. 456
MELHKYWGVGGRRCGDCEAAPAAVHCRSCPATAGGAFLCAACDARPGHARLGHERVWMCEVCELAPAAVTCKADAAVLCAACDADIHDANPLARRHARVPVAPIGSEAAASAVEAMLFGTGDGDPAAPEAEEPQDAAAGHGHGQLQHHHQHALNLNVEAKDMKLDYLFSDLDPYLSVDIPRFQHADSVVPSGVGAGAAAGAVELDFTCGIGVKPSSYSSYTATSFAHSGSSSEVGVVPEAFCGGGAGTFELDFTRPKPQAYMPYTATPQSHSVSSVDVEVAAAERGDMAAARPVPLVGESREARLMRYREKRKNRRFEKTIRYASRKAYAETRPRIKGRFAKRADHDADDAEAEAAVPSPASYVLDFGYGVVPSF

SEQ ID NO: 1797 - DNA, 1251 bp, Panicum virgatum
  misc_feature: Ceres Clone ID no. 1770031
  misc_feature: Encodes the peptide sequence at SEQ ID NO. 1798
agcgagctcccggcgcgcgataatggagggtgacgagaagtcggcaggcggggccccggccccggcctactggggcctgggcgcgcggccctgcgacgcgtgcggcgacgaggcggcgaggctctactgccgcgcggacgcggcgttcctctgcgccgggtgcgacgcgcgcgcgcacggcgccgggtcgcgccacgcccgcgtctggctctgcgaggtctgcgagcacgcgccggccgcggtcacgtgccgcgcggacgccgccgcgctctgcgcctcgtgcgacgccgacatccactccgccaacccgctcgcgcgccgccacgagcgccaggccgtggcgcccttctacggcgcgctggccgacgcgcccaagcccttcgcctcgtcggcggccgtgcccaaagcggccgacgacgacgggagcaacgaggccgaggcggcgtcgtggctcctccccgagcccgaccacgggctcaaggaaggcgccacgacggaggtgttcttcgcggactccgacccgtacctcgacctcgacttcgcgcgcaccatggacgacatcaaggccatcggcgtccagaacggccccgccgagctcgacctcaccggcgccaagctcttctactccgaccactccatgaaccacagcgtgtcgtcatcggaggcagcagtggtgcccgacgcggcggcgggcgcggcgcccgtggttccagtggtgagcaggggtctggagcgggaggcccggctgatgcggtaccgggagaagcgcaagagccggcggttcgagaagacgatccggtacgcgtcccgcaaggcgtacgcggagacgcggccgcgcatcaagggccggttcgccaagcgcacccccgggcccggcggcgcggacggggaggacccgctggaggagcacgaggaggagatgtactcctccgccgcggcagccgtggccgcgctcatggtccccggcggcgccgacgccgactacggcgtcgtgcccacgtattgatcggcgccggcctgttgtaacactagccagcctcgacctcgccgccggggctgtaatttttgctgcatgccctgcatgcaaagctgccgtgtagcattaattacctgtaatatgattccacggaagccatcaggccggacttccaagctattcttcctccctaatcattccgccatgtatgtatattattatgagtaaattgcactcatcatacaataaattgacagatagatacaaattgatcc

SEQ ID NO: 1798 - protein, 327 aa, Panicum virgatum
  misc_feature: Ceres Clone ID no. 1770031
  misc_feature (1)..(327): Bit score of 437.8 for HMM based on sequences of FIGURE 6.
  misc_feature (238)..(282): Pfam Name: CCT Pfam Description: CCT motif
  misc_feature (19)..(63): Pfam Name: zf-B_box Pfam Description: B-box zinc finger
  misc_feature (64)..(106): Pfam Name: zf-B_box Pfam Description: B-box zinc finger
  misc_feature: Functional Homolog Of SEQ ID NO. 456
MEGDEKSAGGAPAPAYWGLGARPCDACGDEAARLYCRADAAFLCAGCDARAHGAGSRHARVWLCEVCEHAPAAVTCRADAAALCASCDADIHSANPLARRHERQAVAPFYGALADAPKPFASSAAVPKAADDDGSNEAEAASWLLPEPDHGLKEGATTEVFFADSDPYLDLDFARTMDDIKAIGVQNGPAELDLTGAKLFYSDHSMNHSVSSSEAAVVPDAAAGAAPVVPVVSRGLEREARLMRYREKRKSRRFEKTIRYASRKAYAETRPRIKGRFAKRTPGPGGADGEDPLEEHEEEMYSSAAAAVAALMVPGGADADYGVVPTY

SEQ ID NO: 1799 - DNA, 1357 bp, Panicum virgatum
  misc_feature: Ceres Clone ID no. 1996408
  misc_feature: Encodes the peptide sequence at SEQ ID NO. 1800
aaaaacacccccgaggccaaccatttccgacgcaaaaccccccggaatccgtgacacccgcccggaggagagcagagcagaggcaccaggcatggacgccgcggtggagctggagctggagcagaagccggcggtggggtactggggcttggccggcgcgcggccctgcgacgcgtgcgccgcggaggcggcgcggctgcactgccgcgcggacggcgccttcctgtgccccgggtgcgacgcccgcgcgcacggcgccgggtcgcgccacgcgcgcgtctgtctctgcgaggtctgcgagcacgcccccgccgccgtcacgtgccgcgccgacgccgccgcgctctgcgcggcctgcgacgccgacatccactcggccaacccgctcgcgcgccgccacgagcggctccccgtcgcgcccttcttcggcgcgctcgccgacgcgccgcagccgttcccgtcctcagccttcgccgccgcgggggtccaggcccagggggacgcggctgcggacgacgacgggagcaacgaggccgaggccgcctcgtggctcctccccgagcccgacaactgccacgaggacagcgccgccgccaccgacgccttcttcgctgactccgacgcgtacctcggcgtcgacctcgacttcgcccggtccatggacggcatcaaggccatcggcgtgccggtcgcgccgcccgagctggacatggccaccggcggttactactaccccgaacactccatgaaccacagcgtgtcgtcgtcggaggtggcggttgtgccggacgcgctggcgggcggcgccccggccgcgccggcggtgccggcggcgagccgggggaaggagcgggaggcgcggctgatgcggtaccgcgagaagcgcaagaaccggcggttcgacaagaccatccggtacgcgtcccgcaaggcgtacgccgagacgcggccgcgcatcaagggccgcttcgccaagcgctgctcctccgcggaggccgaggccgaggacgaggcgctgctggagcacgaggaagcggcgtgcttctcgcccgcggcgtcggcgcccgcggcctcctcggacggcgtcgtcccgtcctgctgaggggacacgacgggcggcggccgcgcctcctcctcccaggctccccggcggcgaccccttaattttgccgactctgaatcgatcccaacgcatgcgaacatgcgatgcgatgcgcgctccgtgcagcacatgaataattgtacagtagttccacgaactcgatcgtggtcgcacggaatcgcatgtaatcctcctcaccgtccttgtaatccagccttgtacattaccgtctagaggtgtttgtgcttctctcgc

SEQ ID NO: 1800 - protein, 336 aa, Panicum virgatum
  misc_feature: Ceres Clone ID no. 1996408
  misc_feature (1)..(336): Bit score of 423.2 for HMM based on sequences of FIGURE 6.
  misc_feature (254)..(298): Pfam Name: CCT Pfam Description: CCT motif
  misc_feature (66)..(108): Pfam Name: zf-B_box Pfam Description: B-box zinc finger
  misc_feature (21)..(65): Pfam Name: zf-B_box Pfam Description: B-box zinc finger
  misc_feature: Functional Homolog Of SEQ ID NO. 456
MDAAVELELEQKPAVGYWGLAGARPCDACAAEAARLHCRADGAFLCPGCDARAHGAGSRHARVCLCEVCEHAPAAVTCRADAAALCAACDADIHSANPLARRHERLPVAPFFGALADAPQPFPSSAFAAAGVQAQGDAAADDDGSNEAEAASWLLPEPDNCHEDSAAATDAFFADSDAYLGVDLDFARSMDGIKAIGVPVAPPELDMATGGYYYPEHSMNHSVSSSEVAVVPDALAGGAPAAPAVPAASRGKEREARLMRYREKRKNRRFDKTIRYASRKAYAETRPRIKGRFAKRCSSAEAEAEDEALLEHEEAACFSPAASAPAASSDGVVPSC

SEQ ID NO: 1801 - DNA, 1320 bp, Glycine max
  misc_feature: Ceres Clone ID no. 472076
  misc_feature: Encodes the peptide sequence at SEQ ID NO. 1802
tcttcactctcagaacactaactcccccaatgttggagggccaagcaacaacgcccacgtggccgcgcatgtgcgacacgtgccgctccgtcccctccaccgtcttctgccgctcccacaccgcctttctctgcgccacgtgcgacactcgcctccacgtctcgctcacgtggcacgagcgcgtgtgggtgtgcgaggcgtgcgagcgcgccccggcggcgttcctctgcaaggccgacgccgcctccctctgcgcctcctgcgacgccgacatccacgccgccaaccccctcgccagccgccaccaccgcgtccccatcctccccatcgccgccgccaacaacaacaacaacgacgacgacgacgttgctgacgttgacgacgaagacgaaaccgcttcatggctcttgctcaaccctatcaagagtgctactgtccctaacaccaataacaataacaataataacgggttcttgtataacggtgaggttgatgagtatttggaccttgttgataattgtaactcttgtggtgataataatcacttcgcttcagctgctgctactactgatcattacgctcagcaccaacatttcgctggtgtttctcagaagagttatgctggggacagtgttgttccggttcagcaacaccagcattttcagcttgggttggactttgacaactccaaacctgccttcagttacaatggttctgttagtcaaagtgtttcagtttcatcaatggatattggtgttgtacctgaatcaccaatgagggatgtctcaattgcccatacaagaccccccaaagggacaattgacctattttctggacctccaattcaggtgccttcccatttttctccaatggacagggaggccagagtcctaaggtacagggagaaaaagaagatgagaaaatttgagaagacaatcaggtatgcctcaaggaaggcctatgcagagactagacctcgtataaaaggtcgatttgccaagagaacagatgtagaagctgaagtggatcagatgttctcgacaacactaattacagaagttggatatggaattgttccctctttctgaatatgctgtgtagaacaaatggccagaagacattgaagatgctagaggatcatgattaatagaaatggaaaccacttgtgtactaagttattctgctgataatgtattttttatgtaatctaattgcttgcagttgtactaatcggatgctttattattttgtttattgtcttttgaatgaaacttgtatttgtaaatacagtccttgtattaaattattaaattacagtcg

SEQ ID NO: 1802 - protein, 352 aa, Glycine max
  misc_feature: Ceres Clone ID no. 472076
  misc_feature (1)..(352): Bit score of 594.7 for HMM based on sequences of FIGURE 6.
  misc_feature (283)..(327): Pfam Name: CCT Pfam Description: CCT motif
  misc_feature (50)..(97): Pfam Name: zf-B_box Pfam Description: B-box zinc finger
  misc_feature: Functional Homolog Of SEQ ID NO. 456
MLEGQATTPTWPRMCDTCRSVPSTVFCRSHTAFLCATCDTRLHVSLTWHERVWVCEACERAPAAFLCKADAASLCASCDADIHAANPLASRHHRVPILPIAAANNNNNDDDDVADVDDEDETASWLLLNPIKSATVPNTNNNNNNNGFLYNGEVDEYLDLVDNCNSCGDNNHFASAAATTDHYAQHQHFAGVSQKSYAGDSVVPVQQHQHFQLGLDFDNSKPAFSYNGSVSQSVSVSSMDIGVVPESPMRDVSIAHTRPPKGTIDLFSGPPIQVPSHFSPMDREARVLRYREKKKMRKFEKTIRYASRKAYAETRPRIKGRFAKRTDVEAEVDQMFSTTLITEVGYGIVPSF

SEQ ID NO: 1803 - DNA, 1556 bp, Triticum aestivum
  misc_feature: Ceres Clone ID no. 685991
  misc_feature: Encodes the peptide sequence at SEQ ID NO. 1804
aacttttgcttcgccgtggaagggatcgtcgtagctggcttagcttgctgctttgcttccaagtgttgctgctggtggtgctgtggtagtgtggtgtgaggtgtgatggagctgcaggggctggggaggtactggggcgtgggcggcaggaggtgcgggtcgtgccgggggtcgccggcggcggtgcactgccggacgtgcgatgggggcagtggggacggggcgtacctgtgcgcgggctgtggcgaggggcacgcgcgggcggggcacgagagggtgtgggtctgcgaggtgtgcgagctcgcgccggccgcggtcacctgcaaggccgacgccgccgcgctctgcgccgcctgcgacgccgacatccaccacgccaacccgctcgcgcgccgccacgagcgcgtccccgtgcagcccatcgggtcctcgtcacccgaggggcaggagcaggagcaggatgcgttcgtgatgtcgttcggcggctcggtcgacggggagaagcagcagaaccccgtggtgaacctgaacgacgctctggaggccggcgccggcgggaaggagaacgtgaagctggacttcctgttcgcggacatgatggaccctttcttcggctccgagctcccgcgcttcccgcacgccgacagcgttgtccccagcggcggcgcggtggagctggacttcggtggcgtcgccgcccccgtcgtcgtctccaacccgtcctacagctcctacacggcggcgtcgctcggtggaagtggctcgtcgtcggaggtcggcttggtgccggacgcgatctgtggccgaggcggcggcatcatcgagctggacttcgcacagtccaaggccgcgtacctgccctacacccccacaccaagccacagtaccgtctcctcggtggatgttgggtcggtgccggagcggagcgacagcgccgtcgcggcggcgacgccggcgacgggggaggggagggaggcgcgtctgatgcggtaccgcgagaagcgcaagaaccggcggttcgagaagaccatccggtacgcgtcccggaaggcctacgccgagagcaggccgcgcgtcaagggccgcttcgccaagcgcgccgacgacgcggacaccgacgccgtcgcggcggccacgatcaccacgccggggccatgcgtgctcgacttcggcagctacggcgtcgtgcccaccttctgaggcggcgcctgatttcgtgtccatttcctccggcgagcgtgccggctgggtgcctaattaaatccggcaccgccatggccggcacgagcgcgccgacgtgcatgcgtcgtgttccctcttgtataattgcatgtaatgtttttcgagctggctgatcgctggctggcgtgtagtatactgtaatcaacatgcacgcacgcacgcacgcatgttttgctagaactagaataatacagatagttctagttgactagtctactaccctgtaccctttccctgggctagcttgatgccaaattaggctagggcaatgtaacgtgtttgctggaacagcttagttctagttttggatccgc

SEQ ID NO: 1804 - protein, 364 aa, Triticum aestivum
  misc_feature: Ceres Clone ID no. 685991
  misc_feature (1)..(364): Bit score of 289.8 for HMM based on sequences of FIGURE 6.
  misc_feature (289)..(333): Pfam Name: CCT Pfam Description: CCT motif
  misc_feature (56)..(103): Pfam Name: zf-B_box Pfam Description: B-box zinc finger
  misc_feature: Functional Homolog Of SEQ ID NO. 456
MELQGLGRYWGVGGRRCGSCRGSPAAVHCRTCDGGSGDGAYLCAGCGEGHARAGHERVWVCEVCELAPAAVTCKADAAALCAACDADIHHANPLARRHERVPVQPIGSSSPEGQEQEQDAFVMSFGGSVDGEKQQNPVVNLNDALEAGAGGKENVKLDFLFADMMDPFFGSELPRFPHADSVVPSGGAVELDFGGVAAPVVVSNPSYSSYTAASLGGSGSSSEVGLVPDAICGRGGGIIELDFAQSKAAYLPYTPTPSHSTVSSVDVGSVPERSDSAVAAATPATGEGREARLMRYREKRKNRRFEKTIRYASRKAYAESRPRVKGRFAKRADDADTDAVAAATITTPGPCVLDFGSYGVVPTF

SEQ ID NO: 1805 - protein, 384 aa, Picea sitchensis
  misc_feature: Public GI ID no. 116787635
  misc_feature (1)..(384): Bit score of 532.5 for HMM based on sequences of FIGURE 6.
  misc_feature (320)..(364): Pfam Name: CCT Pfam Description: CCT motif
  misc_feature (23)..(70): Pfam Name: zf-B_box Pfam Description: B-box zinc finger
  misc_feature (71)..(113): Pfam Name: zf-B_box Pfam Description: B-box zinc finger
  misc_feature: Functional Homolog Of SEQ ID NO. 456
MVKEEDCKVPKEAGIVKEFQAWTMPKPCNVCRIASASLYCRADSAYLCSGCDVKVHGANKLASRHERVWLCEVCEQAPAAVTCKADAASLCVSCDADIHSANPLARRHDRVPIVPFYECASVAKTFLPPPPPPPTSSLQDSDVVGTLDYEDHDDDDEIYAAEAASWLLPNPKSSAEGTKNCDDGGSCFGVDAGPPVNKAAGGYFSVVDLFPDVDPYLDLDYASPLEATGGTDSVVPVQSNVSSQDGAVSTPSDCFDTEKVTYSYTTTTSLSHSVSSSSLDVGVVPDATLSDMPRPLNRGVFELANPGVVNVGIQYVQLDREARVLRYKEKRKNRKFEKTIRYASRKAYAETRPRIKGRFAKRVDADVAQMYTSAELSYGLVPSF

SEQ ID NO: 1806 - protein, 244 aa, Populus balsamifera subsp. trichocarpa
  misc_feature: Public GI ID no. 118487799
  misc_feature (1)..(244): Bit score of 369.1 for HMM based on sequences of FIGURE 6.
  misc_feature (175)..(219): Pfam Name: CCT Pfam Description: CCT motif
  misc_feature: Functional Homolog Of SEQ ID NO. 456
MTQEGEETIGEEDEDEAASWLLLNPAKNSNNQNNNGFLFGGEVDEYLDIVEYNSCAENQYSDQYNQQHYSVPPKSCGGDSVVPIQYGEGKDHQQQQQQQHHNFQLGLEYEPAKAAYSYDGSVSQGVSMSSMDVGVVPESAMSEISISHQSAPRGTIDLFSSPPIQMPSQLSPMEREARVLRYREKKKARKFEKTIRYASRKAYAETRPRIKGRFAKRTDVDVEVDQMFSSTLMAETAYGIVPSF

SEQ ID NO: 1807 - protein, 350 aa, Populus x generosa
  misc_feature: Public GI ID no. 118489345
  misc_feature (1)..(350): Bit score of 626.8 for HMM based on sequences of FIGURE 6.
  misc_feature (287)..(331): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature: Functional Homolog Of SEQ ID NO. 456
MASKLCDSCKSATATLFCRADSAFLCISCDSKIHAANKLASRHARVSVCEVCEQAPAHFTCKADAAALCVTCDRDIHSANPLASRHERVPITPFFDSSSTVHGGGAAVNLLEDRYFDEVDGGRGDVSREEAEAESWLLPNPGGGTAKGVDSMDLNTGQYVFGSEMDPYLDLDPYVDPKVEVQEQNSSGTTDGVVPVQSNKLGFQAPALVNDNCCYELDFSTGSKSFGGGYGYNSLSHSVSSSSLDVGVVPDGSGSTLTDISNPYCSRSVSNGMESANQTVQLSAVDREARVLRYREKRKNRKFEKTIRYASRKAYAETRPRIKGRFAKRTDTEVEVDRSSLYGFGVVPSF

SEQ ID NO: 1808 - protein, 338 aa, Vitis vinifera
  misc_feature: Public GI ID no. 157327254
  misc_feature (1)..(338): Bit score of 657.2 for HMM based on sequences of FIGURE 6.
  misc_feature (271)..(315): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature: Functional Homolog Of SEQ ID NO. 456
MASKLCDSCKSAPPTLFCRADSAFLCVACDSKVHAANKLASRHARVWMCEVCEQAPAHVTCKADAAALCVTCDRDIHSANPLARRHERVPVVPFYDSAAAAAKSNAVNLLVDDRYYSDPDGDASREEAEAASWLLPNPNPKLAESSDLNSSHYMFSDIDPYLDLDYPSMDPKLQSQQQQQSSGTDGVVPVQNKSVQAPLVNDNCFDMDFSGSKSFYNGQSLSQSVSSSSLEVGVVPDGNAMVDVTNPFGRSMNTGSESANQTAQISSGIDREARVLRYREKRKNRKFEKTIRYASRKAYAETRPRIKGRFAKRSEIEVDYSSSGALTADSGYGVVPSF

SEQ ID NO: 1809 - protein, 358 aa, Vitis vinifera
  misc_feature: Public GI ID no. 157341339
  misc_feature (1)..(358): Bit score of 792.1 for HMM based on sequences of FIGURE 6.
  misc_feature (289)..(333): Pfam Name: CCT Pfam Description: CCT motif
  misc_feature (18)..(65): Pfam Name: zf-B_box Pfam Description: B-box zinc finger
  misc_feature (66)..(108): Pfam Name: zf-B_box Pfam Description: B-box zinc finger
  misc_feature: Functional Homolog Of SEQ ID NO. 456
MLKDEGCNADAAAGGGGGWARVCDTCRSAACTIYCRADSAYLCAGCDARIHAANRVASQHERVWVCESCERAPAAFVCKADAASLCATCDADIHSANPLARRHHRVPVLPIAGCLYGPPATDPGGTVTIDEEDEDEAASWLLLNPVKNNNGSSNNQNNGLLFGGEVDEYLDLVEYNSCPENQFSDQYNQQQPPPHYSVPHKNYGGDRVVPVQCGEAKGQLHQQHQQQGFHLGMDHSVSVSSMDVGVVPEATTMSDISISISHPRPPKGTIDLFSGPPIQMPTQLTPMDREARVLRYREKKKTRKFEKTIRYASRKAYAETRPRIKGRFAKRTDVEVEVDQMFSTTLMAESGYGIVPSF

SEQ ID NO: 1810 - protein, 297 aa, Vitis vinifera
  misc_feature: Public GI ID no. 157352296
  misc_feature (1)..(297): Bit score of 460.0 for HMM based on sequences of FIGURE 6.
  misc_feature (223)..(267): Pfam Name: CCT Pfam Description: CCT motif
  misc_feature (1)..(44): Pfam Name: zf-B_box Pfam Description: B-box zinc finger
  misc_feature: Functional Homolog Of SEQ ID NO. 456
MCEVCEQAPASVTCKADAAALCVTCDRDIHSANPLARRHDRVPVVPFYDSAESLVKSTAAAVGFLVPGGAGDEEDSEAASWLLPNPKLPEGPEVKSGEVFFSDIDPFLDFDYPDAKFPHHHHHHCGGNDGVVPVQAKDPSPPVTNHPADNCFELDFSRSKLSAYNYTAQSLSQSISSSDVGVVPDGNCNSMSDTSYPSMKQVSGGGGGGSTGSQATQLSGMDREARVLRYREKRKNRKFEKTIRYASRKAYAETRPRIKGRFAKRTEMESEMVDHIYNSASAAAFMVDAGYGVVPSY

SEQ ID NO: 1811 - protein, 397 aa, Zea mays
  misc_feature: Public GI ID no. 157422228
  misc_feature (1)..(397): Bit score of 556.8 for HMM based on sequences of FIGURE 6.
  misc_feature (326)..(370): Pfam Name: CCT Pfam Description: CCT motif
  misc_feature (27)..(74): Pfam Name: zf-B_box Pfam Description: B-box zinc finger
  misc_feature (75)..(117): Pfam Name: zf-B_box Pfam Description: B-box zinc finger
  misc_feature: Functional Homolog Of SEQ ID NO. 456
MDYNFDTSVLDEDVAGRGGREGSCPPAWARACDGCRAAPSVVYCHADTAYLCASCDSRVHAANRVASRHERVRVCEACECAPAVLACRADAAALCAACDAQVHSANPLAGRHQRVPVLPLPAAAVPAASVLAEATATAASVAGDKDEEVDSWLLLTKDPDDDDKNHNCSSNNNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISYSSSMEVGIVPDNMATTDMPSSGILLTPAGAISLFSSGPPLQMPLHLASMDREARVLRYREKKKSRKFEKTIRYATRKTYAEARPRIKGRFAKRSSDMDDEVDQMFSAAALSSDGSYGTVPWF

SEQ ID NO: 1812 - protein, 398 aa, Zea mays
  misc_feature: Public GI ID no. 158866355
  misc_feature (1)..(398): Bit score of 556.1 for HMM based on sequences of FIGURE 6.
  misc_feature (327)..(371): Pfam Name: CCT Pfam Description: CCT motif
  misc_feature (27)..(74): Pfam Name: zf-B_box Pfam Description: B-box zinc finger
  misc_feature (75)..(117): Pfam Name: zf-B_box Pfam Description: B-box zinc finger
  misc_feature: Functional Homolog Of SEQ ID NO. 456
MDYNFDTSVLDEDVAGRGGREGSCPPAWARACDGCRAAPSVVYCHADTAYLCASCDSRVHAANRVASRHERVRVCEACECAPAVLACRADAAALCAACDAQVHSANPLAGRHQRVPVLPLPAAAVPAASVLAEAAATAAAVAGDKDEEVDSWLLLTKDPDDDDKNHNCSSNNNNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISFSSSMEVGIVPDNMATTDMPSSGILLTPAGAISLFSSGPPLQMPLHLASMDREARVLRYREKKKSRKFEKTIRYATRKTYAEARPRIKGRFAKRSSDMDVEVDQMFSAAALSSDGSYGTVPWF

SEQ ID NO: 1813 - protein, 368 aa, Physcomitrella patens subsp. patens
  misc_feature: Public GI ID no. 168062896
  misc_feature (1)..(368): Bit score of 526.9 for HMM based on sequences of FIGURE 6.
  misc_feature (301)..(345): Pfam Name: CCT Pfam Description: CCT motif
  misc_feature (48)..(90): Pfam Name: zf-B_box Pfam Description: B-box zinc finger
  misc_feature (1)..(47): Pfam Name: zf-B_box Pfam Description: B-box zinc finger
  misc_feature: Functional Homolog Of SEQ ID NO. 456
MPKSCDACQASSAVVYCRADAAYLCLGCDGKVHGANKLASRHERLWMCEVCEVAAAVVTCKADAASLCVSCDTDIHSANPLAQRHERVPVQPLFDCVSQFRGTHFSVLAPKNECNNNLLKGDEDPAVAEAVSWLLPHPKTLSSAILRGIAAADEAPAFPFRERPFSPKLKKLKVEQAADIYSDVDPFLVLDGGNGTGFQPDSMVPVHIPEGPDDSPSLANSTAPSSAINFRASQKSGCSYGTSTLTHSMSCSSVDAAVVPDSSLSDISTPYSKALDSQDSQDLSGALVPHQASKPIDTVDREARVMRYKEKRQKRKFEKTIRYASRKAYAESRPRIKGRFTKRTDSDVEQMFSSCTADSGFGVVPSSC

SEQ ID NO: 1814 - protein, 383 aa, Triticum aestivum
  misc_feature: Public GI ID no. 169807976
  misc_feature (1)..(383): Bit score of 440.9 for HMM based on sequences of FIGURE 6.
  misc_feature (314)..(358): Pfam Name: CCT Pfam Description: CCT motif
  misc_feature (19)..(66): Pfam Name: zf-B_box Pfam Description: B-box zinc finger
  misc_feature: Functional Homolog Of SEQ ID NO. 456
MNCVSNGTVYEEAVGREGSWARLCDGCCTVPSVVYCRADSAYLCASCDAQIHAANRVASRHERVLLSEAYKHAPVVLECHADAAALCAAYEAQVHYANLLATMHQRVPVVSHPVAAIPAASLFAEAAATAPVLGSKEEDASWLLLSKDSDNHNHSGNHSSSSSSSRYFGEVDQYFDLVGYNSYYDSHMNNQEQYVMQEQQHLQQMQKEYAEQQMQKEYVEKEGSECIVPSQSAIVSRPHQSGYAPLVRAEQAASVTAGVSAYTDSVNNSISFSMEAGIVPDNTVQSSILRPAGAIGHFSSPSLQTPLHFSSKEREARVLRYKEKKKSRKFEKTTRYATRKAYAEARPRIKGRFAKRSDADMEVDQTFSTAALSDSSYSTVPWF

SEQ ID NO: 1815 - protein, 362 aa, Chenopodium rubrum
  misc_feature: Public GI ID no. 170779036
  misc_feature (1)..(362): Bit score of 713.4 for HMM based on sequences of FIGURE 6.
  misc_feature (297)..(341): Pfam Name: CCT Pfam Description: CCT motif
  misc_feature (13)..(60): Pfam Name: zf-B_box Pfam Description: B-box zinc finger
  misc_feature (61)..(103): Pfam Name: zf-B_box Pfam Description: B-box zinc finger
  misc_feature: Functional Homolog Of SEQ ID NO. 456
MMKKEVPGGDNNSWARVCDTCRSAPCTVYCKEDSAFLCTSCDARIHAVNQMASRHERVWVCEACEREPAAFLCKADAASLCATCDADIHSANPLARRHHRVPIMPVGCVYGPSDGRMSEDGFLDLPDRDDQTTDHEGDEDEAASWLLLNPGKNSNNQTTNGFLTGGGEVDEYLDLFEYNSGADNQFCEQYNQQQEFSVPEKNCGGDSVVPVQCREVKDHQIQYQNFLFGMECETKSEYTYNTSISHSVSVSSLDVGVVPESTMSDMSVSHSRPPKGTIDLFSSTPMQVPTQLSPLDREARVMRYREKKKNRKFEKTIRYASRKAYAETRPRIKGRFAKRTDVEAERTNSLMSDGGYGIVPSF

SEQ ID NO: 1816 - protein, 336 aa, Chenopodium rubrum
  misc_feature: Public GI ID no. 170779038
  misc_feature (1)..(336): Bit score of 658.5 for HMM based on sequences of FIGURE 6.
  misc_feature (267)..(311): Pfam Name: CCT Pfam Description: CCT motif
  misc_feature (13)..(60): Pfam Name: zf-B_box Pfam Description: B-box zinc finger
  misc_feature (61)..(103): Pfam Name: zf-B_box Pfam Description: B-box zinc finger
  misc_feature: Functional Homolog Of SEQ ID NO. 456
MMKKEVPGGDNNSWARVCDTCRSAPCTVYCKEDSAFLCTSCDARIHAVNQVASRHERVWVCEACEREPAAFLCKADAASLCATCDADIHSANPLARRHHRVPIMPVGCVYGPSDGRMSEEGFLDLPDGDDQTTDHEGDEDEAASWLLLNPGADNQFCEQYSQQQEFSVPEKNCGGDSVVPVQCREVKDHQIQYQKFLFGMECETKSEYNYNTSISHSVSVSSLDVGVVPESTMSDMSVSHSRPPKGTIDLFSSPPMQVPTQLSPLDREARVMRYREKKKNRKFEKTIRYASRKAYAETRPRIKGRFAKRTDVEAEMDQMFTNSLMSDGGYGIVPSF

SEQ ID NO: 1817 - protein, 367 aa, Beta vulgaris subsp. vulgaris
  misc_feature: Public GI ID no. 186911828
  misc_feature (1)..(367): Bit score of 767.4 for HMM based on sequences of FIGURE 6.
  misc_feature (298)..(342): Pfam Name: CCT Pfam Description: CCT motif
  misc_feature (13)..(60): Pfam Name: zf-B_box Pfam Description: B-box zinc finger
  misc_feature (61)..(103): Pfam Name: zf-B_box Pfam Description: B-box zinc finger
  misc_feature: Functional Homolog Of SEQ ID NO. 456
MMKEEVSGSDTNSWARVCDTCRAAPCTVYCRADSAFLCTSCDARIHAANQVASRHERVWVCEACERAPAAFLCKADAASLCATCDAEIHSANPLARRHQRVPIMPVAGCVYGPQGGRMSEDRFLTLPEGDDHTTDHEGDEDEAASWLLLNPVKNSNNQNTNGFLTGGGEVDEYLDLLEYNSGADNQLCEQYNQQQEFKVPEKNCGGDSVVPVQCREAKDHQIQYQNFLFGMECETKSGYTYNTSISQSVSVSSMDVGVVPESAMSDISMSHPRPPKGTIDLFSSPPMQVPTQLSPLDREARVMRYREKKKNRKFEKTIRYASRKAYAETRPRIKGRFAKRTDVEAEMDQMFTNSLMADSGYGIVPSY

SEQ ID NO: 1818 - protein, 386 aa, Solanum lycopersicum
  misc_feature: Public GI ID no. 186915025
  misc_feature (1)..(386): Bit score of 459.3 for HMM based on sequences of FIGURE 6.
  misc_feature (307)..(351): Pfam Name: CCT Pfam Description: CCT motif
  misc_feature (64)..(106): Pfam Name: zf-B_box Pfam Description: B-box zinc finger
  misc_feature (22)..(63): Pfam Name: zf-B_box Pfam Description: B-box zinc finger
  misc_feature: Functional Homolog Of SEQ ID NO. 456
MGIFREAPNCFPGGWNIGAAARMAKSCEYCHLAAALVFCRTDNTFVCLSCDTRLHARHERVWVCEVCEQAAASVTCRADAAALCVACDRDIHSANPLARRHERVPVVPFYDPVESVVKSTAATLLVSINGTTTTATTTATITPELGKVDTCIGHHENNNDPWIPPNTITSKLPLNTEMKGMDFIFTDSENFLDFDYPACVDTQSQPHYNSSNDSVVPVQANTPIKSLPFHHQEKHFEIDFTQSHIKSYNTPSLSVSSSSLDVGIVPDGSSISEISYPYIRTMNNSNSSIDLSNSANHQGEKLLGLDREARVLRYREKKKNRKFEKTIRYASRKAYAETRPRIKGRFAKRTDGSAGAGEFDDVDGIFSGTDFIAAESRYGVVPSFLT

SEQ ID NO: 1819 - protein, 395 aa, Zea mays
  misc_feature: Public GI ID no. 187830112
  misc_feature (1)..(395): Bit score of 551.5 for HMM based on sequences of FIGURE 6.
  misc_feature (324)..(368): Pfam Name: CCT Pfam Description: CCT motif
  misc_feature (75)..(117): Pfam Name: zf-B_box Pfam Description: B-box zinc finger
  misc_feature (27)..(74): Pfam Name: zf-B_box Pfam Description: B-box zinc finger
  misc_feature: Functional Homolog Of SEQ ID NO. 456
MDYNFDTSVLDEDVAGRGGREGSCPPAWARACDGCRAAPSVVYCHADTAYLCASCNSRVHAANRVASRHERVRVCEACECAPAVLACRADAAALCAACDAQVHSANPLAGRHQRVPVLPLPAAAVPAASVLAEAAATAAAVAGDKDEEVDSWLLLTKDPDDDDKNHNCSSNNNNISSNTSTFYADVDEYFDLVGYSSYCDNHINSNTKQYGMQEQQLLLHKEFGDKEGSEYVVPSQVGQQQSGYHRVIGTEQAASMTPGVSAYTDSISNSISFSSSMEVGIVPDNMATTDMPSSGILLTPAGAISLFSSGPPLQMPLHLASMDREARVLRYREKKKSRKFEKTIRYATRKTYAEARPRIKGRFAKRSSDMDVEVDQMFSAAALSSDGSYGTVPWF

SEQ ID NO: 1820 - protein, 369 aa, Lolium perenne
  misc_feature: Public GI ID no. 188484477
  misc_feature (1)..(369): Bit score of 724.7 for HMM based on sequences of FIGURE 6.
  misc_feature (300)..(344): Pfam Name: CCT Pfam Description: CCT motif
  misc_feature (22)..(69): Pfam Name: zf-B_box Pfam Description: B-box zinc finger
  misc_feature (70)..(112): Pfam Name: zf-B_box Pfam Description: B-box zinc finger
  misc_feature: Functional Homolog Of SEQ ID NO. 456
MLMNCDFNCDLFEQEAKRRSYPWARPCDGCHAAPSAVYCHADAAYLCASCDTQVHSANRLASSHERVRVCVSCESAAAVLECHADSAALCTTCDAQVHSANPIAQRHQRVPVLPLPALAIPAASVFAEAEAATTVYGDKEEGEEVDSWLLLERDSDDNNCTNNIDQYFNLFGYDMYYDKFSCNPGPGEEYRLQEQDVQNMYRENEVCEFAVPSQVGMASEQPESSYGMIGAEQDASMTAGTSTYTASISNGIPFSSMEVGIIPDNTRPDVSNTNIQRTSEAMELAGHSLQMPVHFSSMDRDARVLRYKEKKQARTFQKTIRYATRKAYAEARPRIKGRFAKRSDIEHELDQMLTIPALPDSGHATVLWF

SEQ ID NO: 1821 - protein, 340 aa, Malus x domestica
  misc_feature: Public GI ID no. 189014382
  misc_feature (1)..(340): Bit score of 721.7 for HMM based on sequences of FIGURE 6.
  misc_feature (279)..(323): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature: Functional Homolog Of SEQ ID NO. 456
MALKLCDSCKSATGTLFCRADSAFLCVNCDSKIHAANKLASRHARVWLCEVCEQAPAHVTCKADDAALCVTCDRDIHSANPLSRRHERVPVTPFYDSVNSATDSVPAVKSAVNFLNDRYFSDVDGEIEARREEAEAASWLLPNPKAMENPDLNSGQYLFPEMDPYMDLDYGHVDPKLEDAQEQNSCITDGVVPEQSKNMQPQLVNDHSFEIDFSAASKPFVYGYHHAQCLRQSVSSSSMDVSIVPDDNAMTDDSNPYNKSMTSAVESSHPAVQLSSADREARVLRYREKRKNRKFEKTIRYASRKAYAETRPRIKGRFAKRTEVEIEAEPMCRYGIVPSF

SEQ ID NO: 1822 - protein, 444 aa, Picea abies
  misc_feature: Public GI ID no. 193735598
  misc_feature (1)..(444): Bit score of 451.8 for HMM based on sequences of FIGURE 6.
  misc_feature (377)..(421): Pfam Name: CCT Pfam Description: CCT motif
  misc_feature (79)..(126): Pfam Name: zf-B_box Pfam Description: B-box zinc finger
  misc_feature: Functional Homolog Of SEQ ID NO. 456
MVKEEDKDWHTVEDLHRGSHVDHKEFLRGIGGWRMSMPKLCDVCQVSNSVLYCRAHTAQLCLVCDVKIHGGSKASLCHERVWVCEVCEQAPAVVTCKADAAALCVSCDTDIHSANPLASRHERAPVIPFYECPNMPNNNTATNANNDNLDCNVLLNEDGGGDDPLKHDYVDDDYDDYDDDENDHNNLLNHQEDDNDAEICCAEEAATASWLIPEANRNNLTNINGGNSEGEDKMVKDKLKFKAYMQSIDFLQDVENYVDLEYLGTTTTITTPTTPTAHMGADSMVPVHTPEVIEHSSTKVSVETARSLDVDAASKCNYVYRTTSLNHCVSSSSIDVGIVPDSNTTTDISTPYHDPRGVFEIPPRVVHPGGHVEVMGREARVLRYREKRKNRRFEKTIRYASRKAYAETRPRIKGRFAKRTEVEVEQIYSSSLLPDQGYGVVPSY

SEQ ID NO: 1823 - protein, 339 aa, Brassica nigra
  misc_feature: Public GI ID no. 194244777
  misc_feature (1)..(339): Bit score of 549.1 for HMM based on sequences of FIGURE 6.
  misc_feature (288)..(332): Pfam Name: CCT Pfam Description: CCT motif
  misc_feature (15)..(62): Pfam Name: zf-B_box Pfam Description: B-box zinc finger
  misc_feature (63)..(105): Pfam Name: zf-B_box Pfam Description: B-box zinc finger
  misc_feature: Functional Homolog Of SEQ ID NO. 456
MLKQKSNNIDGEENNRARACDTCMSTVCTVYCHADSAYLCTSCDAEVHSANRVASRHKRVPVCESCECAPAAFLCEADDASLCTACDSEVHSANAIARRHHRVPVLPVSGNSYISMETHHQTETTEAEPEKRLVIHQEEDEARETASWLLPKDKNSNQNNELLLSDEYLDLADYNSNMDNKFTGQYSHHQQEGDVPQTNYVGDRVVPIQIQESNGSLRHKQQNMTYGSSDINSGSINHNNGYDTSMETDFVPEPTTPDTADGYTTDGKIDQPPEPPVKMIIQLTPMDREARVLRYREKRKTRKFEKTIRYASRKAYAERRPRINGRFAKMGETEDYDVD

SEQ ID NO: 1824 - protein, 339 aa, Brassica nigra
  misc_feature: Public GI ID no. 194244779
  misc_feature (1)..(339): Bit score of 526.7 for HMM based on sequences of FIGURE 6.
  misc_feature (288)..(332): Pfam Name: CCT Pfam Description: CCT motif
  misc_feature (15)..(62): Pfam Name: zf-B_box Pfam Description: B-box zinc finger
  misc_feature (64)..(105): Pfam Name: zf-B_box Pfam Description: B-box zinc finger
  misc_feature: Functional Homolog Of SEQ ID NO. 456
MLKQKSNNIDGEENNRARACDTCMSTVCTVYWHADSAYLCTSCDAEVHSANRVASRHKRVPSGESCECAPAAFLCEADDASLCTTCDSEVHSANAIARRHHRVPVLPVSGNSYISMETHHQTETTEAEPEKRLVIHQEEDEARETASWLLPKDKNSNQNNELLLSDEYLDLADYNSNMDNKFTGQYSHHQQEGDVPQTNYVGDRVVPIQIQESNGNLRHKQQNMTYGSSDINSGSINHNNGYDTSMETDFVPEPTTPDTADGYTTDGKIDQPPEPPVKMIIQLTPMDREARVLRYREKRKTRKFEKTIRYASRKAYAERRPRINGRFAKMGETEDYDVD

SEQ ID NO: 1825 - protein, 339 aa, Brassica nigra
  misc_feature: Public GI ID no. 194244787
  misc_feature (1)..(339): Bit score of 549.8 for HMM based on sequences of FIGURE 6.
  misc_feature (288)..(332): Pfam Name: CCT Pfam Description: CCT motif
  misc_feature (15)..(62): Pfam Name: zf-B_box Pfam Description: B-box zinc finger
  misc_feature (63)..(105): Pfam Name: zf-B_box Pfam Description: B-box zinc finger
  misc_feature: Functional Homolog Of SEQ ID NO. 456
MLKQKSNNIDGEENNRARACDTCMSTVCTVYCHADSAYLCTSCDAEVHSANRVASRHKRVPVCESCECAPAAFLCEADDASLCTACDSEVHSANAIARRHHRVPVLPVSGNSYISMETHHQTETTEAEPEKRLVIHQEEDEARETASWLLPKDKNSNQNNELLLSDEYLDLADYNSNMDNKFTGQYSHHQQEGDVPQTNYVGDRVVPIQIQESNGNLRHKQQNMTYGSSDINSGSINHNNGYDTSMETDFVPEPTTPDTADGYTTDGKIDQPPEPPVKMIIQLTPMDREARVLRYREKRKTRKFEKTIRYASRKAYAERRPRINGRFAKMGETEDYDVD

SEQ ID NO: 1826 - protein, 343 aa, Brassica nigra
  misc_feature: Public GI ID no. 194244824
  misc_feature (1)..(343): Bit score of 734.3 for HMM based on sequences of FIGURE 6.
  misc_feature (281)..(325): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNSENNRFSVGEEYLDLVDYSSSMDKRFTGQANQYQQDYNVPQRSYVADGVVPLQVGVSKGHMHHEQHNFQFGFTNVSSEAHQISNGSPIHMVSLVPESVTSDATVSHQRSPKSGTEELPEAPVQMLSPMERKARVLRYREKKKTRKFEKRIRYASRKEYAEKRPRIKGRFAKRNEVDADQAFPTVVMFDTGYG

SEQ ID NO: 1827 - protein, 336 aa, Brassica nigra
  misc_feature: Public GI ID no. 194244826
  misc_feature (1)..(336): Bit score of 736.5 for HMM based on sequences of FIGURE 6.
  misc_feature (274)..(318): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYG

SEQ ID NO: 1828 - protein, 340 aa, Brassica nigra
  misc_feature: Public GI ID no. 194244844
  misc_feature (1)..(340): Bit score of 722.1 for HMM based on sequences of FIGURE 6.
  misc_feature (280)..(324): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTG

SEQ ID NO: 1829 - protein, 342 aa, Brassica nigra
  misc_feature: Public GI ID no. 194244850
  misc_feature (1)..(342): Bit score of 728.9 for HMM based on sequences of FIGURE 6.
  misc_feature (280)..(324): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNNNISENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVMFDTGYG

SEQ ID NO: 1830 - protein, 342 aa, Brassica nigra
  misc_feature: Public GI ID no. 194244852
  misc_feature (1)..(342): Bit score of 733.7 for HMM based on sequences of FIGURE 6.
  misc_feature (280)..(324): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNTENNRFSVGEEYLDLVDYSSSIDKRFTGQTNQYQQDYNVPQRSYVADGVVPLQVGVSKGHMHHEQHNFQFGFTNVSSEAHQISNGSPIHMVSLVPESVTSDATVSHQRSPKAGTEELPEAPVQMLSPMERKARVLRYREKKKTRKFEKRIRYASRKEYAEKRPRIKGRFAKRNEVDADQAFPTVVMFDTGYG

SEQ ID NO: 1831 - protein, 335 aa, Brassica nigra
  misc_feature: Public GI ID no. 194244864
  misc_feature (1)..(335): Bit score of 727.8 for HMM based on sequences of FIGURE 6.
  misc_feature (273)..(317): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSETAEPENIVVVGQEEEDEAEAASWLLPSSVKNCGDNNNNSENNRFSVGEEYLDLVDYSSSIDKRFTGQTNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 1832 - protein, 338 aa, Brassica nigra
  misc_feature: Public GI ID no. 194244868
  misc_feature (1)..(338): Bit score of 731.3 for HMM based on sequences of FIGURE 6.
  misc_feature (276)..(320): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNSENNRFSVGEEYLDLVDYSSSMDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 1833 - protein, 339 aa, Brassica nigra
  misc_feature: Public GI ID no. 194244870
  misc_feature (1)..(339): Bit score of 730.9 for HMM based on sequences of FIGURE 6.
  misc_feature (277)..(321): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNNNNSENNRFSVGEEYLDLVDYSSSMDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 1834 - protein, 345 aa, Brassica nigra
  misc_feature: Public GI ID no. 194244874
  misc_feature (1)..(345): Bit score of 728.8 for HMM based on sequences of FIGURE 6.
  misc_feature (283)..(327): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEAHQISNGSPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 1835 - protein, 335 aa, Brassica nigra
  misc_feature: Public GI ID no. 194244876
  misc_feature (1)..(335): Bit score of 726.7 for HMM based on sequences of FIGURE 6.
  misc_feature (273)..(317): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSETAEPENIVVVGQEEEDEAEAASWLLPSSVKNCGDNNNNSENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 1836 - protein, 338 aa, Brassica nigra
  misc_feature: Public GI ID no. 194244878
  misc_feature (1)..(338): Bit score of 727.8 for HMM based on sequences of FIGURE 6.
  misc_feature (276)..(320): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDHNNNNNSENNRFSVGEEYLDLVDYSSSMDKRFTGQSNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 1837 - protein, 339 aa, Brassica nigra
  misc_feature: Public GI ID no. 194244884
  misc_feature (1)..(339): Bit score of 724.3 for HMM based on sequences of FIGURE 6.
  misc_feature (277)..(321): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 1838 - protein, 339 aa, Brassica nigra
  misc_feature: Public GI ID no. 194244892
  misc_feature (1)..(339): Bit score of 718.8 for HMM based on sequences of FIGURE 6.
  misc_feature (277)..(321): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVRMLSPMERKARVLRYREKKKTRKFEKRIRYASRKEYAEKRPRIKGRFAKRNEVDADHALSTMVVFDTGYG

SEQ ID NO: 1839 - protein, 336 aa, Brassica nigra
  misc_feature: Public GI ID no. 194244894
  misc_feature (1)..(336): Bit score of 731.7 for HMM based on sequences of FIGURE 6.
  misc_feature (274)..(318): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHHSSETTEPENIVVVGQEEEDEAEAASWLLPSSVKNCGDNNNNSENNRFSVGEEYLDLVDYSSSIDKRFTGQTNQYQQDYNVPQRSYVADGVVPLQVGVANGHMHHEKHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 1840 - protein, 338 aa, Brassica nigra
  misc_feature: Public GI ID no. 194244898
  misc_feature (1)..(338): Bit score of 724.7 for HMM based on sequences of FIGURE 6.
  misc_feature (276)..(320): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPESVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 1841 - DNA, 2227 bp, Zea mays
  misc_feature: Ceres CLONE ID no.1569555
  misc_feature: Encodes the peptide sequence at SEQ ID NO. 1842
gaaccctttcttcctcttcctcccccagtatactccaattcccacgtactcttcctccttgttctcctcctcctctctccctctctctcgccagaggatccaagaagtaccattgcagctcgctccattcgttcccaatcccaacacagcctctcagctgagctcagctcagctcagctcagggagttcccctgcttgtttttgctctagtgctcttggctgcctcagaaaaggactgcatgtgcagcagctgcaaagatagaatttctttatttttttcaccccaccttctcccaaggtgctgttggtgccccaggtggaggcaactggcgaagtgtgtgcgttctttgcttgatcaactaggttaagccatttcttgccccagtgttctccgattcatggttgtggaactagtccgagaatagctggagctgctcgttttcccttccaagaagacgaaggcggggggcgaggcgatcgtttgagcggtacctgttgcgcgcctgaggcggtgcaatcaatgtcgtcttcctgcataccgaccggcctgcggctggacctggacatggtgaaggcggcggcgtcgccggtgggcgcgcactcgtcgccgctgcgcccggcgcactactcgtcgccgtcgtcgacgctgtcgtcggaggcgtccaacgcctcgtcatcgtcggcgacgtcggtgtcgctcaagcgggctcgcgcgccgcggaagcggcccaaccaggcgtacaacgaggccgccgcgctgctcgcgtccatccacccctccgtgttccccgtgaacaagagccccaagacggcgccgccgcgcccgccgcagctctccgtgctggcggcggcgctcgacgcctcgcccgacctcctcccgccgctccccgtcctcgcggactccgcattcctgctccgggaccaggacacgccgtcgccgaagccgcggagcccgtccggcgccaagaactgcccgtcgccggcccccgtgagcagcgcgttccgggacttccgcgacccgccgtcgtcggcgagcctcgacgcggtcggcgccgacgagcttggcgagatcgacttcgacgacgacggcttcaacgccgactccatcctcgacgtcggtgacgccgcggccgggggcctcgacggcatcatgggcagcctcaccgtcgacgtcgagagcggcaccgccgccaggtccgatgactccatcctttccagctccggcatacacccctacctcaggaggctcatggtggtcggcctcgccggcaggttcgagctcggcctcgggtcccagcacggtgctcggcccagcctcaaccgcgcactgaagcggcgggacgacgacggcgcctggtggatgtggccggcagtgccggtaaaggacttgacgatcgcaccaccggcaccgccagcaccaccggcgccgaacgccgcagtgccgcaggccgccgccgccgccgcgccagaaaagaagaaaagcaagaagaagaaggtggtgaaggccatggcgaagggaaatgaggagcttcttcccaacgcgaagtgcaaggaggaagaagctgacgcctctgttgatgacgccgccgctaatggcgacggtgactccgacagtgcgccgacgaacgcaccaaaggccggtctggggctgaagctggacgccgacgaggttctcaaggcgtggtccgacaaagggtccatgtttgccgagggcagcgggccggagttgccgacgtcggccgccgaagtgcgggctaagcttgcagacatcgacctgtttccagagaacggagcaggcggcggtggggtcagggaagccagcgtgctgcggtacaaggagaagaggcgcacccggctcttctccaagaagatccggtaccaggtgcgcaaggtgaacgccgactgccggcctcggatgaagggaaggttcgttaggagcccgtctcttcttcggcaggccctggaggaagagacctagctagacaggcagtaatctttgctagccatttcttcttcttcttttttcccagcgcgtttttggccttttagttcctcattaactaagatgtgagtgagaattttcagttttttttttggtcggagttttgctctggagagaagaggatagggtaggatgcctttatagtggattgtcatggcatggtggtcagatagtttgtctcgggtttacagtgtgaggtaaaggaaggaaaaataaagtgatgtt

SEQ ID NO: 1842 - protein, 485 aa, Zea mays
  misc_feature: Ceres CLONE ID no.1569555
  misc_feature (431)..(475): Pfam Name: CCT Pfam Description:  CCT motif
  misc_feature: Bit score of for 826.4 HMM based on sequences of FIGURE 6.
  misc_feature: Functional Homolog Of Ceres SEEDLINE ID no.ME11939 at SEQ ID NO. 456
MSSSCIPTGLRLDLDMVKAAASPVGAHSSPLRPAHYSSPSSTLSSEASNASSSSATSVSLKRARAPRKRPNQAYNEAAALLASIHPSVFPVNKSPKTAPPRPPQLSVLAAALDASPDLLPPLPVLADSAFLLRDQDTPSPKPRSPSGAKNCPSPAPVSSAFRDFRDPPSSASLDAVGADELGEIDFDDDGFNADSILDVGDAAAGGLDGIMGSLTVDVESGTAARSDDSILSSSGIHPYLRRLMVVGLAGRFELGLGSQHGARPSLNRALKRRDDDGAWWMWPAVPVKDLTIAPPAPPAPPAPNAAVPQAAAAAAPEKKKSKKKKVVKAMAKGNEELLPNAKCKEEEADASVDDAAANGDGDSDSAPTNAPKAGLGLKLDADEVLKAWSDKGSMFAEGSGPELPTSAAEVRAKLADIDLFPENGAGGGGVREASVLRYKEKRRTRLFSKKIRYQVRKVNADCRPRMKGRFVRSPSLLRQALEEET

SEQ ID NO: 1843 - protein, 218 aa, Ageratina adenophora
  misc_feature: Public GI ID no.115353971
  misc_feature (63)..(114): Pfam Name: AP2 Pfam Description:  AP2 domain
  misc_feature: Bit score of for 381.2 HMM based on sequences of FIGURE 8.
  misc_feature: Functional Homolog Of Ceres SEEDLINE ID no. ME15935 at SEQ ID NO. 216
MATLIQFNTPYTSLSADNIPTTESSSTSDYSTGTSFSDEEVMLASKNPKKRAGRKKFRETRHPYRGVRRRDSGKWVCEVREPNKKTRVWLGTYPTADMAARAHDVAALAMRGRSACLNFADSLWRLPIPESSNVKDIQKAAVKAAEAFRPTETDVAVIEESNELTGNVFCVDDESIFEMQGFLADMAEGMMLPPPRTIEYDNCQDDLEFFVDASLWSF

SEQ ID NO: 1844 - protein, 177 aa, Miscanthus sinensis
  misc_feature: Public GI ID no.62865696
  misc_feature (47)..(69): Pfam Name: zf-C2H2 Pfam Description:  Zinc finger, C2H2 type
  misc_feature: Bit score of for 287.8 HMM based on sequences of FIGURE 10.
  misc_feature: Functional Homolog Of Ceres SEEDLINE ID no. ME16597 at SEQ ID NO. 204
MERVDDGQIKLQQQQPPCSDNFSLAGAASSWPAPPPQVRSSPSSSSYTCGYCKKEFRSAQGLGGHMNVHRLDRARLIHQQYMSHRIDAPPPNPNPSCTVLDLGLSLSSLLARGGAAGSNGGLPAVPLEKMGNRFSSTASAATNDYSEGKTLELRMGACSHGGDGTEERLDLQLRLGY

SEQ ID NO: 1845 - protein, 338 aa, Brassica nigra
  misc_feature: Public GI ID no. 194244906
  misc_feature (1)..(338): Bit score of 718.2 for HMM based on sequences of FIGURE 6.
  misc_feature (277)..(321): Pfam Name: CCT Pfam Description: CCT motif
  misc_feature (55)..(97): Pfam Name: zf-B_box Pfam Description: B-box zinc finger
  misc_feature (7)..(54): Pfam Name: zf-B_box Pfam Description: B-box zinc finger
  misc_feature: Functional Homolog Of SEQ ID NO. 456
MLKQESNWAQACDTCRSAACTVYCRADSAYLCTSCDAQIHAANRLASRHERVRVCESCERAPAAFFCKADAASLCTACDSQIHSANPLARRHQRVPILPISGCVATNHSSKTTEPENIVVVGQEEEDEAEAASWLLPSSVKNCGDNNNNNNNSENNRFSVGEEYLDLVDYSSSIDKRFTGQSNQYQQDYNVPQRSYVADGVVPLQVGVANGHMHHEQHNFQFGFTNVSSEASPIHMVSLVPETVTSDATVSHPRSPKAGTEELPEAPVQMLSPMERKARVLRYREKKKTRKFEKRIRYASRKEYAEKRPRIKGRFAKRNEVDADHALSTMVVFDTGYG

SEQ ID NO: 1846 - protein, 343 aa, Prunus persica
  misc_feature: Public GI ID no. 197726026
  misc_feature (1)..(343): Bit score of 677.7 for HMM based on sequences of FIGURE 6.
  misc_feature (282)..(326): Pfam Name: CCT Pfam Description: CCT motif
  misc_feature (1)..(48): Pfam Name: zf-B_box Pfam Description: B-box zinc finger
  misc_feature (49)..(91): Pfam Name: zf-B_box Pfam Description: B-box zinc finger
  misc_feature: Functional Homolog Of SEQ ID NO. 456
MASKLCDSCKSATATLFCRADSAFLCVNCDSKIHAANKLASRHARVWLCEVCEQAPAHVTCKADDAALCVTCDRDIHSANPLSRRHERVPVTPFYDSGNSAANSAPVVKSVVNFLDDRYFSDVDGQDAETEVSREEAEAASWLLPNPKAMENPDLNSGEYFLPEMDPYLDLDYGHVDPKLEDAQEQNSCGTDGVVPVQSKSVQPQLVNDHSFEIDFSAASKPYVYGFHAQCLSQSVSSSSMDVSVVPDGNTTMTDVCDPYTKSMSAAVESTHQAVQISSADREARVLRYREKRKNRKFEKTIRYASRKAYAETRPRIKGRFAKRTEVEIEAERLCRYGVVPSF

SEQ ID NO: 1847 - protein, 319 aa, Olea europaea
  misc_feature: Public GI ID no. 198285679
  misc_feature (1)..(319): Bit score of 515.5 for HMM based on sequences of FIGURE 6.
  misc_feature (252)..(296): Pfam Name: CCT Pfam Description: CCT motif
  misc_feature (1)..(46): Pfam Name: zf-B_box Pfam Description: B-box zinc finger
  misc_feature: Functional Homolog Of SEQ ID NO. 456
MWVCEACERAPAAFLCKADAASLCITCDSDIHSAQPLARRHQRVPILPIPGMLCGTPSAPYPSGLVMGPTGVAAKIEFLTQDEDQTIHEEEDEDEAASWPLFNHVKNICNQSNNIGRFFGGEVDEYLDLDEYNSYQDNQFSNQDNNQLQPYDVSQKSYGSDNVVPIQYGKSKDQIHNHGFQLGREYEASKNVYDNPASISHTVSFSSLDVGVVPESTTSEVSVPHPRPPKGTIDLFSSPPIPMPTQLSPMDREARVLRYREKKKARKFEKTIRYASRKAYAETRPRIKGRFAKRTDVRANQMFSSTLIEEGGYGIVPSF

SEQ ID NO: 1848 - protein, 321 aa, Brassica rapa subsp. campestris
  misc_feature: Public GI ID no. 33943521
  misc_feature (1)..(321): Bit score of 550.0 for HMM based on sequences of FIGURE 6.
  misc_feature (252)..(296): Pfam Name: CCT Pfam Description: CCT motif
  misc_feature (46)..(93): Pfam Name: zf-B_box Pfam Description: B-box zinc finger
  misc_feature: Functional Homolog Of SEQ ID NO. 456
MLKEESNESGGTRACDTCRSAACTIYREADSTYLCTTCDARVHAAKRVRVCDSCESAPAAFFCKADAASLCTACDAEIHSANPLARRHQRVPITSNSCGSMATDGDNNVMMVSEEKEDADEVASWLMLNPGKNNQNNGFLFGVEYLDLVDYSSSIDNQFEDQYSKYHRSFGGGEDGVVPLQLEESSTSHMQQSQHNFHLGVNYGYSTEPQYSYVSVVPESLSDTTVQHAKETIDQVCGPPTQMVQQLTPADREARVLRYREKKKRRKFEKTIRYASRKAYAEVRPRIKGRFAKRIDMEADAEQLFSTSVMSNTSYGIVPSF

SEQ ID NO: 1849 - DNA, 2100 bp, Sorghum bicolor; identical to SEQ ID NO: 1731
  misc_feature: Ceres Annot ID no. 8679828
  misc_feature: Encodes the peptide sequence at SEQ ID NO. 1850

SEQ ID NO: 1850 - protein, 699 aa, Sorghum bicolor; identical to SEQ ID NO: 1732
  misc_feature: Ceres Annot ID no. 8679828
  misc_feature (1)..(699): Bit score of 1325.0 for HMM based on sequences of FIGURE 22.
  misc_feature (220)..(498): Pfam Name: FAD_binding_7 Pfam Description: FAD binding domain of DNA photolyase
  misc_feature (17)..(189): Pfam Name: DNA_photolyase Pfam Description: DNA photolyase
  misc_feature: Functional Homolog Of SEQ ID NO. 538

SEQ ID NO: 1851 - DNA, 2058 bp, Sorghum bicolor; identical to SEQ ID NO: 1733
  misc_feature: Ceres Annot ID no. 8738520
  misc_feature: Encodes the peptide sequence at SEQ ID NO. 1852

SEQ ID NO: 1852 - protein, 685 aa, Sorghum bicolor; identical to SEQ ID NO: 1734
  misc_feature: Ceres Annot ID no. 8738520
  misc_feature (1)..(685): Bit score of 1367.6 for HMM based on sequences of FIGURE 22.
  misc_feature (212)..(490): Pfam Name: FAD_binding_7 Pfam Description: FAD binding domain of DNA photolyase
  misc_feature (5)..(176): Pfam Name: DNA_photolyase Pfam Description: DNA photolyase
  misc_feature: Functional Homolog Of SEQ ID NO. 538

SEQ ID NO: 1853 - DNA, 2207 bp, Brassica napus; identical to SEQ ID NO: 1735
  misc_feature: Ceres Clone ID no. 1093780
  misc_feature: Encodes the peptide sequence at SEQ ID NO. 1854

SEQ ID NO: 1854 - protein, 581 aa, Brassica napus; identical to SEQ ID NO: 1736
  misc_feature: Ceres Clone ID no. 1093780
  misc_feature (1)..(581): Bit score of 1523.0 for HMM based on sequences of FIGURE 22.
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of SEQ ID NO. 538

SEQ ID NO: 1855 - DNA, 2723 bp, Panicum virgatum
  misc_feature: Ceres Clone ID no. 1784494
  misc_feature: Encodes the peptide sequence at SEQ ID NO. 1856
agaagcaccaactgcaagagcaccaacaccgaacaaaaacataatcaaattgcgagcccagaaatacaaggaaaaatattactcctgcaactcgtgcggcgcactcctccactgttcttgggaatcttgggaggaagaaagtagagtctctgagctccctgccagttcgtggcgcgagtggcctcatggtttcttgacgtcatctgctcttgatccaagaactcgggggtttcttggaccggtggttcttggattggccggccatgtcggtctcgtccccgtccatgtgcggcggcggggagaccgggaggatcgtggtgtggttccggagggacctcagggtggaggacaacccggcgctagcggcggcggcgcgcgccggaggggaggtggtgccggcgtacgtgtggtcgccggaggaggacggcccttaccatccggggcgcgtgtcccggtggtggatcagccagagcctgcagcatctggacgcctcgctccgccggctaggggcaggaaagctcgtcacgcggaggtctgccgacgccgtcgtcgctctgctccagctggtccgcgacaccggcgccacgcacgtctacttcaatcatctctacgaccctatctcgctggtcagggaccaccggctgaaggagatgctgacggctgagggcattgtcgtgcgatctttcaatgcggatctgctttatgagccatgggaagttgttgatgatgaagggcagccattcaccatgtttgccccattctggaacaggtgcctcagcatgtcgtacgatccccccgcgccgcttctgcccccgaagaagatcaattcaggtaacttatcaatgtgcccatccgatgatctgatctttgaggatgaatcagagaggggaagcaacgctcttctggcccgagcatggacaccaggatggcagaacgcagacaaggcgctaacggccttcctcaacggtcctctggctgactattcagtgaaccgcaagaaggctgatagcgcaagcacatccctactttcaccgcacctccattttggtgagcttagcgtgcgcaaggtcttccacctagttcgtatgaaacagcttgtgtggagcaacgagggcaaccacgctgctgaggagagctgcacactgttcctgagttccattggcctgcgggagtactcccgctatctgagcttcaaccatccaagcagccatgagaggcccctcttggcacacctcaggttcttcccctgggtggtcaatgagtgctacttcaagatttggaggcagggaaggactggatacccgcttgtggatgctggcatgagggaactgtgggcgacagggtggttgcatgaccggatacgtgtggtggtgtcaagcttctttgtcaaggtccttcaacttccatggcgatggggtatgaagtacttctgggacactttactggatgcagatcttgagagcgatgcactgggctggcagtacatcactggctctctccctgatggtcgagagcttgaccgcattgacaaccctcagtttgaaggctacaagtttgacccgcatggggagtatgttcgacggtggattccggagcttgcaaggctgccgacagaatggatacatcacccatgggatgcacctgtttccgtgctacaagctgcaggaattgagttgggctccaactatcctctccccgtagttgagctagaagcagccaaagccaggctgcaagaagccctgtcagaaatgtggcagctggaggccgcatcaagggccacaatgaacaatggaatggaggaaggcctcggcgactcctcggaggttccgccgattgagtttcctcaagaattacagatggaagtcgatcggccgccagcccaggcaacggccaatgtgccgataactgctcggaggcgtgaggatcagatggtgcctaccatgacgtcttcactgaacagagctgaaacagaggtttctgccgacctggggaatagtgaggacactagagcacaggttccgtttcattcacatttcgaacctcgagttgagagggaagatgcaatccaaaatgcagaaggccctgctcctagaatcaatggagttcaccagcacaacatctttcagcaacctcagcatcgtaggcgagaagctgttgcgccatccgtgtcggaggcttcgagtagctggaccgggagagaaggcgctgtagtcccagtttggtcacctcctgcagcatcaggccattcagaaacttttgctgctgatgaagctgacgtttctagtaggagttatttggataggcatccccagtcgcaccggttgatgaactggagtcagctatcccagtcactgtgagttcggatgcaccgtaacccattgttctcagacaacaggctgggaagtggaaaattccgtgcagccaaatttaatcggttagggttttctaaagatgggattcatatgtaaattttccagtctgttgctcatctatagtctggtgggcatgcaaaccaggctgctcgttcctgtatgtgataatagtcgtgtaaatctaatccgctagaacttgtgtgatcgacatagggtgcttaaaaaaagtcactattattgatcagacaatgaatgttttctgtaattttgacccttttttggaggtgtgctatgcatgtaaatgtacattcccttgtgtctgttgaccattagcgatctttggttactatc

SEQ ID NO: 1856 - protein, 697 aa, Panicum virgatum; identical to SEQ ID NO: 1518
  misc_feature: Ceres Clone ID no. 1784494
  misc_feature (1)..(697): Bit score of 1286.9 for HMM based on sequences of FIGURE 22.
  misc_feature (219)..(497): Pfam Name: FAD_binding_7 Pfam Description: FAD binding domain of DNA photolyase
  misc_feature (15)..(188): Pfam Name: DNA_photolyase Pfam Description: DNA photolyase
  misc_feature: Functional Homolog Of SEQ ID NO. 538

SEQ ID NO: 1857 - DNA, 2601 bp, Panicum virgatum; identical to SEQ ID NO: 1737
  misc_feature: Ceres Clone ID no. 1814900
  misc_feature: Encodes the peptide sequence at SEQ ID NO. 1858

SEQ ID NO: 1858 - protein, 698 aa, Panicum virgatum; identical to SEQ ID NO: 1738
  misc_feature: Ceres Clone ID no. 1814900
  misc_feature (1)..(698): Bit score of 1302.0 for HMM based on sequences of FIGURE 22.
  misc_feature (220)..(498): Pfam Name: FAD_binding_7 Pfam Description: FAD binding domain of DNA photolyase
  misc_feature (16)..(189): Pfam Name: DNA_photolyase Pfam Description: DNA photolyase
  misc_feature: Functional Homolog Of SEQ ID NO. 538

SEQ ID NO: 1859 - protein, 681 aa, Vitis vinifera; identical to SEQ ID NO: 1739
  misc_feature: Public GI ID no. 157335888
  misc_feature (1)..(681): Bit score of 1510.0 for HMM based on sequences of FIGURE 22.
  misc_feature (207)..(485): Pfam Name: FAD_binding_7 Pfam Description: FAD binding domain of DNA photolyase
  misc_feature (5)..(176): Pfam Name: DNA_photolyase Pfam Description: DNA photolyase
  misc_feature: Functional Homolog Of SEQ ID NO. 538

SEQ ID NO: 1860 - protein, 643 aa, Vitis vinifera; identical to SEQ ID NO: 1740
  misc_feature: Public GI ID no. 157336718
  misc_feature (1)..(643): Bit score of 1649.6 for HMM based on sequences of FIGURE 22.
  misc_feature (208)..(486): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of SEQ ID NO. 538

SEQ ID NO: 1861 - protein, 700 aa, Triticum aestivum; identical to SEQ ID NO: 1741
  misc_feature: Public GI ID no. 161138112
  misc_feature (1)..(700): Bit score of 1286.0 for HMM based on sequences of FIGURE 22.
  misc_feature (221)..(499): Pfam Name: FAD_binding_7 Pfam Description: FAD binding domain of DNA photolyase
  misc_feature (17)..(190): Pfam Name: DNA_photolyase Pfam Description: DNA photolyase
  misc_feature: Functional Homolog Of SEQ ID NO. 538

SEQ ID NO: 1862 - protein, 698 aa, Triticum aestivum; identical to SEQ ID NO: 1742
  misc_feature: Public GI ID no. 161138114
  misc_feature (1)..(698): Bit score of 1301.0 for HMM based on sequences of FIGURE 22.
  misc_feature (219)..(497): Pfam Name: FAD_binding_7 Pfam Description: FAD binding domain of DNA photolyase
  misc_feature (15)..(188): Pfam Name: DNA_photolyase Pfam Description: DNA photolyase
  misc_feature: Functional Homolog Of SEQ ID NO. 538

SEQ ID NO: 1863 - protein, 650 aa, Triticum aestivum; identical to SEQ ID NO: 1743
  misc_feature: Public GI ID no. 161138116
  misc_feature (1)..(650): Bit score of 1468.4 for HMM based on sequences of FIGURE 22.
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of SEQ ID NO. 538

SEQ ID NO: 1864 - protein, 650 aa, Triticum aestivum; identical to SEQ ID NO: 1744
  misc_feature: Public GI ID no. 161138118
  misc_feature (1)..(650): Bit score of 1502.4 for HMM based on sequences of FIGURE 22.
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of SEQ ID NO. 538

SEQ ID NO: 1865 - protein, 612 aa, Arabidopsis thaliana; identical to SEQ ID NO: 1745
  misc_feature: Public GI ID no. 166007537
  misc_feature (1)..(612): Bit score of 1695.1 for HMM based on sequences of FIGURE 22.
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of SEQ ID NO. 538

SEQ ID NO: 1866 - protein, 612 aa, Arabidopsis thaliana; identical to SEQ ID NO: 1746
  misc_feature: Public GI ID no. 166007547
  misc_feature (1)..(612): Bit score of 1693.8 for HMM based on sequences of FIGURE 22.
  misc_feature (211)..(489): Pfam Name: FAD_binding_7 Pfam Description: FAD binding domain of DNA photolyase
  misc_feature (5)..(175): Pfam Name: DNA_photolyase Pfam Description: DNA photolyase
  misc_feature: Functional Homolog Of SEQ ID NO. 538

SEQ ID NO: 1867 - protein, 164 aa, Vitis vinifera
  misc_feature: Public GI ID no. 157336039
  misc_feature (1)..(164): Bit score of 304.5 for HMM based on sequences of FIGURE 24.
  misc_feature: Functional Homolog Of SEQ ID NO. 570
MENSMVLAHETQPHRDFSASSLRDVSYSCGSCGYELKLCSSNRNTKNIGSKYGKNIKRGVISFLQVDESRFTLVDEFKCIPYFISRHSWGLFCHRTKLLCRKCSNHVGNAYVRKSPYPLVLDESDSAPAPATATTDISTCRKYDIRLRALQPSSSEPSAIPLLT

SEQ ID NO: 1868 - DNA, 459 bp, Solanum lycopersicum
  misc_feature: Ceres Annot ID no. 8454153
  misc_feature: Encodes the peptide sequence at SEQ ID NO. 1869
atggacatcagtcatgacttagcaaaagttgattcgatgccaaacaaaaactcatctccctgctgtggcagttgtgggtatgagttaaatcttaattcatcaagtcgcaatactgcttccattgggtccaagtatgggaagtccattaagaaagggatgatctccttcttgtccattgatgagagcagatttacccaggttgatgaattcaagtgtgtaccgttctttttctccaaacgttcttggggcttgttccagcggcgaacaaaacttcagtgcagaaaatgtggtaacgatattggaattgcttatgatgatagtgcttcttcttacccacttgtagccgatgcatcagatacagcctccggtagtgaaataaccactcataggaaatacaatatcaaaatccgctcgttgcaaccgtcttcctcagcatcgggtactcctctccctgagtga

SEQ ID NO: 1869 - protein, 152 aa, Solanum lycopersicum
  misc_feature: Ceres Annot ID no. 8454153
  misc_feature (1)..(152): Bit score of 292.8 for HMM based on sequences of FIGURE 24.
  misc_feature: Functional Homolog Of SEQ ID NO. 570
MDISHDLAKVDSMPNKNSSPCCGSCGYELNLNSSSRNTASIGSKYGKSIKKGMISFLSIDESRFTQVDEFKCVPFFFSKRSWGLFQRRTKLQCRKCGNDIGIAYDDSASSYPLVADASDTASGSEITTHRKYNIKIRSLQPSSSASGTPLPE

SEQ ID NO: 1870 - protein, 154 aa, Vitis vinifera
  misc_feature: Public GI ID no. 157344920
  misc_feature (1)..(154): Bit score of 222.8 for HMM based on sequences of FIGURE 24.
  misc_feature: Functional Homolog Of SEQ ID NO. 570
MEMLAGEDDRSSGFHHLHLSCSLRDVHYSCGSCGYQLNLNSCNRTSVLGSKYEKSIKKGIISFFSIDETRFTQTNELRCLPYFNSRCSWGLFRRRSKLLCKKCGNHIGNAYKTNNRSGKLDSSAWDGISDSSRIYDIKICALQPSSSLESDAFV

SEQ ID NO: 1871 - protein, 162 aa, Populus balsamifera subsp. trichocarpa
  misc_feature: Public GI ID no. 118485259
  misc_feature (1)..(162): Bit score of 198.2 for HMM based on sequences of FIGURE 24.
  misc_feature: Functional Homolog Of SEQ ID NO. 570
MGSEDLDNKIQDFQCPSSPLSLSLPHVNYSCGSCGYQLNLNSCNRNTPDIGVNYKKSIKKGSISFFSIDETRFTQIEELRCTPYFNSMRSWGLFQRRTKLLCYKCGNHLGIAYKENNTSSSPLRLGKCRSDLISWDGISDARIYVIKIRSLQPASTEDYSLS

SEQ ID NO: 1872 - DNA, 685 bp, Brassica oleracea
  misc_feature: Public GI ID no. 150909209
  misc_feature: Encodes the peptide sequence at SEQ ID NO. 1873
ggttgctagaaagttgcgaccacgacattggtcgcggaggcgtgaaaaagttttaaccgaatcaatcaagtgggagggacacgttcttcatcatcaacctattaatcaaacccactcttctcggtcacgaaagtcttggaagctttccctgatttcgagcgacgatggacagatcagcgtcggtgggtatcaaggacggccgatttggtggcaaccacttgtattctccatcattttcttcttcatcttccatgagacatgtcaattacagttgtggatcttgtgggtacgagctgaacttgagctccaccaatcgaattacatcatcaattggatcaaagtatgggaaatccatgaagactggaatcatatccttcttcaacattgacgagggaagattcagccagattgatgagttccaatgcatgccacacttctccagatactcttggggtttgttcagacgcaagactaagcttctctgtcgccaatgtaataactatatcggcaatgcttcttatgacaaggcccctcctgagtacgcactcgtaacacaaaactcatcgcccaggaagggtgtcactgacactgttaccaagtatgatatcagaattcgtgcgcttcaaccttcttccgctgttgcttctctgtgagtgagtgtgtttcttctacaactgtatattgt

SEQ ID NO: 1873 - protein, 162 aa, Brassica oleracea
  misc_feature: Public GI ID no. 150909209
  misc_feature (1)..(162): Bit score of 427.5 for HMM based on sequences of FIGURE 24.
  misc_feature: Functional Homolog Of SEQ ID NO. 570
MDRSASVGIKDGRFGGNHLYSPSFSSSSSMRHVNYSCGSCGYELNLSSTNRITSSIGSKYGKSMKTGIISFFNIDEGRFSQIDEFQCMPHFSRYSWGLFRRKTKLLCRQCNNYIGNASYDKAPPEYALVTQNSSPRKGVTDTVTKYDIRIRALQPSSAVASL

SEQ ID NO: 1874 - DNA, 782 bp, Raphanus sativus (radish)
  misc_feature: Public GI ID no. 166139500
  misc_feature: Encodes the peptide sequence at SEQ ID NO. 1875
ggggaggcgtgaagaagtttaaagtcacgcagaatcaatcaaagtgggaggagggacagacacgttcttcctcatcccaacctattactcacgaaactctggaaagctttgccctgatttcgagcaacgatggacagatcggcgtcggttggtatcaacgacagccgatttgctggcaatcacttgtattctccatcatttccttcttcctcttccatgagacatgtcaattacagttgtggatcttgtgggtacgagctgaacttgagctccacgaatcggatcacatcatcaatcggatcaaagtacgggaaatcaatgaagacaggaatcatatccttcttcaacattgacgaggggaggttcagtctggtggatgagttccaatgcatgcctcacttcttctccagatactccttcggtttgttcagacgcaagactaagcttctctgccgccaatgtagaaaccatatcggcactgcttcttatgacaaggcccctcctcagtacgcactcgttacaacacaaaactcgtcatcccccaggaagggtggtggtgttgtcactgacactgttaccaagtatgatatcaggatccgtgcccttcaaccttcttccgctcttgcttctctgtgagtgcgtttcttctttattgtagaaagacttcaaagtatcagatttagatcttcacgaagtgcttctgtatcagtactgttttcataagtgggtttggcttttgtcttttctttcaaattgtatagtatatacatttgccttttttg

SEQ ID NO: 1875 - protein, 168 aa, Raphanus sativus (radish)
  misc_feature: Public GI ID no. 166139500
  misc_feature (1)..(168): Bit score of 376.4 for HMM based on sequences of FIGURE 24.
  misc_feature: Functional Homolog Of SEQ ID NO. 570
MDRSASVGINDSRFAGNHLYSPSFPSSSSMRHVNYSCGSCGYELNLSSTNRITSSIGSKYGKSMKTGIISFFNIDEGRFSLVDEFQCMPHFFSRYSFGLFRRKTKLLCRQCRNHIGTASYDKAPPQYALVTTQNSSSPRKGGGVVTDTVTKYDIRIRALQPSSALASL

SEQ ID NO: 1876 - DNA, 644 bp, Medicago truncatula (barrel medic)
  misc_feature: Public GI ID no. 11916089
  misc_feature: Encodes the peptide sequence at SEQ ID NO. 1877
  misc_feature (619)..(619): n is a, c, t, g, unknown, or other
gtcaaacacgcgtttcatcagggacaccgcctgtcctcacaaacaacttccaattccccataacacatatctctctcacacgcgctcttcgccgtcacggtggctcttcctcaatccaccgccaccaccgctataaaaccgtcaccggagaaaaccatttaatggataataattcggttttcaatggacatggaaattataaccgaacattctcctcttattcttccgcttctcagagagatgttcgttacagctgtggcgcttgtggttatgagctgaacctatcatcgtcaaaccggaacaccacatctatcggatcaaaatacgggaagtccataaagcgaggtatcatatcatttttcaatattgatgatagcagatttacccaggttgatgagattcagtgcgcaccacattttcataagcactcatggggcttgttccgccgaagaacgaagcttctttgtcgcaagtgtggcaatcatataggaaatgcatacaatggtttcacttcttctttccctctcgtgacagacggagaagagtcatcccctagctccaaagtgtccagtggtgtaaaatatgacattcgtattcgttcattgcagccctcatcttncgacgaatctggaattcctgtattt

SEQ ID NO: 1877 - protein, 151 aa, Medicago truncatula (barrel medic)
  misc_feature: Public GI ID no. 11916089
  misc_feature (1)..(151): Bit score of 345.9 for HMM based on sequences of FIGURE 24.
  misc_feature: Functional Homolog Of SEQ ID NO. 570
MDNNSVFNGHGNYNRTFSSYSSASQRDVRYSCGACGYELNLSSSNRNTTSIGSKYGKSIKRGIISFFNIDDSRFTQVDEIQCAPHFHKHSWGLFRRRTKLLCRKCGNHIGNAYNGFTSSFPLVTDGEESSPSSKVSSGVKYDIRIRSLQPS

SEQ ID NO: 1878 - DNA, 588 bp, Populus euphratica
  misc_feature: Public GI ID no. 50071101
  misc_feature: Encodes the peptide sequence at SEQ ID NO. 1879
  misc_feature (524)..(524): n is a, c, t, g, unknown, or other
gtaatgagtactgctttgatcaccattaactcagtaaatattctgtcaccgatcgtttgagtctcaatcacgatcacagccgttgatcaaggaggagaaatggaaaaatctacggctttcagggaagcttacctcaacgggaatcaccatcattccttttcttcttcctctgcttctcatagacatgttagctacagctgcggtatctgcgggtatgagttgaacttgagctcctccaatcgaaacacgtcaacaattggctctaaatatgggaaatccataaagcgagggaaaatctcattcttcttgatcgatgagagtagatttactcaggttgatgaattccaatgctttcccttcttttcaaaaaactcccttggtttgttccgccagagaactgcacttctttgccgcaagtgtggtaatcacattggaattgcttatgctgatgaagcttcagcttatccacttgtagcagacggatctgactcttcctcagtcagtgaagttttcaaacgtcgaanatatgatgttaaaatccgtgccttgcagccttcttctgccgagcagtttagcattccactttac

SEQ ID NO: 1879 - protein, 163 aa, Populus euphratica
  misc_feature: Public GI ID no. 50071101
  misc_feature (1)..(163): Bit score of 387.8 for HMM based on sequences of FIGURE 24.
  misc_feature: Functional Homolog Of SEQ ID NO. 570
  misc_feature (142)..(142): Xaa is any aa, unknown, or other
MEKSTAFREAYLNGNHHHSFSSSSASHRHVSYSCGICGYELNLSSSNRNTSTIGSKYGKSIKRGKISFFLIDESRFTQVDEFQCFPFFSKNSLGLFRQRTALLCRKCGNHIGIAYADEASAYPLVADGSDSSSVSEVFKRRXYDVKIRALQPSSAEQFSIPLY

SEQ ID NO: 1880 - DNA, 700 bp, Populus euphratica
  misc_feature: Public GI ID no. 50071274
  misc_feature: Encodes the peptide sequence at SEQ ID NO. 1881
accaattacatgtaatgagtactgctttgatcaccattaactcagtaaatattctgtcaccgatcgtttgagtctcaatcacgatcacagccgttgatcaaggaggagaaatggaaaaatctacggctttcagggaagcttacctcaacgggaatcaccatcattccttttcttcttcctctgcttctcatagacatgttagctacagctgcggtatctgcgggtatgagttgaacttgagctcctccaatcgaaacacgtcaacaattggctctaaatatgggaaatccataaagcgagggaaaatctcattcttcttgatcgatgagagtagatttactcaggttgatgaattccaatgctttcccttcttttcaaaaaactcccttggtttgttccgccagagaactgcacttctttgccgcaagtgtggtaatcacattggaattgcttatgctgatgaagcttcagcttatccacttgtagcagacggatctgactcttcctcagtcagtgaagttttcaaacgtcgaaaatatgatgttaaaatccgtgccttgcagccttcttctgccgagcagtttagcattccactttacacctgatgtattggagcaagcctcttcatgttttatgtcaatcaaatgatgtcaattagacgtcaaaaactatggcagaggttttcctgtgacactttcat

SEQ ID NO: 1881 - protein, 164 aa, Populus euphratica
  misc_feature: Public GI ID no. 50071274
  misc_feature (1)..(164): Bit score of 402.4 for HMM based on sequences of FIGURE 24.
  misc_feature: Functional Homolog Of SEQ ID NO. 570
MEKSTAFREAYLNGNHHHSFSSSSASHRHVSYSCGICGYELNLSSSNRNTSTIGSKYGKSIKRGKISFFLIDESRFTQVDEFQCFPFFSKNSLGLFRQRTALLCRKCGNHIGIAYADEASAYPLVADGSDSSSVSEVFKRRKYDVKIRALQPSSAEQFSIPLYT

SEQ ID NO: 1882 - DNA, 698 bp, Antirrhinum majus (snapdragon)
  misc_feature: Public GI ID no. 51119043
  misc_feature: Encodes the peptide sequence at SEQ ID NO. 1883
attgaatcttctatcaatcaacgctgattttattctaatttacaagtcgcaatcgagaagaatattccgttcatggagaatccaaataatcatctgtactcagcttcgttcgccgcttctcaacgagatgtcacttacagctgtggttcttgtggctatgacctaaacctgaactcatccagtagaaacacatcaaccattggttccaaatacggcaaatccataaagaaagggataatttcttttttcaccgtagatgagagcagatttactcaggttgaagaggtccaatgtttgccctactttttttccaagcattcgtggggtatgttcagtcggagaacaaaactactgtgccgcaaatgtgggaactatattggtattgcttctgatgctagtgcttcttcttacgagcttataacaaatggatcaggttcaccctctagcagtgagatacctaatctgagaaagtatgatatcaggattcgttctttgcaaccatcttcagcagagtttgctactcctcttgccttgtgattgtcttgtgaaaagctcgtgtaccataaatctttcaattttggatgcagtgtatttattcaattagtgcgtttatgtggtgaaaagacatgctagctgttcctgaaatgcgtgattgtttttcttcagcataggtaatggtaggcagtagatttatcgga

SEQ ID NO: 1883 - protein, 154 aa, Antirrhinum majus
  misc_feature: Public GI ID no. 51119043
  misc_feature (1)..(154): Bit score of 334.2 for HMM based on sequences of FIGURE 24.
  misc_feature: Functional Homolog Of SEQ ID NO. 570
MENPNNHLYSASFAASQRDVTYSCGSCGYDLNLNSSSRNTSTIGSKYGKSIKKGIISFFTVDESRFTQVEEVQCLPYFFSKHSWGMFSRRTKLLCRKCGNYIGIASDASASSYELITNGSGSPSSSEIPNLRKYDIRIRSLQPSSAEFATPLAL

SEQ ID NO: 1884 - DNA, 691 bp, Glycine max
  misc_feature: Public GI ID no. 151396208
  misc_feature: Encodes the peptide sequence at SEQ ID NO. 1885
cttctctacctttggatccttcctttcactttggcgtgaccgaaccattccactccctcgcaaaacggtgtcgtgtcgatcgcgttcggttcggtcaaactcgcgcgtcccgaatcctccggaacacgctctgtcccaattccctataattcacttctctctctctcgcttaacctctcctccacggtggctcttccgcattctgccaccgcctccgccgtcgccgataatcactaatcaatagatggatgattcggcgttcaaacgagacggtcactttaaccgaacttactcctgctcttctcagagaggtgtccgttacagctgtggcacttgtggttatgagctgaacccgtcctcctcgaaccggaacactgcatccattggatctaaatatgggaagtccataaagcgaggtattatatcattcttcagcattgatcttagcagatttacccaggttgatgaaattcagtgtgtgccccattttgataagcactcatggggtttgtttcgccgaagaaccaagcttctttgtcgcaaatgtggcaaccatattggaaatgcatacaatggttacacttcgtcctttcctcttgtgacagacggagctgaatcatctcctagctccaaagtggtcagtcatacaaaatacgacattcgcattcgtgccctacaaccttcatcttct

SEQ ID NO: 1885 - protein, 149 aa, Glycine max (soybean)
  misc_feature: Public GI ID no. 151396208
  misc_feature (1)..(149): Bit score of 386.0 for HMM based on sequences of FIGURE 24.
  misc_feature: Functional Homolog Of SEQ ID NO. 570
MDDSAFKRDGHFNRTYSCSSQRGVRYSCGTCGYELNPSSSNRNTASIGSKYGKSIKRGIISFFSIDLSRFTQVDEIQCVPHFDKHSWGLFRRRTKLLCRKCGNHIGNAYNGYTSSFPLVTDGAESSPSSKVVSHTKYDIRIRALQPSSS

SEQ ID NO: 1886 - DNA, 718 bp, Medicago truncatula
  misc_feature: Public GI ID no. 22089157
  misc_feature: Encodes the peptide sequence at SEQ ID NO. 1887
tgcaggccattatggcgggggccgtcacggtggctcttcctcaatccaccgccaccaccgctataaaaccgtcaccggagaaaaccatttaatggataataattcggttttcaatggacatggaaattataaccgaacattctcctcttattcttccgcttctcagagagatgttcgttacagctgtggcgcttgtggttatgagctgaacctatcatcgtcaaaccggaacaccacatctatcggatcaaaatacgggaagtccataaagcgaggtatcatatcatttttcaatattgatgatagcagatttacccaggttgatgagattcagtgcgcaccacattttcataagcactcatggggcttgttccgccgaagaacgaagcttctttgtcgcaagtgtggcaatcatataggaaatgcatacaatggtttcacttcttctttccctctcgtgacagacggagaagagtcatcccctagctccaaagtgtccagtggtgtaaaatatgacattcgtattcgttcattgcagccctcatcttccgacgaatctggaattcctgtattagcttgaaataccgggtaatagttgtactttttccttgctacatagtagtcattggtgcaggttagaagttcatcgatatgtgcagtgatccggtttggcaaggtttttgtattttccctcatcaaaatgtgaataatagatgta

SEQ ID NO: 1887 - protein, 162 aa, Medicago truncatula
  misc_feature: Public GI ID no. 22089157
  misc_feature (1)..(162): Bit score of 386.1 for HMM based on sequences of FIGURE 24.
  misc_feature: Functional Homolog Of SEQ ID NO. 570
MDNNSVFNGHGNYNRTFSSYSSASQRDVRYSCGACGYELNLSSSNRNTTSIGSKYGKSIKRGIISFFNIDDSRFTQVDEIQCAPHFHKHSWGLFRRRTKLLCRKCGNHIGNAYNGFTSSFPLVTDGEESSPSSKVSSGVKYDIRIRSLQPSSSDESGIPVLA

SEQ ID NO: 1888 - DNA, 611 bp, Cicer arietinum (chickpea)
  misc_feature: Public GI ID no. 169748289
  misc_feature: Encodes the peptide sequence at SEQ ID NO. 1889
attccaacaccttcctattattcatttctctcgcgcgcgtgcttttcaccgccaaggtggctctttctcaatcggccaccaccgctgccacgccgttaccggataatactatttaatggataataaatcgggtttcaatggagatagccactttaaccgaacattctcctcttattcttccgcttcccaaagggatgtccgttacagctgtggtgcttgtgggtatgagcttaacctatcctcctcaaaccggaacaccacatccatcggatctaaatacgggaagtccataaagcgaggtgtcatatcattcttcaatattgatgacagcagatttacccaggttgatgagattcagtgtgtgcctcattttcataaacattcatggggcttgtttcgccgaacaacaaagcttctttgtcgcaagtgtggtaaccatattggaaatgcatacaatggtttcacttcatccttacctctcgtgtcagacggagcagagtcatcccctggctccaaagtgtccggtagtgtaaaatatgacattcgccttcggtcgttacagccttcatcgtctgaagaatctggaatccgtgcattaacttgaaatacct

SEQ ID NO: 1889 - protein, 162 aa, Cicer arietinum
  misc_feature: Public GI ID no. 169748289
  misc_feature (1)..(162): Bit score of 356.9 for HMM based on sequences of FIGURE 24.
  misc_feature: Functional Homolog Of SEQ ID NO. 570
MDNKSGFNGDSHFNRTFSSYSSASQRDVRYSCGACGYELNLSSSNRNTTSIGSKYGKSIKRGVISFFNIDDSRFTQVDEIQCVPHFHKHSWGLFRRTTKLLCRKCGNHIGNAYNGFTSSLPLVSDGAESSPGSKVSGSVKYDIRLRSLQPSSSEESGIRALT

SEQ ID NO: 1890 - DNA, 541 bp, Malus x domestica
  misc_feature: Public GI ID no. 51294106
  misc_feature: Encodes the peptide sequence at SEQ ID NO. 1891
tagtttcaaaacggtcgaattttcagaaaattctcccccaccgccaccgtgtcagccgttggtttcagcgtcttggatggagaaatcgaatatttacagaggcagttacactaacggagcttaccatccaaccttctcttcctcttctcgcgccgatgtcagttacagctgtggctcttgtggctatgagctgaacctaagttccaacaaccggaacacttctacaattggctctaataagtatggaaaatctataaagcgggggatcatatcgttctttaacatcgatgagagcagatttactcaggttgatgaacttaagtgtaaaccccatttctctaagcgttcatggggtttgttcagccggagaactaaacttctttgtcgcaagtgtggtaaccatataggaaatgcttatgatgagtacacttcatcttcttacccacttgtgttagatggatcagattcatcatcaggccatgaagttaccaaatgcagaaaatttgatgttagaattcgtgccttgcagccttcgaattct

SEQ ID NO: 1891 - protein, 155 aa, Malus x domestica
  misc_feature: Public GI ID no. 51294106
  misc_feature (1)..(155): Bit score of 344.4 for HMM based on sequences of FIGURE 24.
  misc_feature: Functional Homolog Of SEQ ID NO. 570
MEKSNIYRGSYTNGAYHPTFSSSSRADVSYSCGSCGYELNLSSNNRNTSTIGSNKYGKSIKRGIISFFNIDESRFTQVDELKCKPHFSKRSWGLFSRRTKLLCRKCGNHIGNAYDEYTSSSYPLVLDGSDSSSGHEVTKCRKFDVRIRALQPSNS

SEQ ID NO: 1892 - DNA, 782 bp, Gossypium arboreum
  misc_feature: Public GI ID no. 13356210
  misc_feature: Encodes the peptide sequence at SEQ ID NO. 1893
  misc_feature (685)..(685): n is a, c, t, g, unknown, or other
  misc_feature (719)..(719): n is a, c, t, g, unknown, or other
gcgcgttcccttttctctagaaactgctgctgttcttttttttccatccttttaactcggtccctgaaaattgagccgttaacgtcaacccgattcaggcggaaccgtttcctcactcaaaatcctcgcacaaactcagcagttaattaaacacttcataaagttgaatcgctttattagcacagttgccgttatagtgataatcaaaggtgttgattctgtaggaagaaggaaaaaagtaatggagaaatctgtttttgttaaagatgtacaacaactcaatggaaatctccaccattctttttcttctgtttctcaaagagatgtaacttacagctgtggttcttgtgggtatgagctaaacctaagttcctctagtagaaacaccgcaacaatcggctctaaatatggaaaatcgattaagcgagggatgatatcattcttcaatatagacgagaccagatttacgcaggtcgatgaattccaatgcagaccctacttttcgaagcactcgtggggtttattccgccatagaaccaaactactttgtcgcaagtgtgggaaccacattggcaatgcttatgatgataaatctactggctaccctcgtgtcttagatggttctgattcatcctccggcactgaaccttctaaccatagaaaatatgatgttagaatccgtgcnctacagccttcgactgctgaaggactcaacactncactttttgcgtgatttcctgcagtgcatcatggatggtactcggtttgaattatcaacgact

SEQ ID NO: 1893 - protein, 163 aa, Gossypium arboreum
  misc_feature: Public GI ID no. 13356210
  misc_feature (1)..(163): Bit score of 433.4 for HMM based on sequences of FIGURE 24.
  misc_feature: Functional Homolog Of SEQ ID NO. 570
  misc_feature (148)..(148): Xaa is any aa, unknown, or other
  misc_feature (160)..(160): Xaa is any aa, unknown, or other
MEKSVFVKDVQQLNGNLHHSFSSVSQRDVTYSCGSCGYELNLSSSSRNTATIGSKYGKSIKRGMISFFNIDETRFTQVDEFQCRPYFSKHSWGLFRHRTKLLCRKCGNHIGNAYDDKSTGYPRVLDGSDSSSGTEPSNHRKYDVRIRXLQPSTAEGLNTXLFA

SEQ ID NO: 1894 - DNA, 850 bp, Gossypium hirsutum
  misc_feature: Public GI ID no. 109841830
  misc_feature: Encodes the peptide sequence at SEQ ID NO. 1895
ttaaacacttcataaagttgaatcgctttattagtacagttgccgttatagtgataatcaaaggtgttgattctgtaggaagaaggaaaaaagtaatggagaaatctgtttttgttaaagatgtacaacaactcaatggaaatctccaccattctttttcctctgtttctcaaagagatgtaacttacagctgtggttcttgtgggtatgagctaaacttaagttcctctagtagaaacaccgcaacaatcggctctaaatatggaaaatcgattaagcgagggatgatatcattcttcaatatagacgagaccagatttacgcaggtcgatgaattccaatgcagaccctacttttcgaagcactcgtggggtttattccgccatagaaccaaactactttgtcgcaagtgtgggaaccacattggcaatgcttatgatgataaatcttctggctaccctcgtgtcttagatggttctgattcatcctctggcactgaaccttctaaccatagaaaatatgatgttagaatccgtgccctacagccttcgactgctgaaggactcagcactccactttttgcgtgatttcctgcagtgcatcattgatggtcctcggtttgaattatcaacgactgactgagcgttttcgtatgggattattgctgtctattagttggtttgagcctttcattttatgctgtctttgctgtgtttctgttaagtgtatatatgaaaggtaagtaatgtggagctttaaaattaggttgagcacagtaatgtcattacccaaatttaagtctaatatctgtttgagttgaattaaatcaagtatttttcttttggccttt

SEQ ID NO: 1895 - protein, 163 aa, Gossypium hirsutum (upland cotton)
  misc_feature: Public GI ID no. 109841830
  misc_feature (1)..(163): Bit score of 450.2 for HMM based on sequences of FIGURE 24.
  misc_feature: Functional Homolog Of SEQ ID NO. 570
MEKSVFVKDVQQLNGNLHHSFSSVSQRDVTYSCGSCGYELNLSSSSRNTATIGSKYGKSIKRGMISFFNIDETRFTQVDEFQCRPYFSKHSWGLFRHRTKLLCRKCGNHIGNAYDDKSSGYPRVLDGSDSSSGTEPSNHRKYDVRIRALQPSTAEGLSTPLFA

SEQ ID NO: 1896 - DNA, 807 bp, Cucumis melo subsp. melo
  misc_feature: Public GI ID no. 157714252
  misc_feature: Encodes the peptide sequence at SEQ ID NO. 1897
atcataatttttcttccaattctctctttcaccacacttcctctcgtacaagcttcaatttcctttttgtgttttgagatcatagcttctgtttttgattcttgagcttgtttatattaactctttgatcgatactcttaaaattggatcatcgtttctaccgactgcgattccccatttaccacctcgatatccccgtcaaccgttgcccccaccatcgaagacggccgttgtattctgaacccgaagaatgaggcagtcgccggtcttcggagacgattacgcccatggaactcacatccaatccttctcctcagcttcgcttttcccttcttcttcccgcagagatgtttattacagctgtggggcttgtggatacgaactgaacttgagctctattaaccgcaacacatcgaccattggctctaaatatggtaaatcgataaagcgagggatcatatcatttctaaacatcgacgaaagcagatttacacaggttgatgaacttcaatgtgtgcctcatttctcaaaaaactcttggggtctgtttcgccgaagaatcaaactactgtgtcgaaagtgtggaaactatattggaaacgctcacagcaaccatactgcctcctcaccacttgtttcagatggatcagattcatcatccttgcccaatgaagtctcaaggtgcatgaaatatgaagtaaaaattcgtgctttacagccttcatcttccaacgaatttgagccatcgattatttaaacaaggacaagaacaatggtggtttgttgaatgggttctttggagctaaa

SEQ ID NO: 1897 - protein, 168 aa, Cucumis melo subsp. melo
  misc_feature: Public GI ID no. 157714252
  misc_feature (1)..(168): Bit score of 316.9 for HMM based on sequences of FIGURE 24.
  misc_feature: Functional Homolog Of SEQ ID NO. 570
MRQSPVFGDDYAHGTHIQSFSSASLFPSSSRRDVYYSCGACGYELNLSSINRNTSTIGSKYGKSIKRGIISFLNIDESRFTQVDELQCVPHFSKNSWGLFRRRIKLLCRKCGNYIGNAHSNHTASSPLVSDGSDSSSLPNEVSRCMKYEVKIRALQPSSSNEFEPSII

SEQ ID NO: 1898 - DNA, 838 bp, Nicotiana tabacum
  misc_feature: Public GI ID no. 92026775
  misc_feature: Encodes the peptide sequence at SEQ ID NO. 1899
gttcctattttccatcaattttctccctcctcttctctccggccaaacttccggcggccgtcacaaactccggcttcaggtccatcttccggcggccgtcacgaaacacttagccgttgagtagttaaatctacacaaaacatcacctactgcgtttctccgccattgccaacctttttttttaattttgttttggtgcattaattaatggaaacatcaagtgggtatctgaattatcatcaacatccctcttttggttcttctaggagagatgtttcttacagctgtggcagttgtgggtatgagctaaaccttaactcgtctagtcgcaataccgcttccattggttccaagtacggaaaatccataaagaaagggatgatctccttcttgtccattgatgaaagcagatttacccaggttgaagaatttaagtgtgtgccattcttcttctccaagcgttcttggggcttgttccagcggcgaacaaaacttctgtgcagaaaatgtggtaatgatattggaattgcttatgatgatagtgcttcttcttacccacttgtagcagatgcatcagatacagcctctggcagtgaaacaagcactcatagaaaatatgatatcaaaatccgctccttgcaaccttcttcatcggcatcgggtactcctctccccgaatgatatataatgctcgtgaatatttcttctgtgaggaaagcttggcatgtatttgtgatcacacaatagcactgtgctgaaatttacgaaattcaaggtgctttaatgtcctgttatattatttgtcaagtaaataagatgaatcagtttacagttttgg

SEQ ID NO: 1899 - protein, 157 aa, Nicotiana tabacum (common tobacco)
  misc_feature: Public GI ID no. 92026775
  misc_feature (1)..(157): Bit score of 351.9 for HMM based on sequences of FIGURE 24.
  misc_feature: Functional Homolog Of SEQ ID NO. 570
METSSGYLNYHQHPSFGSSRRDVSYSCGSCGYELNLNSSSRNTASIGSKYGKSIKKGMISFLSIDESRFTQVEEFKCVPFFFSKRSWGLFQRRTKLLCRKCGNDIGIAYDDSASSYPLVADASDTASGSETSTHRKYDIKIRSLQPSSSASGTPLPE

SEQ ID NO: 1900 - DNA, 685 bp, Manihot esculenta
  misc_feature: Public GI ID no. 56925352
  misc_feature: Encodes the peptide sequence at SEQ ID NO. 1901
gccaccaccatcactttcttcgttgctttgattcttcttcgtcttctcctccgcctttgcactgtgtgaaacccttttatctattatctcgtctggagctacttgccgtgaactgcggttgcttcaccctcctctggcgggacgctcttgctggcaacctacttgcggcttttgaaattcttcctcgattagctgtcggcgagtattcgacattcgtgttgcctgtcactgtcaaaacagcgattgtagccgttgatcaaggtacttcaatggagaaatcggcggatgttcaggaaaattacctcaacgggaatcaatttgactctttttcttcctcctctgcttctcttagacacgtaaactacagctgtggcacttgtggatatgagttgaacttaagctcctccaatcgaaacacctcaactataggctctaaatatggaaaatccataaaacgagggataatatcattctttgacattgatgagagcagatttactcaggctgaagaattccaatgcgttccccatttttcaaaaaactcgtggggtttgtttcgccggagaaccaaacttctttgtcgtaaatgtggtaataatattggaattgcttatgaagatgaaacctcagcttatccactcgtatcagatggttcagattcatcctcagttaatgaatcaaaaag

SEQ ID NO: 1901 - protein, 138 aa, Manihot esculenta (cassava)
  misc_feature: Public GI ID no. 56925352
  misc_feature (1)..(138): Bit score of 311.4 for HMM based on sequences of FIGURE 24.
  misc_feature: Functional Homolog Of SEQ ID NO. 570
MEKSADVQENYLNGNQFDSFSSSSASLRHVNYSCGTCGYELNLSSSNRNTSTIGSKYGKSIKRGIISFFDIDESRFTQAEEFQCVPHFSKNSWGLFRRRTKLLCRKCGNNIGIAYEDETSAYPLVSDGSDSSSVNESK

SEQ ID NO: 1902 - DNA, 641 bp, Solanum lycopersicum
  misc_feature: Public GI ID no. 117710482
  misc_feature: Encodes the peptide sequence at SEQ ID NO. 1903
cactagctccggcgtgacgtccgactttaatttgattaactctaaaacacttagccgttgagtagtgagacagcaccaacaccacctttcttagtttctccgccattgctaatcgcttgtattttttcggtgcattaatggaaacatcaagtgggtatctgaattatcatcaaaatccctcttttggttcttctagaagagacgtctcttacagctgtggcagttgtgggtatgagttaaatcttaattcatcaagtcgcaatactgcttccattgggtccaagtatgggaagtccattaagaaagggatgatctccttcttgtccattgatgagagcagatttacccaggttgatgaattcaagtgtgtaccgttctttttctccaaacgttcttggggcttgttccagcggcgaacaaaacttcagtgcagaaaatgtggtaacgatattggaattgcttatgatgatagtgcttcttcttacccacttgtagccgatgcatcagatacagcctccggtagtgaaataaccactcataggaaatacaatatcaaaatccgctcgttgcaaccgtcttcctcagcatcgggtactcctctccctgagtgatatataatgcctgtgaataattcttctgtt

SEQ ID NO: 1903 - protein, 157 aa, Solanum lycopersicum (Lycopersicon esculentum)
  misc_feature: Public GI ID no. 117710482
  misc_feature (1)..(157): Bit score of 343.8 for HMM based on sequences of FIGURE 24.
  misc_feature: Functional Homolog Of SEQ ID NO. 570
METSSGYLNYHQNPSFGSSRRDVSYSCGSCGYELNLNSSSRNTASIGSKYGKSIKKGMISFLSIDESRFTQVDEFKCVPFFFSKRSWGLFQRRTKLQCRKCGNDIGIAYDDSASSYPLVADASDTASGSEITTHRKYNIKIRSLQPSSSASGTPLPE

SEQ ID NO: 1904 - DNA, 811 bp, Carthamus tinctorius
  misc_feature: Public GI ID no. 125392822
  misc_feature: Encodes the peptide sequence at SEQ ID NO. 1905
aaacttggtctgatctcccccattttctctagtaagaagtaaccctttctttcttcagcagttgcttaattgctttcctttcccttctaaaacggtaacatctatctatctatctatctggaccagtagtactcacttgatccaccgcctatttctatatctatttccgatccttttcacaatcaccaccattcttgttatggaaatctctaacaaatctcattacaacacctcttttgctgctacttctcagcgagacgtcacttacagatgtgggtcttgtggatacgacttgaacttgagttcttcggcacgcaatacgtcaaccattggttccaaatacggtaaatccataaagaccggaatgatatcattcttctgcatcgatgagagtagattcacgcttgtagatgagttccaatgtgtgccctacttcatctcgaaacatttttggggtttgtttagcaggaaaactaaacttctttgtcgtaagtgtaataaccacatcggaaatgcttatgaagacaataatacctcatcataccctcttgtagcagattcatcatcggccaatcagatctcctcgtacagaaaatatgatgttagaatccgagccgtccaaccttcttcatccgtcgaacctggccttgcgcttggcgtttgataccatcatctcttcctcttcctcttgtgttatgatacatacatgctttagttgtgagtaattttttgggctaatagtacagtttcatatttcatgtagtatatattatttatgtacacctctagcttgatttggttatttggttac

SEQ ID NO: 1905 - protein, 154 aa, Carthamus tinctorius (safflower)
  misc_feature: Public GI ID no. 125392822
  misc_feature (1)..(154): Bit score of 313.7 for HMM based on sequences of FIGURE 24.
  misc_feature: Functional Homolog Of SEQ ID NO. 570
MEISNKSHYNTSFAATSQRDVTYRCGSCGYDLNLSSSARNTSTIGSKYGKSIKTGMISFFCIDESRFTLVDEFQCVPYFISKHFWGLFSRKTKLLCRKCNNHIGNAYEDNNTSSYPLVADSSSANQISSYRKYDVRIRAVQPSSSVEPGLALGV

SEQ ID NO: 1906 - DNA, 677 bp, Citrus sinensis
  misc_feature: Public GI ID no. 68274219
  misc_feature: Encodes the peptide sequence at SEQ ID NO. 1907
tttttttttttttgcccttttcacccgctacttaacggttgcctcctcagttcgggttagcttcgagacagttgattcaattgttttgctcagttgttaagctttgctcgagtcacagacacgatcagagccgttgatttgtctgtggaaatcaaaataagaaaaaaaaaatggaggaatctgtgtatgttaatggaaatcaccatcactccttttcttcatcgatttctcaaagacatgttagctacagctgtggttcttgtgggtatgagctaaaccttagctcttgtaatagaaacatctcatctattggattaaaatacggaaaatctatgaagcgagggataatagcgttcgtagacatagatgagagcagatttactcaagttgatgagttgcaatgcataccccacttctccaaaaactcgtggggcattttgcgccatagaaccaaacttctctgccgtaagtgtggtaaccctattggaattgcttataccgacaaaacctcagcatactcacccaaatcaaatggatcagattcaccttcagtccctggtgcttctggtcgtagaaaatatgatgttagaatacgtgccttacagccttcatccagtgaggaatctggcattccactcttctcatgataatacggcttgagcttcttcttcatcatt

SEQ ID NO: 1907 - protein, 158 aa, Citrus sinensis
  misc_feature: Public GI ID no. 68274219
  misc_feature (1)..(158): Bit score of 348.0 for HMM based on sequences of FIGURE 24.
  misc_feature: Functional Homolog Of SEQ ID NO. 570
MEESVYVNGNHHHSFSSSISQRHVSYSCGSCGYELNLSSCNRNISSIGLKYGKSMKRGIIAFVDIDESRFTQVDELQCIPHFSKNSWGILRHRTKLLCRKCGNPIGIAYTDKTSAYSPKSNGSDSPSVPGASGRRKYDVRIRALQPSSSEESGIPLFS

SEQ ID NO: 1908 - DNA, 558 bp, Solanum lycopersicum
  misc_feature: Ceres Annot ID no. 8457060
  misc_feature: Encodes the peptide sequence at SEQ ID NO. 1909
atgagaatttacgagaaggatatcaatgatcttgaggcaactgagctaagattaggtttgcctgggataataaacgatgaatcttcaacatcaactagtacttctaaaaatagcagaaaaagaccttcatctagtagtgtaaatgaaaatgaacaacaagactcagctcctgcaccaaaagcacaagttgttggttggccaccagttcgatcatacaggaaaaatcatgtgtctaaattatcagaatctgataataattcctcaggaatgtatttaaaagttagcatggatggagcaccttatttgaggaaaattgatcttcaggtttacaaaagttatcaagagctactcaaggctttacaaagcatgttcaagtgcactattggagtgtattcagaaagagaaggatataatggatctgattatgcaccaacatatgaagacaaggatggtgattggatgcttgttggtgatgtaccatgggagatgtttataagttcttgcaaaaggcttagaattatcaaaggatctgaagctaaaggtctagcatgtctataa

SEQ ID NO: 1909 - protein, 185 aa, Solanum lycopersicum
  misc_feature: Ceres Annot ID no. 8457060
  misc_feature (1)..(185): Bit score of 379.1 for HMM based on sequences of FIGURE 3.
  misc_feature (10)..(185): Pfam Name: AUX_IAA Pfam Description: AUX/IAA family
  misc_feature: Functional Homolog Of SEQ ID NO. 129
MRIYEKDINDLEATELRLGLPGIINDESSTSTSTSKNSRKRPSSSSVNENEQQDSAPAPKAQVVGWPPVRSYRKNHVSKLSESDNNSSGMYLKVSMDGAPYLRKIDLQVYKSYQELLKALQSMFKCTIGVYSEREGYNGSDYAPTYEDKDGDWMLVGDVPWEMFISSCKRLRIIKGSEAKGLACL

SEQ ID NO: 1910 - DNA, 678 bp, Solanum lycopersicum
  misc_feature: Ceres Annot ID no. 8460629
  misc_feature: Encodes the peptide sequence at SEQ ID NO. 1911
atggcaacaatctacgagaataatgatcttgcaactgagctgagattagggttacccggtacaacagataaatcgaagacacgtgtatcttcgactagtactactaataaaagatctttatcagagatggacagctcctcagatattataaatcaaaatgatcaacaagactcctcccctccaccaaaagtacaaattgttggttggccaccagtaagatcttgcaggaagaatgttggtgtacaagccaagaattcaattgatatttccataggaatgtatgtgaaagttagcatggatggagcaccttacttgaggaaaattgaccttagggtttacaaaaattatcaagaattactcaaagctttggagtacatgttcaagcatcccattggtgtatttttggaaaaagaaggctacactactagtggatctgattatgtattaacatatgaagacaaagatggtgattggatgcttgttggagatgtaccattggatatgtttattagttcttgtaaaaggcttagaatcatgaaagagtctgatgctaaagcagattttatttctggaaaactggctgagacgacggatcccacgatggaccgtcatggcacgacggaccgtcgagggggtctcgtctcaaaacacttagaaattctgaaaaatgggtactga

SEQ ID NO: 1911 - protein, 225 aa, Solanum lycopersicum
  misc_feature: Ceres Annot ID no. 8460629
  misc_feature (1)..(225): Bit score of 304.2 for HMM based on sequences of FIGURE 3.
  misc_feature (11)..(187): Pfam Name: AUX_IAA Pfam Description: AUX/IAA family
  misc_feature: Functional Homolog Of SEQ ID NO. 129
MATIYENNDLATELRLGLPGTTDKSKTRVSSTSTTNKRSLSEMDSSSDIINQNDQQDSSPPPKVQIVGWPPVRSCRKNVGVQAKNSIDISIGMYVKVSMDGAPYLRKIDLRVYKNYQELLKALEYMFKHPIGVFLEKEGYTTSGSDYVLTYEDKDGDWMLVGDVPLDMFISSCKRLRIMKESDAKADFISGKLAETTDPTMDRHGTTDRRGGLVSKHLEILKNGY

SEQ ID NO: 1912 - DNA, 906 bp, Solanum lycopersicum
  misc_feature: Ceres Annot ID no. 8464841
  misc_feature: Encodes the peptide sequence at SEQ ID NO. 1913
atggagcaagattacaatatgggtatgtgttctgaggatgaaacagagcttgagttggggttaggtcttagccttaacagtgggggtgggggtggtggggtggggggaaagactaagaaatcaccatggggtgagtatggtaggattttaactgctaaagattttcctaatggattttcagctaagagatccattaatgttggtgtttctggtactaaaagagctgctgattttgctggttctacaactgaggttggatctcctcctactggtgcaagtcaggttgtgggatggccacccataagggcatacagaatgaacagcttggttaatcaatcaaaggttctaaatgctgatgatgagaagggagttggcgggaacgataagaaggagcactcgaagaagaagatcaatcatgggaacactaaggatgatgcagcatcggttaaagaaaaggggcatcttggttttgtgaaggtgaatatggatggtttgcctattggaagaaaggtggatttgaatgctcatacttgctatgaatcgttagccgaaaccttggaggatatgttctttaaatctaccaaaagcggtgaaaaggaacaagcaactaagtcttttaagctcttggatggatcatctgaatttgtgctcacatatgaggataaagaaggagactggatgcttgttggagatgttccattcgggatgtttctcaacactgtgaaaaggctaagaatcatgaggacttctgaggctaatggacttggtatgtacatagccatgccaaaagaacacactcaacctctccttttgttatattactcgaaaactcttcaaaagtactccgaggtgcaggctccaagaatccctcagaagcaagagaaacacaaaggaaaacctatctaa

SEQ ID NO: 1913 - protein, 301 aa, Solanum lycopersicum
  misc_feature: Ceres Annot ID no. 8464841
  misc_feature (1)..(301): Bit score of 173.9 for HMM based on sequences of FIGURE 3.
  misc_feature (13)..(259): Pfam Name: AUX_IAA Pfam Description: AUX/IAA family
  misc_feature: Functional Homolog Of SEQ ID NO. 129
MEQDYNMGMCSEDETELELGLGLSLNSGGGGGGVGGKTKKSPWGEYGRILTAKDFPNGFSAKRSINVGVSGTKRAADFAGSTTEVGSPPTGASQVVGWPPIRAYRMNSLVNQSKVLNADDEKGVGGNDKKEHSKKKINHGNTKDDAASVKEKGHLGFVKVNMDGLPIGRKVDLNAHTCYESLAETLEDMFFKSTKSGEKEQATKSFKLLDGSSEFVLTYEDKEGDWMLVGDVPFGMFLNTVKRLRIMRTSEANGLGMYIAMPKEHTQPLLLLYYSKTLQKYSEVQAPRIPQKQEKHKGKPI

SEQ ID NO: 1914 - DNA, 834 bp, Sorghum bicolor
  misc_feature: Ceres Annot ID no. 8682232
  misc_feature: Encodes the peptide sequence at SEQ ID NO. 1915
atgagaggaggaggagcggggcccacggcggcgttcatctccggcgacccgcctccagccgccgcggaggaggtggaggagaactccggtggcgagggggacgaggaggtggtggtggtggggcaggacgacgacgacctggagctggggctctgtctcggttccaagaagcagcagccgtcgccggcgccgtgccggatcctcacggcccgggaccttcagccggggtccctgtcgccggattcctccgtgtcctcttcctctcccgcggcaggtgcaggtgccgcagcgcccagcaagagggccaaggcggatgctgcccccaacgccaccacctcgccggggacggccgttcctggccatccacagagctatggagtagtgggatggccacccataagaactttcaggatgaacagcctatttaaccaggccaaagaaaatgcctctgaggctggcaccaagaagcccaccgttgaatctgacatgcaggaagacaaggaggagagcaagaaaggacgggtcgtcggttgggtgaaggtgaacatggaaggagatatcattggaaggaaggtggatctcaacgcccatcgatcttacaagacccttgcctcagcacttgagctcatgttcatgaagccgtccatcagtctttgcacttctagtagttctaagtctctaaagctattggacaactcatcggagtatcagctcacctatgaggacagggatggggactggatgctagttggagatgtaccctgggagatgtttgtaggttcagtgaagaggctcaagatcatgaggacctcagatgccaacggtctcggttag

SEQ ID NO: 1915 - protein, 277 aa, Sorghum bicolor
  misc_feature: Ceres Annot ID no. 8682232
  misc_feature (1)..(277): Bit score of 126.0 for HMM based on sequences of FIGURE 3.
  misc_feature (40)..(277): Pfam Name: AUX_IAA Pfam Description: AUX/IAA family
  misc_feature: Functional Homolog Of SEQ ID NO. 129
MRGGGAGPTAAFISGDPPPAAAEEVEENSGGEGDEEVVVVGQDDDDLELGLCLGSKKQQPSPAPCRILTARDLQPGSLSPDSSVSSSSPAAGAGAAAPSKRAKADAAPNATTSPGTAVPGHPQSYGVVGWPPIRTFRMNSLFNQAKENASEAGTKKPTVESDMQEDKEESKKGRVVGWVKVNMEGDIIGRKVDLNAHRSYKTLASALELMFMKPSISLCTSSSSKSLKLLDNSSEYQLTYEDRDGDWMLVGDVPWEMFVGSVKRLKIMRTSDANGLG

SEQ ID NO: 1916 - DNA, 954 bp, Sorghum bicolor
  misc_feature: Ceres Annot ID no. 8723559
  misc_feature: Encodes the peptide sequence at SEQ ID NO. 1917
atggcgacgacggacctggggttcgaggagacggagctccgtctgggcctgcccggcggcgggggagaggtggtcggcgaagggaggagctctgtcgtctcctccgggaagaggggcttcgcagagaccatcgacctcaagctgaagctggagccggcgactcccgcggccgtattgaaggcggcggaggcggacgagcatcaggacggtgttgccgccgccaaggaagacgccggctgcgtggccgccgcggaggaggccgccgtcggcgggaagatgaagaggtccccgagccagagcagcgtcgtcaccgccgccgccgtgcaggctgaccccgccgagaagccgcgcgcccccaaggctcaggtggtgggatggccaccggtccggtcgttccggaagaacatcatgtccgtgcagtccgacaagggcgccggcggcagcaaagacgccgacaagtcctcgccggcggcggcagctggcggtggtgcggcgttcgtgaaggtgagcttggacggcgcgccgtacctgcgcaaggtggacctcaagatgtacaagagctaccaggagctgtccaaggcgctcgagaagatgttcagctccttcaccattggaagctgtgggtctcaagggatgaacggcatgaacgagagcaagctggtggatctgctcaacggctccgagtacgtgccgacctacgaggacaaggacggcgactggatgctcgtcggcgacgtgccgtgggaaagagaagccatgaacatgtacctgtcctataacaatgtctttttgcactacctgttctctcctcctcttctttttttttggtggctcaaaatgcaaaggcaccctgctcctaatcaaggggcccttttgcatcttgtccatcaaaagttgtttaattataattaccacggtgtgtcagtggaacaaataactgtttcaagctgttaa

SEQ ID NO: 1917 - protein, 317 aa, Sorghum bicolor
  misc_feature: Ceres Annot ID no. 8723559
  misc_feature (1)..(317): Bit score of 202.2 for HMM based on sequences of FIGURE 3.
  misc_feature (6)..(258): Pfam Name: AUX_IAA Pfam Description: AUX/IAA family
  misc_feature: Functional Homolog Of SEQ ID NO. 129
MATTDLGFEETELRLGLPGGGGEVVGEGRSSVVSSGKRGFAETIDLKLKLEPATPAAVLKAAEADEHQDGVAAAKEDAGCVAAAEEAAVGGKMKRSPSQSSVVTAAAVQADPAEKPRAPKAQVVGWPPVRSFRKNIMSVQSDKGAGGSKDADKSSPAAAAGGGAAFVKVSLDGAPYLRKVDLKMYKSYQELSKALEKMFSSFTIGSCGSQGMNGMNESKLVDLLNGSEYVPTYEDKDGDWMLVGDVPWEREAMNMYLSYNNVFLHYLFSPPLLFFWWLKMQRHPAPNQGALLHLVHQKLFNYNYHGVSVEQITVSSC

SEQ ID NO: 1918 - DNA, 1512 bp, Sorghum bicolor
  misc_feature: Ceres Annot ID no. 8734000
  misc_feature: Encodes the peptide sequence at SEQ ID NO. 1919
atgccgccgccgctcgaggcgcgcgacttcctcggcgccggcgccacctcgtcgtgctgctcgtcgtcctgctcctccggcggcgatgggacggtgccgcacctcgcgctgcggctcgggctcccggggtccgactcccccggccgaggcgcgcaggcggagcacgcccacgtggacgccgcgctcaccctcggacccacccctgcccccgcgccgcccaggggaggcgccccgcgcgggttcgccgactccctcgaccggtccgcgaagcgggacggtgctgcggcggatgacgacgctgctgggggcgtaactggggaggataagggggtagctgcggccgctgccggagctccgccggctgccaaggcacaagttgttggatggccacctgttaggagctaccgaaagaatacactagctgcaagtgccacaaagacaaaggtggaagatgaaggtaggagtgaggcgggatgctgttatgttaaggtcagcatggatggagccccatacctaaggaaggtagacctcaagacctattcaagctatgagaatctctcgcttggtctggagaaaatgttcagctgcttcatcactggtcaaaacagttcttgcaagacatcaagaagggataggtttactgatggttctagggctgatgcccttcaggaccaagaatatgtccttacttacgaagataaagatgctgactggatgcttgttggtgatctgccctgggacttgttcaccacaatttgtcggaaactaagaatcatgagaggctctgatgctgctggcatgggacggacgggaccgaccctgtccctggggggctgggggcaccgcgcgcggcagcccacagcctggtggtggtggcgaccggatcaccaggcgtccaggcccaaggggaccaaaacggcacggcagcaacagcacagaccgaggaccactgcgacctcgacgacacatggctcgggagcctcgggctccggtcgtggcctcgacctgacccagcgtccgcgccgagccgcctctttcaagccgcggaaacgaagaaacgaacgagaaccggtcgaggcgcgacgcgaacgccgacggcgacgccaccgtgctttcaccgtctcaggcgcctgcgcctgctggctcgatcgcggtcgcggacgccgcggcaacagggcgcgaccggagcacatgtgcatgtggccgcgcgcgggacgtgtcgatgcgcgcgcgcgcgcgtgcgtacgttctggttctgctgcggtgcacgagagcggggccaggacctccagcgccatcgggttcggtgggcgaccgcgacgggaacacggccagttgcgcgccatgactcgcagagccgcggccacggacagccccagtgggcgggcacccgccggtcacatggccgcggggccccgcctgcttgtgcctacggccgccgtccccgtccgcgcccggtgcgtgccgttgccatgccgggagtatcggcgggcgaagcgaaaccggggctga

SEQ ID NO: 1919 - protein, 503 aa, Sorghum bicolor
  misc_feature: Ceres Annot ID no. 8734000
  misc_feature (1)..(503): Bit score of 256.4 for HMM based on sequences of FIGURE 3.
  misc_feature (37)..(270): Pfam Name: AUX_IAA Pfam Description: AUX/IAA family
  misc_feature: Functional Homolog Of SEQ ID NO. 129
MPPPLEARDFLGAGATSSCCSSSCSSGGDGTVPHLALRLGLPGSDSPGRGAQAEHAHVDAALTLGPTPAPAPPRGGAPRGFADSLDRSAKRDGAAADDDAAGGVTGEDKGVAAAAAGAPPAAKAQVVGWPPVRSYRKNTLAASATKTKVEDEGRSEAGCCYVKVSMDGAPYLRKVDLKTYSSYENLSLGLEKMFSCFITGQNSSCKTSRRDRFTDGSRADALQDQEYVLTYEDKDADWMLVGDLPWDLFTTICRKLRIMRGSDAAGMGRTGPTLSLGGWGHRARQPTAWWWWRPDHQASRPKGTKTARQQQHRPRTTATSTTHGSGASGSGRGLDLTQRPRRAASFKPRKRRNEREPVEARRERRRRRHRAFTVSGACACWLDRGRGRRGNRARPEHMCMWPRAGRVDARARACVRSGSAAVHESGARTSSAIGFGGRPRREHGQLRAMTRRAAATDSPSGRAPAGHMAAGPRLLVPTAAVPVRARCVPLPCREYRRAKRNRG

SEQ ID NO: 1920 - DNA, 651 bp, Sorghum bicolor
  misc_feature: Ceres Annot ID no. 8743255
  misc_feature: Encodes the peptide sequence at SEQ ID NO. 1921
atgccgacgagctcgaccaactccgccgcggcggcttcccctgccgtgtcaggcctcgactacgacgacaccgcgctcaccctcgccctcccgggctcctcctcctccgccgccgacccctccgccgccgccgaccgcaagcgcgcccacgccgaccacgacaagccgccctccccaaaggcgcgggccgtggggtggccgccggtgcgcgcgtaccggcgcaacgcgctgcgcgacgagcaggccgccaagctcgtgaaggtggccgtggacggcgcgccgtacctgcgcaaggtggacctcgcggcgcacgacgggtacgcggcgctgctccgcgcgctccacggcatgttcgcctcctgcctcggagccgacggggccgggagcctcgtcgacgccgccaccggcgccgagtacgtgcccacctacgaggacaaggacggcgactggatgctcgtcggagacgtccccttcaagatgtttgtggactcgtgcaagaggatccgcctcatgaagagctccgaggccggcagcctatgccacacaccccatggaaaaacttcatcagtttcaagtgccgctactgtcggccggacggtttcgtttttggacgccggcgagaaggcggcgctagcacttcgtcagctatag

SEQ ID NO: 1921 - protein, 216 aa, Sorghum bicolor
  misc_feature: Ceres Annot ID no. 8743255
  misc_feature (1)..(216): Bit score of 233.4 for HMM based on sequences of FIGURE 3.
  misc_feature (19)..(183): Pfam Name: AUX_IAA Pfam Description: AUX/IAA family
  misc_feature: Functional Homolog Of SEQ ID NO. 129
MPTSSTNSAAAASPAVSGLDYDDTALTLALPGSSSSAADPSAAADRKRAHADHDKPPSPKARAVGWPPVRAYRRNALRDEQAAKLVKVAVDGAPYLRKVDLAAHDGYAALLRALHGMFASCLGADGAGSLVDAATGAEYVPTYEDKDGDWMLVGDVPFKMFVDSCKRIRLMKSSEAGSLCHTPHGKTSSVSSAATVGRTVSFLDAGEKAALALRQL

SEQ ID NO: 1922 - DNA, 1428 bp, Arabidopsis thaliana
  misc_feature: Ceres Annot ID no. 887669
  misc_feature: Encodes the peptide sequence at SEQ ID NO. 1923
gtaatgataattaagcttttttctgctttaatggaaggaccttgacacttctctctctctttctctttgctattcatcttctacagtttcttaaaaattatactcttcttctccaaaatatctcagactctcttatttttgatcgtcttcttcttcttcgttgtgagcttccatttttcatccaggatttgttttttccgtttgaggtaaagcagctttgcagttaaagaaaccttgagtatccaatgtccccggaagaggagctacagagcaatgtatcggtggctagttcttcacctactagcaattgcatctccaggaacactctaggaggacttaaagagcataactacttgggtctctctgattgttcttctgttggaagctctactctctctccccttgctgaagatgacaaagctactatcagcctcaaggctacggagctgacacttggtcttcctggatcacaatctcctgcgagagacacagagcttaaccttttgagcccagcaaagctagatgagaagccattctttcctttgcttccttctaaagatgagatatgctcctcctcgcaaaagaacaatgcatcgggaaacaaaagaggcttttctgacacaatggatcagtttgctgaagctaaaagttcagtgtatactgagaaaaactggatgttccctgaagcagcagccacccagtctgtaacaaagaaagatgtgccacaaaacatacccaaaggacagtctagcactacaaacaatagctctagtccacctgcagccaaggcacaaattgtcggttggcctccagtgagatcctacaggaagaacacattggccactacttgtaagaacagtgacgaagttgatgggaggccaggttctggggctctcttcgtgaaggtcagtatggatggtgctccttatctgaggaaagttgacctgaggagctacactaactacggggagctttcttcagccttggagaaaatgttcaccactttcactcttggtcaatgtggatctaatggagctgctgggaaggatatgcttagtgagaccaagctcaaggatcttttgaatggaaaagactatgtgctcacttatgaggataaggatggtgactggatgcttgttggagatgttccgtgggagatgtttattgatgtctgcaagaagctgaagataatgaaagggtgtgatgctattggctgcagctccgagagcaatggagaaatcgaagatgagagcttaaaagatggaacatgacaaagctttctaactatacaaaatatgtgcgatcttttggtggtgtttttaaatttcaaaacatcaatatctttagtttctgaatttttaaaatgaagtaagtaagactacgaatgtaaggaaatgaagaagaattaaaaatgatctatttttgttg

SEQ ID NO: 1923 - protein, 341 aa, Arabidopsis thaliana
  misc_feature: Ceres Annot ID no. 887669
  misc_feature (1)..(341): Bit score of 248.4 for HMM based on sequences of FIGURE 3.
  misc_feature (61)..(328): Pfam Name: AUX_IAA Pfam Description: AUX/IAA family
  misc_feature: Functional Homolog Of SEQ ID NO. 129
MSPEEELQSNVSVASSSPTSNCISRNTLGGLKEHNYLGLSDCSSVGSSTLSPLAEDDKATISLKATELTLGLPGSQSPARDTELNLLSPAKLDEKPFFPLLPSKDEICSSSQKNNASGNKRGFSDTMDQFAEAKSSVYTEKNWMFPEAAATQSVTKKDVPQNIPKGQSSTTNNSSSPPAAKAQIVGWPPVRSYRKNTLATTCKNSDEVDGRPGSGALFVKVSMDGAPYLRKVDLRSYTNYGELSSALEKMFTTFTLGQCGSNGAAGKDMLSETKLKDLLNGKDYVLTYEDKDGDWMLVGDVPWEMFIDVCKKLKIMKGCDAIGCSSESNGEIEDESLKDGT

SEQ ID NO: 1924 - DNA, 1039 bp, Zea mays
  misc_feature: Ceres Clone ID no. 100818180
  misc_feature: Encodes the peptide sequence at SEQ ID NO. 1925
tccctctctcgagtcaagagcagagcagctaccaaacaagctctcctttcgcttccgatccatggagctcgacgccgacaacctgagcgccaccgagctccgcctcggcctgcctgggaccagcagcagcagcagcgacgactggcagaagaagccgtcgccctccgtcggggccaagcgcgctctggacgacggcaccaagagcgaggcctcggggaccagcccggccgccagagacctcgacttcgaccacgaccacgacaccgccgcgcctcccaaggcgcaagtggtcgggtggccgccggtgagggcgtacaggaagaacaccttccaggcggcggcggcggccaagaaggtcgagcagaagcagaagcagcagcagcagggaggcctgtacgtgaaggtgagcatggacggcgcgccgtacctcaggaaggtggacctccggatgtacaaggggtacagggagctcagggaggctctggacgcgctcttcaccaactccttctccgcggcggcagagggcggcggcgaccaccaccagcacgccatcgcctacgaagacaaggacggcgacctcatgctcgccggagaccgtgccctgggagtaagtacaccgtcgggttcggatcagcaagcatgctgctccgttctgtggatctgaggatacgtttggtgaacagaagcctgattaattgtgattcttaatttcaccccctttgcagtatgttcatctcttcgtgcaagaagctcaggataatgaagggctctgcctctgaggccaggtgatcgctgatccatacataaacagaggctacagacacgccacctgggaacgcggatccaagagcacacacggatcgtacttgacgaggaaggagggaggagcagtgtggcttgagctctccagtgttgtacaaagacatgtttctttctgaacccaaaagggagaaagatgtatgaagcgtgtatataagatcttagctagcagtttgttttcatttgtatgagcgatcgaaggctgtaaaaaatgaaaaag

SEQ ID NO: 1925 - protein, 200 aa, Zea mays
  misc_feature: Ceres Clone ID no. 100818180
  misc_feature (1)..(200): Bit score of 193.2 for HMM based on sequences of FIGURE 3.
  misc_feature (7)..(186): Pfam Name: AUX_IAA Pfam Description: AUX/IAA family
  misc_feature: Functional Homolog Of SEQ ID NO. 129
MELDADNLSATELRLGLPGTSSSSSDDWQKKPSPSVGAKRALDDGTKSEASGTSPAARDLDFDHDHDTAAPPKAQVVGWPPVRAYRKNTFQAAAAAKKVEQKQKQQQQGGLYVKVSMDGAPYLRKVDLRMYKGYRELREALDALFTNSFSAAAEGGGDHHQHAIAYEDKDGDLMLAGDRALGVSTPSGSDQQACCSVLWI

SEQ ID NO: 1926 - DNA, 1140 bp, Zea mays
  misc_feature: Ceres Clone ID no. 100860302
  misc_feature: Encodes the peptide sequence at SEQ ID NO. 1927
catctcttctagcacgcaaagatcgagctatagctagctctgcaaccagagacaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgaggaggcaagcaagcgtgacgccgagacggcgcccccggcagccaaggcgcccgtggtgggttggccgccggtgaggtcgtaccggaagagctgcttccagcaggccagcagcaagcaggcggcagcggccaaacaggaggcggcggcggcggcgcccggctgcacggcatcgtcagcagccgccacaaacaccagcagctgcagcagcgccgccgttgtcgtcggytccttcgtcaaagtgagcatggacggcgccccgtacctgaggaaggtggacctgaggatgtacaggggctacagggagctccgggaggccctggaggccatgttcgtttcctccagcagcgccaacaacctgtcggagttcgccgtcacctacgaggacaaggacggcgacctcatgctcgtcggagacgtgccgttcgagatgttcgctagcacctgcaagaagctgaggatcatgaagagatctgaagccacaggcctggggtcgttgtcagcgaggcagcaatgaagatgatcccatctgatcgagaggacctgcatgcccggcaacgttgaacaacatgtcgatcgaacgtcatggtggccttattaattgtttctttcttttcttttcttccttttgtttaattatttttgctgttctggttggcgccgccgtggatcggagggatccccaagccgaaggatgagcttggctggggcatcgaagcgcatgcaacggatgtgtgcggctttggttttgtaataggacaaccagtggtccttttttcgatttattagcggcacaaaaggagctagatgcatgctgaggttgtttcagttcactctccatgtgtgtttgtacaaacgaaacaata

SEQ ID NO: 1927 - protein, 226 aa, Zea mays
  misc_feature: Ceres Clone ID no. 100860302
  misc_feature (1)..(226): Bit score of 269.0 for HMM based on sequences of FIGURE 3.
  misc_feature (7)..(222): Pfam Name: AUX_IAA Pfam Description: AUX/IAA family
  misc_feature: Functional Homolog Of SEQ ID NO. 129
  misc_feature (131)..(131): Xaa is any aa, unknown, or other
METVVGDLMATELRLGLPGTVDDCSQPQLVKATPPSTPRGKRRATADAVEEAAGAEEASKRDAETAPPAAKAPVVGWPPVRSYRKSCFQQASSKQAAAAKQEAAAAAPGCTASSAAATNTSSCSSAAVVVXSFVKVSMDGAPYLRKVDLRMYRGYRELREALEAMFVSSSSANNLSEFAVTYEDKDGDLMLVGDVPFEMFASTCKKLRIMKRSEATGLGSLSARQQ

SEQ ID NO: 1928 - DNA, 1254 bp, Zea mays
  misc_feature: Ceres Clone ID no. 100908051
  misc_feature: Encodes the peptide sequence at SEQ ID NO. 1929
tcgtcggcctctcgacgccggttgctgcaaccaccgcctttattgcccacgcgggccgtgcggaagaagcaagaagacacgccaatggaggtcgccgcagcatcggcagcgagctacggattcaaggccgacgacgacgttgacagcctcagggcgacggagctcaggcttggcctgccgggcacggaggagaaggaggaggccgaggagccccagcacaaggcggcaccgccgccgccgtccacgcccagaggcaagaagcgcgacgtcgtcgccagcagcgggcccgaggacgcgcccaagaagcgcgactgcgagaccgacgccgacgccgacgccgcgccgccgccggccgccaaggctcagctggtgggatggccgccggtgaggtcgtacaggaagagctgcttccagcagcaggcggcggccaagaacaagccggcggcagccctggcggaggaggccccggccgccggcgggttgttcgtgaaggtgagcatggacggcgccccctacctcaggaaggtggacctcaagatgtacaagggctaccgcgagctgcgggaggcgctggaggccatgttcctctgcttctccggcgccgccgacgcgcccgccgtcaacccctccgacttcgccgtcacctacgaggacaaggacggcgacctcatgctcgtcggcgacgtgcccttcggcatgttcatcagcacctgcaagaggctgaggatcatgaaagggtctgaagcgagagggctcggctcggccaagaacaactgatgatgaggcgtctatcgcatgcttgtgctgtgcgtgcgtgcatgcgccagcaaattcttttgttcttttggggtcttatttcttctccaaggcgtccctgcatgggtgtgggcgtgtggtgttgagtattatgtaccttctcccctagcattgtctgtgccaacaatggagcagcagctagcagcaaaccagagacatggcgaggcgaaagatgaagctgcttgcttggaaggagagagagagagagagagagagagagagagagagagagagagagagagggaagctttgtgcatgcgtggaatgatgtgtggtcgctttgttctttttcttttgtgccccttgtaggggtgtgtgtgtgtgtgtttagcaagacatgcaaaaggagtggagagtcgagttgaatctccatgatgcgtggttgtacaaagccaaagatcactcttctttcttgtctatcagtctattgtctatcta

SEQ ID NO: 1929 - protein, 230 aa, Zea mays
  misc_feature: Ceres Clone ID no. 100908051
  misc_feature (1)..(230): Bit score of 296.4 for HMM based on sequences of FIGURE 3.
  misc_feature (21)..(228): Pfam Name: AUX_IAA Pfam Description: AUX/IAA family
  misc_feature: Functional Homolog Of SEQ ID NO. 129
MEVAAASAASYGFKADDDVDSLRATELRLGLPGTEEKEEAEEPQHKAAPPPPSTPRGKKRDVVASSGPEDAPKKRDCETDADADAAPPPAAKAQLVGWPPVRSYRKSCFQQQAAAKNKPAAALAEEAPAAGGLFVKVSMDGAPYLRKVDLKMYKGYRELREALEAMFLCFSGAADAPAVNPSDFAVTYEDKDGDLMLVGDVPFGMFISTCKRLRIMKGSEARGLGSAKNN

SEQ ID NO: 1930 - DNA, 1187 bp, Zea mays
  misc_feature: Ceres Clone ID no. 100914105
  misc_feature: Encodes the peptide sequence at SEQ ID NO. 1931
ccttcctcgcatacgcgcgcagcagaggagctgagaccaacgaagaagaagaacaaccgagcaagcacaagcttagctagcgtggaggtgcccaaggcgacgacggccgccgcgccaggctagccaaccagctgctcatcgctcctagctgcggagccgatggctggagccgacgtcgacgtcgggacggagctccgcctcggcctgccaggaggaggcgccgatgcggccaaggctgccaagaggggcttcgaggacaccatcgacctcaagctgaagctgcccaccgccggcatggaggaagctgccgctgccgccgccgccaagccggagccggccgccgagaaggccaagaggcccgccgaggcgccggccgctgatgccgagaagccacccgcacccaaggcacaagctgtgggttggccaccagtccggtcataccgcaggaacgtcatgaccgtccagtctgtgaagagcaagaaggaagaggagcctgagaagcagcagtccgctgccaacgccggcggcaacggctccgccttcgtgaaggtcagcatggacggcgcgccctacctgcgcaaggtggacctgaagatgtacaacagctacacggagctctccgttgctctgaagaagatgttcagcaccttcaccacatccgggaacaacatgaatgagggaaaactagttgatccggtcagcggtgctgatgtggtcactacttacgaagacaaggatggcgactggatgctcgttggcgacgtcccgtgggagatgtttgtcgagtcatgcaggcgtctgaggatcatgaagagctctgaagccataggtcttgccccaagaacgaaggacaagtgcaagaacaggagctgaagaagatacagcgttaaagacgctgcccgttgtgtcaaaagaatggtgcccttgcagtgtgctgcggtttttctagaaatataatgcgttttaattactagttggagggagacctgtcttgttcaatttgttcatggaccagaagcaataatctatctgtgtgtagctggattggtgttatgggatgtcccctcccgtgtgtcccagaatctacttggtgattttatcccagtgttgttaatcaagcttgtgtgattgttaagtaaagggcatcaatgagactattattattatggtcccttgtaagttaacct

SEQ ID NO: 1931 - protein, 237 aa, Zea mays
  misc_feature: Ceres Clone ID no. 100914105
  misc_feature (1)..(237): Bit score of 285.6 for HMM based on sequences of FIGURE 3.
  misc_feature (10)..(229): Pfam Name: AUX_IAA Pfam Description: AUX/IAA family
  misc_feature: Functional Homolog Of SEQ ID NO. 129
MAGADVDVGTELRLGLPGGGADAAKAAKRGFEDTIDLKLKLPTAGMEEAAAAAAAKPEPAAEKAKRPAEAPAADAEKPPAPKAQAVGWPPVRSYRRNVMTVQSVKSKKEEEPEKQQSAANAGGNGSAFVKVSMDGAPYLRKVDLKMYNSYTELSVALKKMFSTFTTSGNNMNEGKLVDPVSGADVVTTYEDKDGDWMLVGDVPWEMFVESCRRLRIMKSSEAIGLAPRTKDKCKNRS

SEQ ID NO: 1932 - DNA, 1276 bp, Zea mays
  misc_feature: Ceres Clone ID no. 100916680
  misc_feature: Encodes the peptide sequence at SEQ ID NO. 1933
gtctctcccagaacgcacagcacagtcgcagaacaggaaggcagagagcagcgccgcgatgagaggaggaggagcggggcccactgcggcgttcatgtccgacgagccgcctccagccgacgcggaagaggtggaggagaactccggcgccgaggaggaggacgaggagacggtggtggagcaggacgacgacgagctggagctggggctctgcctcggctccaagcaacagcagcagcagcatccgccgccgtgccggatcctcacggcccgggacctgcagccgaggtccctgtcaccggattcctccgtgtcctcttcctcccccgcggcaggtgcaggtaccgcggcgccaagcaagagggccaaggcggatgcggcgcccaactcgccagggacggtcgcgtctggccacccacagagcagctttggagtggtgggatggccacccataagaactttcaggatgaacagcctatttaaccaggccaaagagaatgcatcggaggctggcgccaagaagcccatcgtcgaacctgacatgcaggaagacaaggaggagagcaagaaaggccggaccgtcggttgggtgaaggtgaacatggaaggagatatcattggaaggaaggtcgatctcaatgcccatcgctcttacaagacccttgcctcagcacttgagctcatgttcatgaagccgtccattggtctttgcacttctagcagttcaaagactctaaagctattagacagctcatcggagtatcagctcacctatgaggacagggacggggactggatgcttgttggagatgttccctgggagatgtttgtaggttcagtgaagaggctcaagatcatgagaacctcagacgccaaaggtctcggtccacgattccaagggtctcacagacccacagcagcttgcacgagaggcaggacgtgaaaccaccgatgtgcgtttggtgctaacaccgctggtgaagcttgaactgtatttgatatcacgtaacagtaacagcagcccatatcgctggcatagttgtgagattacggggctgtttggtttactgtctaaggcgccacaacatggctaacttttatgtctaagtttagttcttcaattcgaacgactaaacttaggcaacttcattgtgtctagtggaaatagtagaagtttttttttttgcttcttccctgtggtgccctcgttgagcttttcttatgggctatacgagcatcatcgcccccagctcttctgtccacgctgtttacctgt

SEQ ID NO: 1933 - protein, 294 aa, Zea mays
  misc_feature: Ceres Clone ID no. 100916680
  misc_feature (1)..(294): Bit score of 157.0 for HMM based on sequences of FIGURE 3.
  misc_feature (40)..(279): Pfam Name: AUX_IAA Pfam Description: AUX/IAA family
  misc_feature: Functional Homolog Of SEQ ID NO. 129
MRGGGAGPTAAFMSDEPPPADAEEVEENSGAEEEDEETVVEQDDDELELGLCLGSKQQQQQHPPPCRILTARDLQPRSLSPDSSVSSSSPAAGAGTAAPSKRAKADAAPNSPGTVASGHPQSSFGVVGWPPIRTFRMNSLFNQAKENASEAGAKKPIVEPDMQEDKEESKKGRTVGWVKVNMEGDIIGRKVDLNAHRSYKTLASALELMFMKPSIGLCTSSSSKTLKLLDSSSEYQLTYEDRDGDWMLVGDVPWEMFVGSVKRLKIMRTSDAKGLGPRFQGSHRPTAACTRGRT

SEQ ID NO: 1934 - DNA, 1234 bp, Zea mays
  misc_feature: Ceres Clone ID no. 100922469
  misc_feature: Encodes the peptide sequence at SEQ ID NO. 1935
ccacccgccccggccccaatgtcgccgcccctcgagccccacgactacatcggcctctccgccgccgccgccgcggcgccgccgacaccgacctcctcctcgtcgtcctcgtcctcgccggcgccccgcctcaccctccgcctcggcctgccgggctccgagtcccccgaccgcgaccgcgaccgggaccgctgcgaggacgtcgccgccgcgctctccctcggcccgctgcctgctacccccaaggcgcccgctgccgtctccgccaagcgcgccttcccggaccccgcccagcgccccggcgctgccaaggctagcgacgacaagcaggcgtcccccgccgccccgccggccgccaaggcgcaggtggtgggatggccgcccgtgcggaactaccggaagaacaccctcgccgcgagcgcctccaggagcaaggcgccggcggcggaggacgccgcgtctgcggcccggcccatgtacgtgaaggtgagcatggatggcgcgccctacctcaggaaggtggacatcaagatgtactccagctacgaggacctctccgtggcgctccagaagatgttcagctgcttcatcgctggtcaaagtggcctgcataaatcatcgagcaaagacaggctgactaatggctcgaaggtggatgccctcaaagaccaggagtatgtacttacatatgaggataaggatgcagactggatgcttgtcggtgatcttccctgggactatggtgacatgcaaataacagaaggatgaaaagaaaaaaaatgtacttgtggcgcaggtactaaacgcatttgttatataattcggtaaactgattaccccgtataagtttcatatacaattcgttattttacctctatctgccggaagctcaaaatcatgaggggctctgatgctgttggaatagctccaagaaccatagagcagacaggtcagaacaaataagcttggtctttgcctgcacccacgcaagaaatctgagctagctggaaggccatgttgaaggcttaaatagttgctcggaattatcaaaagtcgtcaaatgttagtgtagtttccacgtgttcttgagacgtgtgtatttgtatgtctgtgatgtgatccgtcagatctgttcttgtgcccttcaaaggccaaatcagggagctctctgcttcctgtgtatgcttgctttttccagtattccctgttattctactatgaaatcatccatcgt

SEQ ID NO: 1935 - protein, 249 aa, Zea mays
  misc_feature: Ceres Clone ID no. 100922469
  misc_feature (1)..(249): Bit score of 204.6 for HMM based on sequences of FIGURE 3.
  misc_feature (40)..(245): Pfam Name: AUX_IAA Pfam Description: AUX/IAA family
  misc_feature: Functional Homolog Of SEQ ID NO. 129
MSPPLEPHDYIGLSAAAAAAPPTPTSSSSSSSSPAPRLTLRLGLPGSESPDRDRDRDRCEDVAAALSLGPLPATPKAPAAVSAKRAFPDPAQRPGAAKASDDKQASPAAPPAAKAQVVGWPPVRNYRKNTLAASASRSKAPAAEDAASAARPMYVKVSMDGAPYLRKVDIKMYSSYEDLSVALQKMFSCFIAGQSGLHKSSSKDRLTNGSKVDALKDQEYVLTYEDKDADWMLVGDLPWDYGDMQITEG

SEQ ID NO: 1936 - DNA, 1114 bp, Zea mays
  misc_feature: Ceres Clone ID no. 100969565
  misc_feature: Encodes the peptide sequence at SEQ ID NO. 1937
tcaccccttccgcctacccacgcaaacggcacacgaactaacagccacctctcacgtcccccaccctctggttcatgtcctgctgctccccatgtcgcctccactcgagctcgactacataggcctctcgccgccggcggcagccgccgccgctgaaaacgacgaactgaagggtactgagctccgcctcgggctgccagggtccgggtcgccggaccgccgtgtcgtggctgccaccgcgaccaccctggacctgctcccggccaagggcgccaagcgcgggttttctgacgaggcgcccccgccatcgcctgttgccactgccggaaagggaaagaaggtggcagaagaggagtacgacgagaagaaggtggcagcgaccccgcagccggccgccaaagcacaggtggtgggatggccaccagtctgcaactaccgcaagaacacgatgactaccacccagctggagggcagcaaggaggatggtgatgccaagcagggtcaggggttcctgtacgtcaaggtcagcatggatggcgcgccgtacctcaggaagatcgacctcaagacttacaagaactacaaggacctgtcgaccgcgcttgagaagatgttcagtggcttcagtactggcaaggacggctcatytgagtaccgcaaggatggtgaatatgttttgacttacgaggacaaggatggagattggatgcttgtcggcgacgtaccatgggagatgttcgccggctcctgccgcaggctcaggatcatgaaaggctcagatgcgattggactcgctccaagggcagccgataagtccaagaaccgcaactagaacggtggcttcctatccttacacagtccggtacgagggaggagatgcagtgacttgtagggatttgtacgaaaaccgaaaaagtttactaacagctatgacttgtgagaagaattttggcttatggtttgcactagaatggcttggtacatcgtttatggacaaaacacgctattcgattaattgttgttaattaagccttggggggggtacgagtgctattcatgtaaatggtttggtgcatcgtgtgctgctgctgcctgctgctgttactacgattga

SEQ ID NO: 1937 - protein, 246 aa, Zea mays; identical to SEQ ID NO: 1422
  misc_feature: Ceres Clone ID no. 100969565
  misc_feature (1)..(246): Bit score of 400.2 for HMM based on sequences of FIGURE 3.
  misc_feature (25)..(238): Pfam Name: AUX_IAA Pfam Description: AUX/IAA family
  misc_feature: Functional Homolog Of SEQ ID NO. 129
  misc_feature (186)..(186): Xaa is any aa, unknown, or other

SEQ ID NO: 1938 - DNA, 1237 bp, Zea mays
  misc_feature: Ceres Clone ID no. 100973322
  misc_feature: Encodes the peptide sequence at SEQ ID NO. 1939
gcgaggaaccccaccccacgtcgccctccccccacctttctctctagtctctagtttctagtctctacccccaggccccagactcctgcctcttctctctctcgcccacccgccccggccccaatgtcgccgcccctcgagccccacgactacatcggcctctccgccgccgccgccgcggcgccgccgacaccgacctcctcctcgtcgtcctcgtcctcgccggcgccccgcctcaccctccgcctcggcctgccgggctccgagtcccccgaccgcgaccgcgaccgggaccgctgcgaggacgtcgccgccgcgctctccctcggcccgctgcctgctacccccaaggcgcccgctgccgtctccgccaagcgcgccttcccggaccccgcccagcgccccggcgctgccaaggctagcgacgacaagcaggcgtcccccgccgccccgccggccgccaaggcgcaggtggtgggatggccgcccgtgcggaactaccggaagaacaccctcgccgcgagcgcctccaggagcaaggcgccggcggcggaggacgccgcgtctgcggcccggcccatgtacgtgaaggtgagcatggatggcgcgccctacctcaggaaggtggacatcaagatgtactccagctacgaggacctctccgtggcgctccagaagatgttcagctgcttcatcgctggtcaaagtggcctgcataaatcatcgagcaaagacaggctgactaatggctcgaaggtggatgccctcaaagaccaggagtatgtacttacatatgaggataaggatgcagactggatgcttgtcggtgatcttccctgggattattttacctctatctgccggaagctcaaaatcatgaggggctctgatgctgttggaatagctccaagaaccatagagcagacaggtcagaacaaataagcttggtctttgcctgcacccacgcaagaaatctgagctagctggaaggccatgttgaaggcttaaatagttgctcggaattatcaaaagtcgtcaaatgttagtgtagtttccacgtgttcttgagacgtgtgtatttgtatgtctgtgatgtgatccgtcagatctgttcttgtgcccttcaaaggccaaatcagggagctctctgcttcctgtgtatgcttgctttttccagtattccctgttattctactatgaaatcatccatcgtgccacaaagaactgatggttcctg

SEQ ID NO: 1939 - protein, 272 aa, Zea mays
  misc_feature: Ceres Clone ID no. 100973322
  misc_feature (1)..(272): Bit score of 278.2 for HMM based on sequences of FIGURE 3.
  misc_feature (40)..(264): Pfam Name: AUX_IAA Pfam Description: AUX/IAA family
  misc_feature: Functional Homolog Of SEQ ID NO. 129
MSPPLEPHDYIGLSAAAAAAPPTPTSSSSSSSSPAPRLTLRLGLPGSESPDRDRDRDRCEDVAAALSLGPLPATPKAPAAVSAKRAFPDPAQRPGAAKASDDKQASPAAPPAAKAQVVGWPPVRNYRKNTLAASASRSKAPAAEDAASAARPMYVKVSMDGAPYLRKVDIKMYSSYEDLSVALQKMFSCFIAGQSGLHKSSSKDRLTNGSKVDALKDQEYVLTYEDKDADWMLVGDLPWDYFTSICRKLKIMRGSDAVGIAPRTIEQTGQNK

SEQ ID NO: 1940 - DNA, 1580 bp, Glycine max
  misc_feature: Ceres Clone ID no. 1113354
  misc_feature: Encodes the peptide sequence at SEQ ID NO. 1941
attctcttttgcacagtaatgcaatcacaatctctcattcccagttcaatattcccatttcttcctttttctttttttgttacaccacacacaattccattgctaccagtttaacagaatgcatagagttttataataatatcatagaaacaaactgaacacataaaaattcagttcagagaagcttctcttcatcaaagcttcatatttttatttttattgtataaactctaattctcaaccttagtttctgtttccttatctctctcttgttttccacttttttgaaaagaagtgatactgtgtggtagtagtgtgagctgaagtttgatgtctgtgtcattggagcaagaaggctatgtaggcttatcagaggttcctgcaatggaaggttgttctgagaggactggtggtggcttgaacctcaaggctactgagctgaggcttggtttgccaggttctgagtcaccagagagagaagagggtgtggaggacaagaatgtgcaccctttaggcatggtgaagtgtttggtgtcaggggccaagaggggtttctcagacaccattgatgggggttctgggaagtggcttctttctgggaatagtggatctgaggtgggtttggggaaagatggtggcttcttctctccaaggggtgttggtgttagtgttagtgctgccaaggctgagtgtaccaaccaacaaacttgtgttgtaaaagataaagttcctcaatctccaaagccgttgaatgagaagaagcctcagatatctgttcctgctgcaaaggaacaagttgtgggatggccaccaatccgttctttcagaaagaactcaatggccactcagccacaaaagaatgatgataatgcagaagccaagtcggtatgcctttatgtgaaggtcagcatggatggtgctccatacttgaggaaagttgacctcaaaaactttggcacttacatggaactgtcttcagcactggaaaagatgtttagttgttttacaatcagtcaatgtggttcccatggagtttgtggtcgagataagttgactgaaaatagattgatggatctcctccatggttcagaatatgtgctcacctatgaagacaaggatggtgattggatgcttgttggtgatgttccatgggagatgttcaccgactcttgcaagaggttgaggataatgaagagttctgaagcaattggactagcaccaagagccatggaaaaatgcaaaagtcgcaactagcaagatggtgttgatacagaaagatgaattattattattacctttaaacacgtacatcatacaagagtccagaggcaagtgcagggcacaagctggggcttttcttgcttgaatatgtatgatataatcctacatatgggatccaagtatcctagactttttagtaggcaagatatgtttgttgtagacatttaaggtttcttaggcttgtttcccctcacttctcttcaatcactgtcactgtggacttcataagactgaagctacgtcgttactatgtaaattttgtaacttaagtctcatatatagattagtttgagatggtt

SEQ ID NO: 1941 - protein, 307 aa, Glycine max; identical to SEQ ID NO: 1442
  misc_feature: Ceres Clone ID no. 1113354
  misc_feature (1)..(307): Bit score of 289.0 for HMM based on sequences of FIGURE 3.
  misc_feature (30)..(299): Pfam Name: AUX_IAA Pfam Description: AUX/IAA family
  misc_feature: Functional Homolog Of SEQ ID NO. 129

SEQ ID NO: 1942 - DNA, 919 bp, Glycine max; identical to SEQ ID NO: 1443
  misc_feature: Ceres Clone ID no. 1113630
  misc_feature: Encodes the peptide sequence at SEQ ID NO. 1943

SEQ ID NO: 1943 - protein, 227 aa, Glycine max; identical to SEQ ID NO: 1444
  misc_feature: Ceres Clone ID no. 1113630
  misc_feature (1)..(227): Bit score of 303.2 for HMM based on sequences of FIGURE 3.
  misc_feature (2)..(219): Pfam Name: AUX_IAA Pfam Description: AUX/IAA family
  misc_feature: Functional Homolog Of SEQ ID NO. 129

SEQ ID NO: 1944 - DNA, 1263 bp, Arabidopsis thaliana
  misc_feature: Ceres Clone ID no. 13741
  misc_feature: Encodes the peptide sequence at SEQ ID NO. 1945
gaaactctctttcagatttcaagaaacccttaaaatcctctctctgtctctttctgtttgtttgttttcttgtttccttctctctctctctttctttctttgtcttcctttcccaggttgtttttttttgctctctctgccttcttgactttcaaaagactctttctttcttttggattgattttggattctagggctctctttcttttagtgggtttttgttcttgttgtggtctctctgatgattactgaacttgagatggggaaaggtgagagtgagcttgagcttggtctagggctgagtcttggcggtggaacggcggccaagattggtaaatcaggtggtggtggcgcgtggggagagcgtggaaggcttttgacggstaaggattttycttctgttggttctaaacgtgctgctgattctgcttctcatgctggttcatctcctcctcgttcaagtcaagttgttggatggcctcctatagggtcacacaggatgaacagtttggttaataaccaagctacaaagtcagcaagagaagaagaagaagctggtaagaagaaagtgaaagatgatgaacctaaagatgtgacaaagaaagtgaatgggaaagtacaagttggatttattaaggtgaacatggatggagttgctataggaagaaaagtggatttgaatgctcattcttcttacgagaatttggcgcaaacattggaagatatgttctttcgcactaatccgggtactgtcgggttaaccagtcagttcactaaaccgttgaggcttttagatggatcgtctgagtttgtacttacttatgaagataaggaaggagattggatgcttgttggtgatgttccatggagaatgttcatcaactcggtgaaaaggctacgtgtgatgaaaacctctgaagctaatggactcgctgcacgaaatcaagaaccaaacgagagacagcgaaagcagccggtttagatctcttttcgacgttacggtgttacaggttttatattttggggttttgcaagtctgagatacttctgaagcaagcataagctagattgatcttatatccagtttgtgtattttcttggttcttataatggtttttactggttttctttagtttttttttttgctgtcttttaattttcggttgcgatttcactatatactatggatggaagagaatgctctttatatcttttactacactgtaaatatttgaagcttatctaatatcgtttttaagggtc

SEQ ID NO: 1945 - protein, 246 aa, Arabidopsis thaliana
  misc_feature: Ceres Clone ID no. 13741
  misc_feature (1)..(246): Bit score of 181.1 for HMM based on sequences of FIGURE 3.
  misc_feature (15)..(234): Pfam Name: AUX_IAA Pfam Description: AUX/IAA family
  misc_feature: Functional Homolog Of SEQ ID NO. 129
  misc_feature (48)..(48): Xaa is any aa, unknown, or other
  misc_feature (52)..(52): Xaa is any aa, unknown, or other
MITELEMGKGESELELGLGLSLGGGTAAKIGKSGGGGAWGERGRLLTXKDFXSVGSKRAADSASHAGSSPPRSSQVVGWPPIGSHRMNSLVNNQATKSAREEEEAGKKKVKDDEPKDVTKKVNGKVQVGFIKVNMDGVAIGRKVDLNAHSSYENLAQTLEDMFFRTNPGTVGLTSQFTKPLRLLDGSSEFVLTYEDKEGDWMLVGDVPWRMFINSVKRLRVMKTSEANGLAARNQEPNERQRKQPV

SEQ ID NO: 1946 - DNA, 1261 bp, Zea mays
  misc_feature: Ceres Clone ID no. 1560553
  misc_feature: Encodes the peptide sequence at SEQ ID NO. 1947
tcgtcttccattccagtacaccgcacgcacgcactcgcctccgacagcgaccgcgcaacgtccttctcccgcgccgcccggccggccggtccctgttccctctcctcccctcggagcagcaggagcaggagcagccgcgttcgtcctctgcgctgcgcggcccgccggcctgaccaagcaaagcttatcggccggagccggacgaacgaacgatgcagcaggacctcagaaactcagagagaagaaacccggaacaggcgcatccagtgatgtcggcgagctcgaccaactccgcggcttccccggccgtgtccggcctcgactacgacgacacggcgctcaccctcgcgctcccgggctcctccgccgagcccgccgccgatcgcaagcgcgcccacgccgaccacgacaagccgccatccccaaaggcgcgggccgtgggctggccgccggtccgcgcgtaccggcgcaacgcgctgcgcgacgaggccaggctcgtgaaggtggccgtggacggcgcgccgtacctgcggaaggtggacctcgcggcgcacgacgggtacgcggccctgctccgcgcgctccacggcatgttcgcctcctgcctcgttgccggagccggagccgacggggcggggcggatcgacaccgccgccgagtacatgcccacctacgaggacaaggacggcgactggatgctcgtcggagacgtccccttcaagatgttcgtggactcgtgcaagaggatccgcctcatgaagagctccgaggccgtcaacctatctccgaggacatcatcccggcagtgattgttgttggtgtggacgccatatgccctacgcggcttatctctccgaattagttcacagagtgtgtgctggaagaggcttggctgctcaggtcctccatgcacacgtcatacaccgtacgtagggtgagggttcagtctgttgctgtgtgttctgtacaggccacaccacacacgcccccatggaaaactttttcagtttcgagtgcccctccctctcggccggacggtttggtttttggacgacgccggcgaggaggcggcgctagcacactagtagctccgtttccgtgtgttctttcatacttggctttggtttccgtttcagtcttcggccctcggtcgtcttgtctcgactctcgagggatccatgtatacacgaacatggtacatgctgtgtgctgtttccattgtataaggtcaaagaatacaagtacgatctgtctctgttct

SEQ ID NO: 1947 - protein, 198 aa, Zea mays
  misc_feature: Ceres Clone ID no. 1560553
  misc_feature (1)..(198): Bit score of 204.9 for HMM based on sequences of FIGURE 3.
  misc_feature (13)..(194): Pfam Name: AUX_IAA Pfam Description: AUX/IAA family
  misc_feature: Functional Homolog Of SEQ ID NO. 129
MQQDLRNSERRNPEQAHPVMSASSTNSAASPAVSGLDYDDTALTLALPGSSAEPAADRKRAHADHDKPPSPKARAVGWPPVRAYRRNALRDEARLVKVAVDGAPYLRKVDLAAHDGYAALLRALHGMFASCLVAGAGADGAGRIDTAAEYMPTYEDKDGDWMLVGDVPFKMFVDSCKRIRLMKSSEAVNLSPRTSSRQ

SEQ ID NO: 1948 - DNA, 646 bp, Musa acuminata
  misc_feature: Ceres Clone ID no. 1733954
  misc_feature: Encodes the peptide sequence at SEQ ID NO. 1949
gtgaagtcatcgacaagctcgtttgaatcctcttctttaggtgcaaagacgcagaggtcgcacaagtttacgtacatggaagctgcgggagagagcctgagagacaccgagctgaggctcggattgccaggcaccgacgcgcctgagaagccggcgtcgacggtgacaaggggcggcaagcgagccctcccggaggacgacgaggagggttacgccaagagcaacaagtcgtcgtcggaggaggagcagggggagggcgacctgtgctgccaagaacccccggcggcgaaggcgcaggtggttggctggccgcccatccggtcgtacaggaagaacagccttcacgctaggaaggtggagggggaggccgccggcttgtacgtgaaggttagcatggacggggctccctacttgaggaagatcgatctcaaggtctacaagggttacaaggagctcacagaagccttagacgacatgttcaagtgcttctctctaggagaatttccaaggaaagaagggtgcagtggatcagaatacgccatcatttatgagaacaaagatggagacttgatgttggtcggagatgttccctgggagatgttcatctcttcttgtagaagactgaggataattgaagggatctgaa

SEQ ID NO: 1949 - protein, 189 aa, Musa acuminata
  misc_feature: Ceres Clone ID no. 1733954
  misc_feature (1)..(189): Bit score of 328.1 for HMM based on sequences of FIGURE 3.
  misc_feature (7)..(188): Pfam Name: AUX_IAA Pfam Description: AUX/IAA family
  misc_feature: Functional Homolog Of SEQ ID NO. 129
MEAAGESLRDTELRLGLPGTDAPEKPASTVTRGGKRALPEDDEEGYAKSNKSSSEEEQGEGDLCCQEPPAAKAQVVGWPPIRSYRKNSLHARKVEGEAAGLYVKVSMDGAPYLRKIDLKVYKGYKELTEALDDMFKCFSLGEFPRKEGCSGSEYAIIYENKDGDLMLVGDVPWEMFISSCRRLRIIEGI

SEQ ID NO: 1950 - DNA, 1388 bp, Panicum virgatum
  misc_feature: Ceres Clone ID no. 1748604
  misc_feature: Encodes the peptide sequence at SEQ ID NO. 1951
atgcctttacattgcaatcgcaagcctcctcctaccacccttcctccctctcaaagcagccaagcaagaagccaaacagccagccagcgagcaagaagccgcgcgagctagcagagggagcaggaaggcgaggaggtgaggagcgaggtggctgcggcggcggcaatggcggcggacctggggttcgaggagaccgagctccggctgggcctgcccggtggcggcgggggaggggttggagacggcgaggggacaaggagcgcctccggcaagaggggcttcgccgagaccatcgacctcaagctgaagctggagccggcggcggcggccgtcgtggaagaggagaaggaggtagtggatgccgccaaggaggccgcggcggcgaccgaggagtccccggccgggaagatgaagcggtcgcccagccagagcagcgtcgtcaccgccgccgccgcctcgcagcccgaccccgccgagaagccgcgcgcccccaaggctcaggtggtcggatggccgccggtgcgctcgttccggaagaacatcatgtctgtgcagtccgagaagggcgccggcagcaaggacgccgacgccgacaagtcctcgccggcagccggcggcggcgccgcgttcgtgaaggtgagcctggacggcgcgccgtacctgcgcaaggtggacctcaagatgtacaagagctaccaggagctgtccaaggctctcgagaagatggtcagctccttcaccaatggaagctgtgggtcccaagggatgaacggcatgaacgagagcaagctggtggatctgcttaacggctccgagtacgtgctgacctacgaggacaaggacggcgactggatgctcgtcggcgacgtcccatgggagatgttcgtcgaatcgtgcaagcgccttcggatcatgaagggatcagaagccattggcctggcgccaagggccatggagaaatgcaagaacagaagctgaacacatgggccgccagccagatgcaaggaccaagtctctagctctgcagctctgctcgtctctgtatcatactcgtccctgttctccaagcctgtacctcctgatcagtgaagtcattttggtgtgtcaactgttctatcagttccagtgagtcagtcagccagccaggcagtcagtcagtcagtgttcaagtttcatcttgtcatatacaaaagagagaaaccatgaataacatgtatctgtcctataacaatgtctttttgctctacctgctctttttctttgttgggcacaaaatgcaaaggcaccctgctcctaatcaaggggcccttttgcatcttgtccaccaaaagttgtttaattatattaccatggtgtgtcaatggaacaaataattgttgcaagctgtt

SEQ ID NO: 1951 - protein, 270 aa, Panicum virgatum
  misc_feature: Ceres Clone ID no. 1748604
  misc_feature (1)..(270): Bit score of 281.8 for HMM based on sequences of FIGURE 3.
  misc_feature (5)..(262): Pfam Name: AUX_IAA Pfam Description: AUX/IAA family
  misc_feature: Functional Homolog Of SEQ ID NO. 129
MAADLGFEETELRLGLPGGGGGGVGDGEGTRSASGKRGFAETIDLKLKLEPAAAAVVEEEKEVVDAAKEAAAATEESPAGKMKRSPSQSSVVTAAAASQPDPAEKPRAPKAQVVGWPPVRSFRKNIMSVQSEKGAGSKDADADKSSPAAGGGAAFVKVSLDGAPYLRKVDLKMYKSYQELSKALEKMVSSFTNGSCGSQGMNGMNESKLVDLLNGSEYVLTYEDKDGDWMLVGDVPWEMFVESCKRLRIMKGSEAIGLAPRAMEKCKNRS

SEQ ID NO: 1952 - DNA, 1112 bp, Panicum virgatum
  misc_feature: Ceres Clone ID no. 1777242
  misc_feature: Encodes the peptide sequence at SEQ ID NO. 1953
aggcagcttatagctcagacccacgacggccgcgacaggctagcccaccagcagctagctcccgcggagccgatgggtagcgccgacgtcgacgtcgggacggagctcagtctcgggctgccgggaggcggcgccgaggcggccaaggccgcgaagaggggcttcgaggacaccatcgacctcaagctgaagctgcccaccgctggcatggaggaagccgccgccggcaagccggagccggccgccgagaaggccaagaggcccgcagaggcggcggccgctgatgcagagaagccacccgcacccaaggcacaagctgtgggttggccaccagtgcgatcataccgaaggaacgtcatgaccgtccagtcagtgaagagcaagaaggaagaggaacccgagaagcagcagcccgctgccaacgccggcagtaacagctctgccttcgtgaaggtcagcatggatggcgcaccctacctacgtaaggtggacctgaagatgtacaatagctacaaggacctctcgattgctctgaagaagatgttcagcaccttcacaactaggaacaacatgaacgaggggaaattggttgatccggtgactggtgcagatgttgtcactacttacgaagacaaggatggtgactggatgcttgttggcgacgtcccgtgggagatgtttgtcgagtcatgcaagcgcctgaggatcatgaagagttctgaagccatcggtcttgcaccaagaaccaaggacaagtgcaagaacaagagctgaacaagatgcagcgtcaagatgctgcgcattatgtcataagaatggtgcccttgcagtgtgctgcggttttcctagaaatataatgtgttttaattactagtggagggagagctgtcttgttcaatttgttcatggaccagaagcaataatctatctgtgtgtagctggaatggtgttatgtgatgtcccctactgtgagtcccagaatctacttggtgattttattccagtgttgttaatcaagcttgtgtgattgttaagggcatcaatgagactattattattattatggtatcttgtaagttaacctgtttgttaatgtcaatacaatatttggc

SEQ ID NO: 1953 - protein, 233 aa, Panicum virgatum
  misc_feature: Ceres Clone ID no. 1777242
  misc_feature (1)..(233): Bit score of 283.3 for HMM based on sequences of FIGURE 3.
  misc_feature (10)..(225): Pfam Name: AUX_IAA Pfam Description: AUX/IAA family
  misc_feature: Functional Homolog Of SEQ ID NO. 129
MGSADVDVGTELSLGLPGGGAEAAKAAKRGFEDTIDLKLKLPTAGMEEAAAGKPEPAAEKAKRPAEAAAADAEKPPAPKAQAVGWPPVRSYRRNVMTVQSVKSKKEEEPEKQQPAANAGSNSSAFVKVSMDGAPYLRKVDLKMYNSYKDLSIALKKMFSTFTTRNNMNEGKLVDPVTGADVVTTYEDKDGDWMLVGDVPWEMFVESCKRLRIMKSSEAIGLAPRTKDKCKNKS

SEQ ID NO: 1954 - DNA, 1361 bp, Panicum virgatum
  misc_feature: Ceres Clone ID no. 1791455
  misc_feature: Encodes the peptide sequence at SEQ ID NO. 1955
gtctctcccaaaacacaccccctccctcgccgcagacccgcagtcactgagccaagaacgagcagcgcgatgagaggaggagcggggcccacggtggcgtttatcgccggcgacccgcctccggatgcggcggcggaggaggaggtggaggacgacgagctggagctggggctctgcctaggctccaagaagcagcagcagcagcagcagcagcccccatcgccagcgccgtgccggatcctgacggccagggacctgcagccgggggccctgtctccggactcctccgtgtcctcctcctcccccgcagcaggggcagcggcggccagcaagagggccaaggcggatacagcgcccaacgccaccatctcgccggggacggtcgcttctggccacccacagagctttggagtggtgggatggccacccataagaactttcaggatgaacagcctattcaaccaggccaaagacaatgcttcagaggctagcaccaagaaggccgctgatgaatctgacatgcagaaagacaaggagagcgagaagaaagggcgggttgtcggttgggtgaaggtgaacatggatggagatatcattggaaggaaggtcgatcttaacgcccatcgttcgtataagactcttgcctcagcacttgagctgatgttcatgaagccatccatcagtctttacacttctagtagtgcaaagtctctgaatctattggacagctcatcggaatatcagctcacctatgaggactgggatggggattggatgctcgtcggagatgttccatgggagatgtttgtaggttcagtgaagaggctcaagatcatgagggcatcagatgctaatggtctgggttagattcttcgctctctcttcttcaacccaggcatagtaaaacatttgaaggtctgcgattccaaggggttcacagagctgcagctttcacaagagctagaacttgagaagcactgatggcgttcgatctagagagctataccactggtgaagcttgaaatttgtttcatatcacataacagcagtccgtatctttggcatagttgtgagattacttgtgtctagtggaaatagtagaagcgctgtgaaggagccacaccaccgtgttctattctattctttttacttgcccttcggtgccctctttcagggctcttctcatggctatgagcatcctccccgtctcttctgtccacactgtttttatctgaggcatggtcgcccaaagtgtcggtttttctttttttttccccttttgtgctgtggcaatagtatttgttccacttgtttcatattcatgtttatatctgaatggatgtgcaaattgttgcggtctc

SEQ ID NO: 1955 - protein, 265 aa, Panicum virgatum
  misc_feature: Ceres Clone ID no. 1791455
  misc_feature (1)..(265): Bit score of 126.9 for HMM based on sequences of FIGURE 3.
  misc_feature (25)..(265): Pfam Name: AUX_IAA Pfam Description: AUX/IAA family
  misc_feature: Functional Homolog Of SEQ ID NO. 129
MRGGAGPTVAFIAGDPPPDAAAEEEVEDDELELGLCLGSKKQQQQQQQPPSPAPCRILTARDLQPGALSPDSSVSSSSPAAGAAAASKRAKADTAPNATISPGTVASGHPQSFGVVGWPPIRTFRMNSLFNQAKDNASEASTKKAADESDMQKDKESEKKGRVVGWVKVNMDGDIIGRKVDLNAHRSYKTLASALELMFMKPSISLYTSSSAKSLNLLDSSSEYQLTYEDWDGDWMLVGDVPWEMFVGSVKRLKIMRASDANGLG

SEQ ID NO: 1956 - DNA, 1317 bp, Panicum virgatum; identical to SEQ ID NO: 1416
  misc_feature: Ceres Clone ID no. 1805110
  misc_feature: Encodes the peptide sequence at SEQ ID NO. 1957

SEQ ID NO: 1957 - protein, 247 aa, Panicum virgatum; identical to SEQ ID NO: 1417
  misc_feature: Ceres Clone ID no. 1805110
  misc_feature (1)..(247): Bit score of 400.4 for HMM based on sequences of FIGURE 3.
  misc_feature (26)..(239): Pfam Name: AUX_IAA Pfam Description: AUX/IAA family
  misc_feature: Functional Homolog Of SEQ ID NO. 129

SEQ ID NO: 1958 - DNA, 1110 bp, Panicum virgatum
  misc_feature: Ceres Clone ID no. 1805378
  misc_feature: Encodes the peptide sequence at SEQ ID NO. 1959
tcccacctccttgtcctctgcctcctccctctcccgactcgcgaactcacgagctcagcagcagcggcggccagcggccagcggccaagacaaacctcgagcccatccctcctcctgacacctcactcccccaagaacccagtattccaggatttggtgatgctcgtaaagtttggctaggcatggcgcctccacaggagcgggactacatcgggctgtcgccggcgacggcggccaccgagctacgtctggggctgccgggcacggaagacgcggagggcggcgacgccgtggcggggacgccgctcaccctcgagctgcttcccaagggcggggccaagcgcggattcgcggacgccatcgtgcggcgggacgcggctgcaaccggcaaggaaccggcggacgacgaggaggacaagaagaaggcgcaggctccggcggcaaaggcacaggtggtaggatggccaccaatccgcagctacagaaagaacaccatggcgatgaaccaggattgcctctatgtcaaggttagcatggatggtgcgccatacctcaggaaggtggaccttaagatgtacagcaactacaaagagctctcactggcgctgaagaaaatgttcagctcctttactgttggtgatattgaatctaatggaaaatcaggaagagaaggattatctaattgccgactaatggatcataaaaatgggaccgaacttgtgctcacatataaggacaaggatggagattggatgcttgttggtgatgtcccgtggagaatgttcacaggcagctgtaggaggctcaggatcatgaagggctcagatgcagtgggccttgcacccagagcaaccgagaagagcaagaacggtaactaggaaaaggatgaatgcactctgctctctacagcctcatcctactctactcttacctgtaaggtcccattctcaaaccctcaaggttaaaggaattaacatgtgagaaggggattacttatatccatatgtacacctatggtttttgttttttccccttattttgcttgtttttttttttttggtttggactcagatatgtcagattgcaaacataagatgtgtgagtatgtcc

SEQ ID NO: 1959 - protein, 231 aa, Panicum virgatum
  misc_feature: Ceres Clone ID no. 1805378
  misc_feature (1)..(231): Bit score of 318.9 for HMM based on sequences of FIGURE 3.
  misc_feature (18)..(223): Pfam Name: AUX_IAA Pfam Description: AUX/IAA family
  misc_feature: Functional Homolog Of SEQ ID NO. 129
MAPPQERDYIGLSPATAATELRLGLPGTEDAEGGDAVAGTPLTLELLPKGGAKRGFADAIVRRDAAATGKEPADDEEDKKKAQAPAAKAQVVGWPPIRSYRKNTMAMNQDCLYVKVSMDGAPYLRKVDLKMYSNYKELSLALKKMFSSFTVGDIESNGKSGREGLSNCRLMDHKNGTELVLTYKDKDGDWMLVGDVPWRMFTGSCRRLRIMKGSDAVGLAPRATEKSKNGN

SEQ ID NO: 1960 - DNA, 1151 bp, Gossypium hirsutum
  misc_feature: Ceres Clone ID no. 1808032
  misc_feature: Encodes the peptide sequence at SEQ ID NO. 1961
ctttcccaacattatcatatattcccccctcctacttgcaatttctctagcaaatacactatcaagagagagagaaaagagagatattttgtgacgaaaaaaaaaaaaaggaaaaggactaaagttggatggttgtagggttttgcacgtaaaagctcgtgtttaatcatcataatgactagcattatgggcacagaggatgataagtatagcacgattaacttcgaagagacggagttgcgtttagggttgcccggcgccaatggaaacgacggtgaaactaccaaaaacaacggaaaacgagggttctcagagaccgttaatttgaagcttaacctttcatcaaaggagactgtagccgaggattccgacaagatgaaggagaagagctcaactgaccctgcaaagccacctgccaaggcacaagtggtgggatggccaccagtcaggtcattccggaagaacatcatggccgtccaaaaagccagttccgaggaggaaggtggcagcaagaaggccggaaacagtgcagccgccattactaccaccacggctgcggcgtttgttaaggtcagcatggacggtgcaccttatctacgcaaagtggacttgaaactatacaagagttaccaacaactctctgatgccttgagcaaaatgttcagctccttcactattggtaactgtgggtctcatggaatgaaagatttcatgaatgagagcaaattgatagaccttttgaatggttctgagtatgttcctacttatgaagacaaagatggagattggatgcttgttggagatgttccatgggagatgtttgttgattcgtgcaaacgcttacgaattatgaaaggatctgaggcaattggacttgcaccaagagcagtagagaagtgcaagaacagaagctaaggtaggtttagaaacaacaatcccaattaaaatcaagccagatcaaaatcagattgtatgtgaaaccagttgaatcgagaaccgaggtctgaagaagaagaaatattaataaaagttagtagggatatattttgatatttattaagggacaagaaatcaaataatagaaaattcataaagtttactttcaatggtttgtttaaataatatctttaaatatattaatggttttggtc

SEQ ID NO: 1961 - protein, 246 aa, Gossypium hirsutum
  misc_feature: Ceres Clone ID no. 1808032
  misc_feature (1)..(246): Bit score of 329.9 for HMM based on sequences of FIGURE 3.
  misc_feature (15)..(238): Pfam Name: AUX_IAA Pfam Description: AUX/IAA family
  misc_feature: Functional Homolog Of SEQ ID NO. 129
MTSIMGTEDDKYSTINFEETELRLGLPGANGNDGETTKNNGKRGFSETVNLKLNLSSKETVAEDSDKMKEKSSTDPAKPPAKAQVVGWPPVRSFRKNIMAVQKASSEEEGGSKKAGNSAAAITTTTAAAFVKVSMDGAPYLRKVDLKLYKSYQQLSDALSKMFSSFTIGNCGSHGMKDFMNESKLIDLLNGSEYVPTYEDKDGDWMLVGDVPWEMFVDSCKRLRIMKGSEAIGLAPRAVEKCKNRS

SEQ ID NO: 1962 - DNA, 1229 bp, Panicum virgatum
  misc_feature: Ceres Clone ID no. 1822256
  misc_feature: Encodes the peptide sequence at SEQ ID NO. 1963
aacgaacaaaaagaggccccgcttcgcttcccgccctgctgccgcgctgcgcctctctcccccacccggccttcctcggctcgacctctcaaaccgccccgactccgtccgatccgatgccgccgccgctcgaggcgcgcgactacatcggcctgggcgccgccgcgtcccccgcctcctcgtcctgctccggcgcccgcggcgagggggctccgggcccgcacctcgcgctgcggctcgggctgccggggtcggagtcccccggccgcggggcgggggcggagcacgtcgacgccgcgctcacgctgggacccgcgcctcccaggggcggcgccaagcgcgggttcgccgactccctcgaccggcccgcgaagcgggatgcggatgccggcgacgctgctggggccgtgagcggggaggagaacaagggtgtggctgctgcagccgccggagctccgcgggctgccaaggcacaggttgttggttggccacctgttcgtagacagagttaccgaaagaatatactagctgcgagtgccacaaagacaaaggggggagatgaaagtaggagtgaggcaggatgctgttatgttaaaatcagcatggatggagccccatacctaaggaaggtggacctcaagacctattcaagctatgaggatctctcgcttggtctcgagaaaatgttcagttgcttcatcactggtaaaagcagttcaggcaagccatcaagggacatgcttacggatggttctagggctgatgcccttctggaccaagaatatgtccttacttatgaagacaaagatgctgactggatgcttgttggtgatctgccctgggacttgttcaccacaacttgtcggaaacttagaatcatgagaggttctgatgctgcaggcatggctccaagatcactggaacaggttggtcggaacaaataaggtgccttgccctacacgtgaatcacgaatgtaatggtcagtttgcgatggcgctgaagggagcaatgttttatctgaagtgctatgtctttttccacatgtgcagtgagatttgtggcctactgtaagacgcccattttgcccacgaggttgtctgtaccattgttgatggttgcttttgtctgtgaaaggtcgaacactgcctctgtgatactttcaccagtttgcttatatattcagcagtttgtatttcataccgtagaagtaagaacaaatgttcatgtc

SEQ ID NO: 1963 - protein, 275 aa, Panicum virgatum
  misc_feature: Ceres Clone ID no. 1822256
  misc_feature (1)..(275): Bit score of 260.8 for HMM based on sequences of FIGURE 3.
  misc_feature (39)..(267): Pfam Name: AUX_IAA Pfam Description: AUX/IAA family
  misc_feature: Functional Homolog Of SEQ ID NO. 129
MPPPLEARDYIGLGAAASPASSSCSGARGEGAPGPHLALRLGLPGSESPGRGAGAEHVDAALTLGPAPPRGGAKRGFADSLDRPAKRDADAGDAAGAVSGEENKGVAAAAAGAPRAAKAQVVGWPPVRRQSYRKNILAASATKTKGGDESRSEAGCCYVKISMDGAPYLRKVDLKTYSSYEDLSLGLEKMFSCFITGKSSSGKPSRDMLTDGSRADALLDQEYVLTYEDKDADWMLVGDLPWDLFTTTCRKLRIMRGSDAAGMAPRSLEQVGRNK

SEQ ID NO: 1964 - DNA, 993 bp, Gossypium hirsutum
  misc_feature: Ceres Clone ID no. 1836924
  misc_feature: Encodes the peptide sequence at SEQ ID NO. 1965
atcaacaactccaactcacggttttggcaaacaaagaaatataaaggaaccccactgtaaccaatatccccaagcctttttcgtttcaaacaattatatcattgtaagttagcaatggagaatgatctcaacctcaaggcaacagaactgagattgggattacctggcagtgatgagcccgagagacaaatgacccctaggcctaacaagagaaccttatctgacattgtttctgagggatcaaggtcgaccacagaggaagatcatcaagacactgctcctcctgccaagtatgtctacatatatatataattgtgttttagaaacgtttagccaaagcaaaagtttagattctaatggttgggtgaatgtatatgaatgaatgcagggtacaaattgtaggatggccaccagtccgatcataccggaaaaattgtttacaaggcaagaaagatgacgttgaaggcgggacaggaatgtatgtcaaagtaagcgttgacggagctccttatctcagaaagattgatctcaaggtttatagaagctaccctcaactcctcttggctttggaaaacatgttcaagcttaccattggtgcatactcagagagggaaggctacaatggatctaactatgctccaacatatgaagacagagatggtgactggatgcttgttggagatgttccctgggaaatgttcatctcctcttgcaagaggctgagaatcatgaaagggtcagaagccagggggttggggtgcgtatgagacgcccaaaaaaagaacaaacaaggagattttctttggcttggataatccaaattccacaaggaagatgaagcctgctcttcctgagaagtgagaggtgccatttgctagaggaaaaattcagagactgcatccttttcaatccaaccatggctggctttcagcctccattatttcaaatacatgtacttctttataaatagcatataccacaaaaccaaaaggc

SEQ ID NO: 1965 - protein, 132 aa, Gossypium hirsutum
  misc_feature: Ceres Clone ID no. 1836924
  misc_feature (1)..(132): Bit score of 237.5 for HMM based on sequences of FIGURE 3.
  misc_feature (4)..(132): Pfam Name: AUX_IAA Pfam Description: AUX/IAA family
  misc_feature: Functional Homolog Of SEQ ID NO. 129
MYMNECRVQIVGWPPVRSYRKNCLQGKKDDVEGGTGMYVKVSVDGAPYLRKIDLKVYRSYPQLLLALENMFKLTIGAYSEREGYNGSNYAPTYEDRDGDWMLVGDVPWEMFISSCKRLRIMKGSEARGLGCV

SEQ ID NO: 1966 - DNA, 749 bp, Panicum virgatum
  misc_feature: Ceres Clone ID no. 2002366
  misc_feature: Encodes the peptide sequence at SEQ ID NO. 1967
attctctttctctgccaagaacaccggccggctagcagctcgtgctcccatggagatcgacgccgacaacctcagcgccaccgagctccgcctcggcctgccgggaaccagcagcggcgacgccgaccgcccgaagaggccggcgccctccgtcggcgccaagcgcgcgctcgacgacaccaggagcgaggcctcgggcaccagcccggccgccgggggcgaccacgacgccgccacgcctgccaaagcgcaagtggtggggtggccgccggtgagggcgtacaggaagaacaccttccaggcggcggcggcggcgaagaaggccgagcagccgggagggctgtacgtgaaggtgagcatggacggggcgccgtacctcaggaaggtggacctccggatgtataaggggtaccgggagctcagggaggcgctggacgccctcttcaccaagtccttctccgcctccgccggagcggagggcggcgacggccagcacgccctcgcctacgaggacaaggacggcgacctcatgctcgtcggagatgtgccctgggacatgttcatctcttcgtgcaagaagctcaagataatgaatggttctgaggccaggtgaccgctgatgcacaggcagaggctgcaactcatggggtgaatcgaggagcacaggtcgtgcaaaggagctgtgtggcttggactctccagtgctgtacaaagagatgggtgtttctgaaaccaaggagaggatctac

SEQ ID NO: 1967 - protein, 187 aa, Panicum virgatum
  misc_feature: Ceres Clone ID no. 2002366
  misc_feature (1)..(187): Bit score of 280.9 for HMM based on sequences of FIGURE 3.
  misc_feature (7)..(187): Pfam Name: AUX_IAA Pfam Description: AUX/IAA family
  misc_feature: Functional Homolog Of SEQ ID NO. 129
MEIDADNLSATELRLGLPGTSSGDADRPKRPAPSVGAKRALDDTRSEASGTSPAAGGDHDAATPAKAQVVGWPPVRAYRKNTFQAAAAAKKAEQPGGLYVKVSMDGAPYLRKVDLRMYKGYRELREALDALFTKSFSASAGAEGGDGQHALAYEDKDGDLMLVGDVPWDMFISSCKKLKIMNGSEAR

SEQ ID NO: 1968 - DNA, 683 bp, Panicum virgatum; identical to SEQ ID NO: 1392
  misc_feature: Ceres Clone ID no. 2016149
  misc_feature: Encodes the peptide sequence at SEQ ID NO. 1969

SEQ ID NO: 1969 - protein, 174 aa, Panicum virgatum; identical to SEQ ID NO: 1393
  misc_feature: Ceres Clone ID no. 2016149
  misc_feature (1)..(174): Bit score of 222.7 for HMM based on sequences of FIGURE 3.
  misc_feature (7)..(174): Pfam Name: AUX_IAA Pfam Description: AUX/IAA family
  misc_feature: Functional Homolog Of SEQ ID NO. 129

SEQ ID NO: 1970 - DNA, 1151 bp, Zea mays; identical to SEQ ID NO: 1371
  misc_feature: Ceres Clone ID no. 277751
  misc_feature: Encodes the peptide sequence at SEQ ID NO. 1971

SEQ ID NO: 1971 - protein, 223 aa, Zea mays; identical to SEQ ID NO: 1372
  misc_feature: Ceres Clone ID no. 277751
  misc_feature (1)..(223): Bit score of 269.1 for HMM based on sequences of FIGURE 3.
  misc_feature (7)..(222): Pfam Name: AUX_IAA Pfam Description: AUX/IAA family
  misc_feature: Functional Homolog Of SEQ ID NO. 129
  misc_feature (20)..(20): Xaa is any aa, unknown, or other

SEQ ID NO: 1972 - DNA, 1058 bp, Zea mays
  misc_feature: Ceres Clone ID no. 284442
  misc_feature: Encodes the peptide sequence at SEQ ID NO. 1973
cctctcttccacccactgcaaccccaaatctctccttcctcacacacgcgaagtgagagaccaaagaagaagaagaaggaggagctgctagcgtggaagtgcccaaggcgagagagagacaagctagctaggacggccgcgacaggctagccagccagctgctagctcctgcggacgaggcgatggctggcgccgacgtcgacgtcgggacggagctccggctcggcctgccgggaggaggcgccgcggcggccaagaaggacaccatcgacctcaagctgaagctgcctaccgctggcatggaggaggctgctgccgccgccaggccggagccggcagccgataaggccaagaggcccgccgaggcgccggccgccgatgccgagaagccacctgcacccaaggcacaggccgtgggctggccaccagtccgatcgtaccgcaggaacgccatgacgaccgtcgtccaggccgtgaggagcaagaaggaagaggaacctgagaagcagcaacagcccgctgccgccaacgccttcgtgaaggtcagcatggacggcgcgccctacctgcgcaaggtggacctgaagacgtacagcagctacaaggacctctccgctgcactcaagaagatgttcggcaccttcaccgcatctgggaacagcatgaacgaggggagattggttgatccggccggcgatgctgatgatgtggtcactacttacgaagacaaggatggtgactggatgctggtcggcgacgtcccgtgggagatgtttgtcgagtcatgcaagcgtctgaggatcatgaagagttctgaagccataggtcttgcaccaagaacgaaggacaagtgcaagaacaagagctgaagaagatgcagtgttaaagatgttgcacattgtatcaaaagaatggtccccttgcagtgcgctgccgttttttttcctactagaaatataacgcgttttaattactactagttggagggagacctgtcttgttcaactcgttcatggaccagaagcaataatctatccgtgtgtagctggattggtgtt

SEQ ID NO: 1973 - protein, 228 aa, Zea mays
  misc_feature: Ceres Clone ID no. 284442
  misc_feature (1)..(228): Bit score of 261.4 for HMM based on sequences of FIGURE 3.
  misc_feature (10)..(220): Pfam Name: AUX_IAA Pfam Description: AUX/IAA family
  misc_feature: Functional Homolog Of SEQ ID NO. 129
MAGADVDVGTELRLGLPGGGAAAAKKDTIDLKLKLPTAGMEEAAAAARPEPAADKAKRPAEAPAADAEKPPAPKAQAVGWPPVRSYRRNAMTTVVQAVRSKKEEEPEKQQQPAAANAFVKVSMDGAPYLRKVDLKTYSSYKDLSAALKKMFGTFTASGNSMNEGRLVDPAGDADDVVTTYEDKDGDWMLVGDVPWEMFVESCKRLRIMKSSEAIGLAPRTKDKCKNKS

SEQ ID NO: 1974 - DNA, 1257 bp, Zea mays; identical to SEQ ID NO: 1418
  misc_feature: Ceres Clone ID no. 285028
  misc_feature: Encodes the peptide sequence at SEQ ID NO. 1975

SEQ ID NO: 1975 - protein, 244 aa, Zea mays; identical to SEQ ID NO: 1419
  misc_feature: Ceres Clone ID no. 285028
  misc_feature (1)..(244): Bit score of 395.5 for HMM based on sequences of FIGURE 3.
  misc_feature (24)..(236): Pfam Name: AUX_IAA Pfam Description: AUX/IAA family
  misc_feature: Functional Homolog Of SEQ ID NO. 129

SEQ ID NO: 1976 - DNA, 1124 bp, Zea mays
  misc_feature: Ceres Clone ID no. 292605
  misc_feature: Encodes the peptide sequence at SEQ ID NO. 1977
atgagactctgaggctctgagctgagcgcgctccgtttcagtttcagagagcggttgctgtgcatgtgctggtgctgcgacttgactgttcgagcacagctgcgtctgcgtccccatggtgtagataggaggggaggaagcaggaagagggggaggcagcctgtgtgtgtgagagagaggcagaagtagtgaggaaggaagcaggaagatggcttggaatgcccgcttcggcgatgacgaggaaggcagcggccttgagctcagcctgggccttccgggctacttctccgggtcgccagaccaagccgcaggtttcgaggagaaagcgagccggggttctgctgctgctcctcctcctcctcctcccgctgctgctcgagcgaaaggaagcgacggcttcaaggcgaggccggcggcagctgctccggtcgtgggatggccgccggtgcgcgcgttccggcggaacctcgccacgtcgtcctccaagccgtcgagccacggaggcaaggagcccgccgcgagcgccgacggcgrcaacaagggcctgttcgtcaaggtcaacatggacggcgtccccatcggccgtaagctcgacctggcggcgcacgccggctacgacacgctctccgccgccgttgacagcctcttccgcggcctcttcgctgctcaagcggcggggccaggcggggagcagcaggctgtcgcgggtatcctgagcggcggcggcggcggcgagcacacgctggtgtacgaggacgacgagggcgaccagatgctggtcggggacgtgccgtggccgatgttcgtcgccaccgctaggcgtctgcgcgtgctcaagagctccgacctgagcccgtcgtcgctgagggcagcgagagccgcagctgagtgctgaacgcaccctggacctggagcctgaacgttttgcggcctctccggagggcccatccgtgtaaaatcgaagcagttttcgtcgattttgcttttagcaagggattatatgtcctagtgatcaagtagggaagcaagaatctatctagaggtgatgaggggtgtcgtagaaccatgcaatcctagtgctagattttttttctgaaagtttaacaaggtttcttggcgctggc

SEQ ID NO: 1977 - protein, 228 aa, Zea mays
  misc_feature: Ceres Clone ID no. 292605
  misc_feature (1)..(228): Bit score of 139.6 for HMM based on sequences of FIGURE 3.
  misc_feature (17)..(218): Pfam Name: AUX_IAA Pfam Description: AUX/IAA family
  misc_feature: Functional Homolog Of SEQ ID NO. 129
  misc_feature (109)..(109): Xaa is any aa, unknown, or other
MAWNARFGDDEEGSGLELSLGLPGYFSGSPDQAAGFEEKASRGSAAAPPPPPPAAARAKGSDGFKARPAAAAPVVGWPPVRAFRRNLATSSSKPSSHGGKEPAASADGXNKGLFVKVNMDGVPIGRKLDLAAHAGYDTLSAAVDSLFRGLFAAQAAGPGGEQQAVAGILSGGGGGEHTLVYEDDEGDQMLVGDVPWPMFVATARRLRVLKSSDLSPSSLRAARAAAEC

SEQ ID NO: 1978 - DNA, 1178 bp, Zea mays
  misc_feature: Ceres Clone ID no. 299894
  misc_feature: Encodes the peptide sequence at SEQ ID NO. 1979
tctagtctctagtttctagtctctacccccaggccccagccccccattcctgcctcttctctctctcgcccacccgccccggccccaatgtcgccgcccctcgagccccacgactacatcggcctctccgccgccgccgcgkcgccgccgaccccgacctcctcctcgtcgtcctcgtcctcgccggcgccccgcytcaccctccgcctcggcctgccgggctccgagtcccccgaccgcgaccgcgaccgctgcgaggacgtcgccgccgcgctctccctcggcccgctgcctgctacccccaaggcgcccgctgccgtctccgccaagcgcgccttcccggaccccgcccagcgccccggcgctgccaaggctagcgacgacaggcaggcctcccccgccgcgccgccggccgccaaggcgcaggtggtgggatggccgcccgtgcggaactaccggaagaacaccctcgccgcgagcgcctccaggagcaaggcgccggcgccggcggcggaggacgccgcgtctgcggcccggcccatgtacgtgaaggtgagcatggatggcgcgccctacctcaggaaggtggacatcaagatgtactccagctacgaggacctctccgtggcgctcgagaagatgttcagctgcttcatcgctggtcaaagtgtcctgcataaatcatcgagcaaagacaggctaactaatggctcgaaggtggatgccctcaaagatcaggagtatgtacttacatatgaggataaggatgcagactggatgcttgtcggtgatcttccctgggattattttacctctatctgtcggaagctcaaaatcatgaggggctctgatgctgttggaatagctccaagaaccatagagcagacaggtcagaacaaataagcttggtctttgcctgcacccacgcaagaaatctgagctagctgggaggccatgttgaaggctgaaatagttgctcggaattatcaaaagtcgtcaaatgttagtgtagtttccacgtgttcttgagacgtgtgtatttgtatgtctgtgatgtgatccgtcagatctgttcttgtgcccttcaaaggccaaatcagggagctctctgcttcctgtgtatgcttgcttttccagtattccctgttattctactatgaaatcatccatcgtgccac

SEQ ID NO: 1979 - protein, 271 aa, Zea mays
  misc_feature: Ceres Clone ID no. 299894
  misc_feature (1)..(271): Bit score of 282.7 for HMM based on sequences of FIGURE 3.
  misc_feature (39)..(263): Pfam Name: AUX_IAA Pfam Description: AUX/IAA family
  misc_feature: Functional Homolog Of SEQ ID NO. 129
  misc_feature (19)..(19): Xaa is any aa, unknown, or other
  misc_feature (37)..(37): Xaa is any aa, unknown, or other
MSPPLEPHDYIGLSAAAAXPPTPTSSSSSSSSPAPRXTLRLGLPGSESPDRDRDRCEDVAAALSLGPLPATPKAPAAVSAKRAFPDPAQRPGAAKASDDRQASPAAPPAAKAQVVGWPPVRNYRKNTLAASASRSKAPAPAAEDAASAARPMYVKVSMDGAPYLRKVDIKMYSSYEDLSVALEKMFSCFIAGQSVLHKSSSKDRLTNGSKVDALKDQEYVLTYEDKDADWMLVGDLPWDYFTSICRKLKIMRGSDAVGIAPRTIEQTGQNK

SEQ ID NO: 1980 - DNA, 1180 bp, Zea mays
  misc_feature: Ceres Clone ID no. 305774
  misc_feature: Encodes the peptide sequence at SEQ ID NO. 1981
acctgtgcttccttccgtcgtcttcctgcctcctcttctgttcaccgctctggcgctctcctatactcttctctctctctcgctgaggcaggcgggggcagcctttcctccccggtcgccatcctcgtttatatacacacaccctctcttgccgaaccactgctcgcttctctgcctgcttctgcttgagtcgtgccagtgacccgtgaccgtgaccgcgagcttcagggacgcgggcggcggcgatcatggcgtggcgcggcccgctcggagccggagaggaggccctggacagcggcctcgagctcagcctcggcctcccggcatacttcgcccggccttcaggtttggacgccgccagggaggagcccgccgaggcctctgtctacgctatccaggccgccagtgggagcaatgtctccaaggcaagggtcaggccagcgggcgcggcgccggtggtggggtggccgccggtgcggtcgttccggaggaacctggccgcctcctcctccaggccgtcgtcggggaaacacacccgccaggagggcagcgccaaggacggcctgttcgtgaagatcaacatggacggcgtgccgatcaggcgcaaggtggacctcacggcgtacggcggctacgccgacctctccgccgccgtcggcaagctcttccgcggcctgcttgccgctcagagggaccgagcggccacggcgggtggcgaggaggaggaggagggggagggccccgtgatcggcggcgactacacgctggtgtacgaggacgacgagggcgacagggtccttgccggcgacgtcccctgggagatgttcgtggccaccgccaagaggctgcgcgtgctcaagagctccgacgtgccggcctcgtcggtgacgctgggagctgggggcccggagaggtctgcagccgactgctgctgctgaaacgtgctctgcttcgtcagctgcttgtaaaaagtcccgagtggaggagacgaggagtggccctatccctggcctcttttttgtgtgttgctcttgctgcctttctgctagtggtactagtattgggtgccagtaaaaagtaggagaacaaagtcatgacggtattaaggatgtaatgtgcaagattagcagtggtagtagtcgtaaggtgtttaatgaatctacggtctctgttttggggc

SEQ ID NO: 1981 - protein, 229 aa, Zea mays
  misc_feature: Ceres Clone ID no. 305774
  misc_feature (1)..(229): Bit score of 125.2 for HMM based on sequences of FIGURE 3.
  misc_feature (19)..(219): Pfam Name: AUX_IAA Pfam Description: AUX/IAA family
  misc_feature: Functional Homolog Of SEQ ID NO. 129
MAWRGPLGAGEEALDSGLELSLGLPAYFARPSGLDAAREEPAEASVYAIQAASGSNVSKARVRPAGAAPVVGWPPVRSFRRNLAASSSRPSSGKHTRQEGSAKDGLFVKINMDGVPIRRKVDLTAYGGYADLSAAVGKLFRGLLAAQRDRAATAGGEEEEEGEGPVIGGDYTLVYEDDEGDRVLAGDVPWEMFVATAKRLRVLKSSDVPASSVTLGAGGPERSAADCCC

SEQ ID NO: 1982 - DNA, 1070 bp, Zea mays
  misc_feature: Ceres Clone ID no. 316217
  misc_feature: Encodes the peptide sequence at SEQ ID NO. 1983
atatagatagataggagtacactgcgtaggagacagcaagagggcgaggctgtgtgtgagagagggagaggcagagaacattcggcagtgtgagaatcggaatcggagtcggagatggcttggaatggccgcttcggcaacgacgaggaggggagcggccttgagctcagccttagcctcccgggctacttctccggatcaccaacccaagctgcagcaggtttcgaggacaaagcagacggcggctctgctgctgctgctgctgctgcgcgagcaaagggaagcaatggcttcaaggccaggccggcggcagctgctccggtcgtgggatggccgccagtgcgcgcgttccggcggaacctcgcctcggcgtcctccaagccgtcccgcgatccgccaccaagccacagaggaaacgagtccgcgagcgtcggcgccggcggcaaggccgtcgagggcggcaacaagggcctgttcgtcaaggtcaacatggacggcgtgcccatcggccggaagctcgacctgggcggccacgccggctacgacacgctaaccgccgccgtcgaccacctcttccgcggcctcctctccgctcaaacgtcgggaccaggcggcgagcggcaggcggtcgcggggatcctgaacggtggcggcgagtacacgctggtgtacgaggacgacgagggagaccagatgctggtcggggacgtgccgtggcagatgttcgccgccaccgccaggcgtctgcgcgtgctgcggagctccgatctcaacccctcgtcgctaagggcagctaccaggaagagagctgcagcttagtgcttcgctggcgtaccctggagtctcaactctgaacattttgcggccttttcggagggccaccaatgtaaaattgaagcggtttttcgtggattttagttaccattaccatcatgtatgtgatcaagtagggaagcaggaatctagaggtgatgagcggtgttggtagaatcacgtaatttagtgctaggaccagcagtgtctcaacttttctgaaagtctaacaaggtgtcttggcgctggagtgtatg

SEQ ID NO: 1983 - protein, 234 aa, Zea mays
  misc_feature: Ceres Clone ID no. 316217
  misc_feature (1)..(234): Bit score of 123.2 for HMM based on sequences of FIGURE 3.
  misc_feature (17)..(223): Pfam Name: AUX_IAA Pfam Description: AUX/IAA family
  misc_feature: Functional Homolog Of SEQ ID NO. 129
MAWNGRFGNDEEGSGLELSLSLPGYFSGSPTQAAAGFEDKADGGSAAAAAAARAKGSNGFKARPAAAAPVVGWPPVRAFRRNLASASSKPSRDPPPSHRGNESASVGAGGKAVEGGNKGLFVKVNMDGVPIGRKLDLGGHAGYDTLTAAVDHLFRGLLSAQTSGPGGERQAVAGILNGGGEYTLVYEDDEGDQMLVGDVPWQMFAATARRLRVLRSSDLNPSSLRAATRKRAAA

SEQ ID NO: 1984 - DNA, 1278 bp, Zea mays
  misc_feature: Ceres Clone ID no. 319239
  misc_feature: Encodes the peptide sequence at SEQ ID NO. 1985
atccttctctcggctacctccaccactgctctgctcagctcgaacgaacaaaaagaactcccctcggccctctcctcttgtgcttctgcttccccaaccgagtctcctcaaccccaggcactcgccctctttcccctcgcctcggcccgcgactccgatgccgccgccgctcctcgagccgcgcgactacctcggcgccggcgccacctcgtcgtgctgctcgtcgtcctgctcctccggccgcgagggcgcggggccccacctcgcgctgcggctcgggcttccggggtccgacgactcccccggccgcggcgcggacgcggagcacgcccgcgcccacgtcgacgccgcgctcaccctcggccccgcccccgcccccgcccccgcgcctcccaggggcagcgccaagcgcgggttcgccgactccctcgaccggtccgcgaagcggsacggcgttgccgcggatgacgctgctgggggcgtcacacgggtagctgaagctgctgccggagctccgcccgctgccaaggcacaagttgttggatggccgcctgttaggagctaccggaagaataccctagctgccagtgccacaaagacaaatgggggagatgaaggtaggagtgaggcgggatgctgttatgtcaaggtcagcatggatggagccccatacctaaggaaggtggacctcaagacctattcaagctatgaggatctctcgcttggtctggagaaaatgttcagttgcttcatcactggtcaaaacagttcatgcaagacatcaagaagggataggcttactgatggttctagggctgatgcccttcaggaccaagaatatgtcctcacttacgaagataaagatgctgactggatgctcgttggtgatctgccctgggacttgttcaccacattttgccggaaacttaggatcatgagaggctctgatgctgctggcatggctcctccaagaccaccggaacagacagttcggaacaaatgagggcggacagcttacttacctggcgctgaactgaagggagagcgacgctgccttggtcaggccttctttcacttgtgcagtgggaactgcgtcctgctgtctcggacgcccattttgcccacgagctggtcgtcacgtgctgtcgctttttgtctgggaaagatagcgtactgcttgctgtatgatactttcatctgtgttcggaagtttgtagcgcttcatatcctggaagggagtaaagaaaatgtccatgctgtccggtgagaatttcttcc

SEQ ID NO: 1985 - protein, 281 aa, Zea mays
  misc_feature: Ceres Clone ID no. 319239
  misc_feature (1)..(281): Bit score of 253.3 for HMM based on sequences of FIGURE 3.
  misc_feature (38)..(272): Pfam Name: AUX_IAA Pfam Description: AUX/IAA family
  misc_feature: Functional Homolog Of SEQ ID NO. 129
  misc_feature (98)..(98): Xaa is any aa, unknown, or other
MPPPLLEPRDYLGAGATSSCCSSSCSSGREGAGPHLALRLGLPGSDDSPGRGADAEHARAHVDAALTLGPAPAPAPAPPRGSAKRGFADSLDRSAKRXGVAADDAAGGVTRVAEAAAGAPPAAKAQVVGWPPVRSYRKNTLAASATKTNGGDEGRSEAGCCYVKVSMDGAPYLRKVDLKTYSSYEDLSLGLEKMFSCFITGQNSSCKTSRRDRLTDGSRADALQDQEYVLTYEDKDADWMLVGDLPWDLFTTFCRKLRIMRGSDAAGMAPPRPPEQTVRNK

SEQ ID NO: 1986 - DNA, 1235 bp, Zea mays; identical to SEQ ID NO: 1359
  misc_feature: Ceres Clone ID no. 320997
  misc_feature: Encodes the peptide sequence at SEQ ID NO. 1987

SEQ ID NO: 1987 - protein, 267 aa, Zea mays; identical to SEQ ID NO: 1360
  misc_feature: Ceres Clone ID no. 320997
  misc_feature (1)..(267): Bit score of 285.2 for HMM based on sequences of FIGURE 3.
  misc_feature (40)..(259): Pfam Name: AUX_IAA Pfam Description: AUX/IAA family
  misc_feature: Functional Homolog Of SEQ ID NO. 129

SEQ ID NO: 1988 - DNA, 1179 bp, Zea mays; identical to SEQ ID NO: 1365
  misc_feature: Ceres Clone ID no. 334484
  misc_feature: Encodes the peptide sequence at SEQ ID NO. 1989

SEQ ID NO: 1989 - protein, 220 aa, Zea mays; identical to SEQ ID NO: 1366
  misc_feature: Ceres Clone ID no. 334484
  misc_feature (1)..(220): Bit score of 254.0 for HMM based on sequences of FIGURE 3.
  misc_feature (18)..(218): Pfam Name: AUX_IAA Pfam Description: AUX/IAA family
  misc_feature: Functional Homolog Of SEQ ID NO. 129
  misc_feature (155)..(155): Xaa is any aa, unknown, or other

SEQ ID NO: 1990 - DNA, 1252 bp, Zea mays
  misc_feature: Ceres Clone ID no. 336536
  misc_feature: Encodes the peptide sequence at SEQ ID NO. 1991
ctctgctcagctcgaacgaacaaaaagaactcccctcggccctctcctcttgtgcttctgcttccccaccgagtctcctcaaccccaggcactcgccctctgtcggtctgtcccctcccttcctcgcctccgatgccgccgccgccgccgcttctcgagccgcgcgactacctcggcgccggcgccacctcgtcgtgctgctcgtcgtcctgctcctccggccgcgagggcgcggggccccacctcgcgctgcggctcgggcttccggggtccgacgactcccccggccgcagcgcggacgcggagcacgccggcgcccacgtcgacgccgcgctcaccctcggccccgcccccgcccccgcgcctcccaggggcagcgccaagcgcgggttcgccgactccctcgaccggtccgcgaagcgggacggcgttgccgcggatgacgctgctgggggcgtcacgcgggtagctggagctgctgccggagctccgcccgctgccaaggcacaagttgttggatggccgcctgttaggagctaccggaagamtaccctagctgccagtgccacaaagacaaatgggggagatgaaggtaggagtgaggcgggatgctgttatgtcaaggtcagcatggatggagccccatacctaaggaaggtggacctcaagacctattcaagctatgaggatctctcgcttggtctggagaaaatgttcagttgcttcatcactggtcaaaacagttcatgcaagacatcaagaagggataggcttactgatggttctagggctgatgcccttcaggaccaagaatatgtccttacttacgaagataaagatgctgactggatgctcgttggtgatctgccctgggacttgttcaccacattttgccggaaacttaggatcatgagaggctctgatgctgctggcatggctcctccaagaccaccggaacagacagttcggaacaaatgagggcgggcagcttacttacctggcgctgaactgaagggagagcgacgctgccttggtcaggccttctttcacttgtgcagtgggatctgcgtcctgctgtctcggacgcccattttgcccacgagctggtcgtcacgtgctgtcgctttttgtctgggaaagatagcgtactgcttgctgtatgatactttcatctgtgttcggaagtttgtagcgcttcatatcctggaagggagtaaagaaaatgtccatgtgtccggtgagaatttctttc

SEQ ID NO: 1991 - protein, 281 aa, Zea mays
  misc_feature: Ceres Clone ID no. 336536
  misc_feature (1)..(281): Bit score of 248.4 for HMM based on sequences of FIGURE 3.
  misc_feature (40)..(272): Pfam Name: AUX_IAA Pfam Description: AUX/IAA family
  misc_feature: Functional Homolog Of SEQ ID NO. 129
  misc_feature (139)..(139): Xaa is any aa, unknown, or other
MPPPPPLLEPRDYLGAGATSSCCSSSCSSGREGAGPHLALRLGLPGSDDSPGRSADAEHAGAHVDAALTLGPAPAPAPPRGSAKRGFADSLDRSAKRDGVAADDAAGGVTRVAGAAAGAPPAAKAQVVGWPPVRSYRKXTLAASATKTNGGDEGRSEAGCCYVKVSMDGAPYLRKVDLKTYSSYEDLSLGLEKMFSCFITGQNSSCKTSRRDRLTDGSRADALQDQEYVLTYEDKDADWMLVGDLPWDLFTTFCRKLRIMRGSDAAGMAPPRPPEQTVRNK

SEQ ID NO: 1992 - DNA, 1390 bp, Zea mays
  misc_feature: Ceres Clone ID no. 342413
  misc_feature: Encodes the peptide sequence at SEQ ID NO. 1993
atcgcctcctctcgggctagctccacactcctttgtcctctccaaacgaacgaacaaaaagaggccgcttccccacccagtcacctcgacctcagcccctctcccccctccctatctcgactccgatgccgccgccgctcctcgaggcgcgcgactacatgggcgccggcgccaccccgttgtcctgctcctccagcggcgagggcacggggccgcacctcgcgctgcggctcgggctcccagggtccgactcccccggccgcgacgcggggccggagccggaccacgcccacgtcgacgccgcgctcaccctcggccctgcccccgcccccgcccccgcgcctcccagggtcggcgcaaagcgcgggttcgctgactcccgcgaccggtgcgtgaagcgggacgccactgctgcggatgacgctgctgggggagtgaccggggaggagaagcgggtagctgcggccgctgccggaactccgccggctgccaaggcgcaagttgttggatggccgcctgttaggagctaccggaagaacacactagctatgagtgccacaaagacaaacggggaagatgaaggtaggagtgaggcgggatgctgttatgttaaggtcagcatggatggagccccatacctaaggaaggtggacctcaagaccttttcgagctatgaggacctttcgcttgctctggagaaaatgttcacctgcttcatcactggccaaagcggttcgtgcaagacttcaagaagggagaggctcactgatggttctagggctgatgcccttcaggaccaagaatatgtccttacttacgaagataaagatgctgactggatgctcgttggtgatctcccctgggacttgttcaccacaatttgtgggaaacttagaatcatgagaggctctgatgctgctggcatggctccaagatcaccggagcagatagttgggaccagaataaggaacgttgcccggcatgcagagtcgtgaactgaaaggaaaggacagagtttacatggcgctgaagggagcggtgtttttacgtgaagtgctccggttaagtctctctctctctctttttaacccccacatgtgcaatgagatgtgtgtggccctactgtaagacaccccattttgcccacgaggttgtcacgcgttattgtagatggtcgcctttgtgttatgaacgatcaaactcggtagtagcttgcttgctgcttcctctacgatactttcctccgtatttggaagctcgtacttcatatggtagaagtaagaaaaaatgcccatgttgcccattaagtttttttctctcgtgatgtgtgtgcgagcgaactaactattcagtggatctagaaagaatctgatcagtgagtctgtgtgcc

SEQ ID NO: 1993 - protein, 289 aa, Zea mays
  misc_feature: Ceres Clone ID no. 342413
  misc_feature (1)..(289): Bit score of 251.0 for HMM based on sequences of FIGURE 3.
  misc_feature (34)..(271): Pfam Name: AUX_IAA Pfam Description: AUX/IAA family
  misc_feature: Functional Homolog Of SEQ ID NO. 129
MPPPLLEARDYMGAGATPLSCSSSGEGTGPHLALRLGLPGSDSPGRDAGPEPDHAHVDAALTLGPAPAPAPAPPRVGAKRGFADSRDRCVKRDATAADDAAGGVTGEEKRVAAAAAGTPPAAKAQVVGWPPVRSYRKNTLAMSATKTNGEDEGRSEAGCCYVKVSMDGAPYLRKVDLKTFSSYEDLSLALEKMFTCFITGQSGSCKTSRRERLTDGSRADALQDQEYVLTYEDKDADWMLVGDLPWDLFTTICGKLRIMRGSDAAGMAPRSPEQIVGTRIRNVARHAES

SEQ ID NO: 1994 - DNA, 1297 bp, Zea mays; identical to SEQ ID NO: 1384
  misc_feature: Ceres Clone ID no. 354561
  misc_feature: Encodes the peptide sequence at SEQ ID NO. 1995

SEQ ID NO: 1995 - protein, 179 aa, Zea mays; identical to SEQ ID NO: 1385
  misc_feature: Ceres Clone ID no. 354561
  misc_feature (1)..(179): Bit score of 231.2 for HMM based on sequences of FIGURE 3.
  misc_feature (1)..(179): Pfam Name: AUX_IAA Pfam Description: AUX/IAA family
  misc_feature: Functional Homolog Of SEQ ID NO. 129

SEQ ID NO: 1996 - DNA, 1198 bp, Arabidopsis thaliana
  misc_feature: Ceres Clone ID no. 38286
  misc_feature: Encodes the peptide sequence at SEQ ID NO. 1997
cttcccctcttaccttttcagagagagaaacaatatttctaatctattacaagtaacatgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgattgatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcaattggacttgctccgagagcaatggagaagtactgcaagaacagatcttgaattaataaaaaaaaaaagaagcatcaatgatcaacaatatgacgggttcttgattttttatgtatttttatgattgtatgtggctatcacctatatatgtgtgttgtaattttaaatacttgatgggtatatagggcagtattttaccagtaagatgtggacaaacttgtaatgtgaccaaaagagaggaaacttcaatatctctgtgtttgtgtcatatttattgcccaacatgtgtctgtcggtttgatgatcaatcacaacttgatatgtgcatacatataaatgtgtgtatgtaggtgtgtgtacatgtacatgtgttttgatccctactctgctacttgtcgtttcttgtgtgtgttatctaatagttttttcccaaaatgaataattcgttgttatgtttact

SEQ ID NO: 1997 - protein, 243 aa, Arabidopsis thaliana
  misc_feature: Ceres Clone ID no. 38286
  misc_feature (1)..(243): Bit score of 291.1 for HMM based on sequences of FIGURE 3.
  misc_feature (6)..(234): Pfam Name: AUX_IAA Pfam Description: AUX/IAA family
  misc_feature: Functional Homolog Of SEQ ID NO. 129
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAIGLAPRAMEKYCKNRS

SEQ ID NO: 1998 - DNA, 1277 bp, Glycine max
  misc_feature: Ceres Clone ID no. 467528
  misc_feature: Encodes the peptide sequence at SEQ ID NO. 1999
aattcttccactaccccttttcgttattcttcttcaattctcccaaaaatcatatttttacactctgagtggtttttcagcttgtgggtcgatgtcaactgtgtcaaaagatgacaacttggcgctttcttcggaggactcttcatgcccagaagagtctgagcttgaattgggtcttgggttgagcctctcctctggctcttcatcaaaatctcatcaccaccatcatgctagaatttacactgctaaggattttccttcttctgcagcagcagcagcagcagcagcatcatcaccttcctcttcttcttcctctcccaacaacatcactgctggcaccaagagagctgctgccgattctcttgttgccaataaccgtcccagtcaagtagttggatggcctccacttcgaacatatagagtgaatagcttcaatagccatgcaaaatcaactgaagtattcaactctgtggctgagaaaagtaagaccgataatactgtggccaggaagactaatgacaatggcaatgataataacataaatgccaaagagaaaagacacctcaggagttccctgtttgtcaaggtaaatatggatgggataccaattggaaggaaggttgatttgagtgctcatagttcctatgaaaccttagcgcaaacattagaggatatgtttaatgaatcaactacagtcaccacttgcaaaggatcaaatggtgaggattatggctttattatcggaggagaaaggcattcaaaattattagatggatcttccaagtttgtgctcacttatgaagacaaggaaggagattggatgcttgttggggatgttccctgggggatgttctttagctcagtgaggaggctaagaatcatgaggacatctgaggctaatggacttgcaccgagattggaagaaaacataaaaaagagatgcaagcccatatagattccgttttcatggctaaggacatgaaaaacctgtcaaatagatgaagaggaaaaaccgaaacagaaaagtataggaatactgcaaatgtatgaagttttgagatttgaatgataaaatctcacacttttgcttaattaattcagtttgtttgtttaatttggtatctttgttgcggcctctctattcatctcacttggagggtgcaggcatcatagattttcatgcaatacaactaatcatacaagtcagactgcttgttagtgttgtaaatgtggaatgtttgctaactatttcagctataaagttttgtttgaacttc

SEQ ID NO: 1999 - protein, 287 aa, Glycine max
  misc_feature: Ceres Clone ID no. 467528
  misc_feature (1)..(287): Bit score of 180.9 for HMM based on sequences of FIGURE 3.
  misc_feature (21)..(276): Pfam Name: AUX_IAA Pfam Description: AUX/IAA family
  misc_feature: Functional Homolog Of SEQ ID NO. 129
MSTVSKDDNLALSSEDSSCPEESELELGLGLSLSSGSSSKSHHHHHARIYTAKDFPSSAAAAAAAASSPSSSSSSPNNITAGTKRAAADSLVANNRPSQVVGWPPLRTYRVNSFNSHAKSTEVFNSVAEKSKTDNTVARKTNDNGNDNNINAKEKRHLRSSLFVKVNMDGIPIGRKVDLSAHSSYETLAQTLEDMFNESTTVTTCKGSNGEDYGFIIGGERHSKLLDGSSKFVLTYEDKEGDWMLVGDVPWGMFFSSVRRLRIMRTSEANGLAPRLEENIKKRCKPI

SEQ ID NO: 2000 - DNA, 1296 bp, Glycine max
  misc_feature: Ceres Clone ID no. 471139
  misc_feature: Encodes the peptide sequence at SEQ ID NO. 2001
acatatatttggtgagtgatatttcagcaaggaggaatcttcctttggagcgtggtgtgaacagaagatggatgaaaggtcaagaaacgaggcatctcctcagctgttagatttgatctcaaacgagagagagtggcagatgaacaagagaaacgaaggaaaatcctcagaagaaagaaagcttgaactgaggcttggtccacctggtgaagactggtctctgggcggtaaaatgaagaacacagaaagagaagaatctcttctctctcttggttgcttctctcctaacaatgggttccagagcaaggcttctccatggccaaactaccaccaccaccaccagggtaacaacaacaaagcctcttcttcatcatttcttcagtgccctaaggttgtggtagagttgcagaatggtggtgatggcaaagtattctctccctcttctgcaaatacagctgtgtcccagcccaacacctctcagaaaagaactgctcctgctccagtggtggggtggcccccaattcgttccttcaggaagaaccttgcaagcagcagcagtgcttctaagccacctcctgagtctcaggctgagcagcacaacaaggttgctggtaaaaaacctgttgacaactatgctaataataaaggtttgtttgtcaagatcaacatggatggtgttcctatagggagaaaagtggacctcaatgcctatgacagctatgaaaatctctcttccgccgtggacgagctattcagaggtcttcttgctgctcaaagagattcctctgctggtggagttcacaacaagcaggaggaagagaaagcaattacggggttattggatggaagtggagagtatactcttgtttatgaggataatgaaggagacaggatgcttgttggggatgtgccatggcacatgtttgtatcaacagtgaagaggctacgagtgttgaagagttctgagctttctgcttttacccttgggagtaagcaagacaagataccccttgactcagcaatgaaatgaacagcggtttgaggttttgatcacctgctgaaaacttgaagactcttcctaatttgacgttttggttctattgtctgatgaaaagaacatggaatgaagctagttgcgtacattacaactaagtaatgtgatgaatgtgtctttttttttttttctaaatgaagatttgaaatgtttatgggttttgtataaatagggaagggaaacttcacggatgtgtgtacttatgatttactgttgagtagccattaacttgttttggtttg

SEQ ID NO: 2001 - protein, 320 aa, Glycine max
  misc_feature: Ceres Clone ID no. 471139
  misc_feature (1)..(320): Bit score of 129.9 for HMM based on sequences of FIGURE 3.
  misc_feature (40)..(308): Pfam Name: AUX_IAA Pfam Description: AUX/IAA family
  misc_feature: Functional Homolog Of SEQ ID NO. 129
MDERSRNEASPQLLDLISNEREWQMNKRNEGKSSEERKLELRLGPPGEDWSLGGKMKNTEREESLLSLGCFSPNNGFQSKASPWPNYHHHHQGNNNKASSSSFLQCPKVVVELQNGGDGKVFSPSSANTAVSQPNTSQKRTAPAPVVGWPPIRSFRKNLASSSSASKPPPESQAEQHNKVAGKKPVDNYANNKGLFVKINMDGVPIGRKVDLNAYDSYENLSSAVDELFRGLLAAQRDSSAGGVHNKQEEEKAITGLLDGSGEYTLVYEDNEGDRMLVGDVPWHMFVSTVKRLRVLKSSELSAFTLGSKQDKIPLDSAMK

SEQ ID NO: 2002 - DNA, 935 bp, Glycine max
  misc_feature: Ceres Clone ID no. 471171
  misc_feature: Encodes the peptide sequence at SEQ ID NO. 2003
  misc_feature (293)..(293): n is a, c, t, g, unknown, or other
gaacaattcaattcattcatccttcactactacaccaaattaatagaaattaaagatatatcattccacaacacaaattaaagttagtgagacgtacccttattatggccaaagaaggtcttggacttgaaatcactgagctaaggttgggtctacctgatgcggagcatcaagtaagtgtagtcaataagaaaaatgagaagaagagggcattctcggaaattgatgatggtgttggagatgaaaatagctcctccggcggaggcgaccggaaaatggagacgaataagagntcaaggtggtggggtggcctccggtgtgctcttaccggaagaagaacagcatgaacgaaggtgcttcaaagatgtacgtgaaggttagcatggacggtgctcctttcttgcgtaaaattgatttgggtctgcataagggctactcagatttagctttggctttggacaagctctttggttgctatggaatggtggaggcgttgaaaaatgcagacaattytgaacacgttcccatttatgaggacaaagatggtgattggatgcttgttggagatgtcccttgggaaatgtttatggagtcatgcaagaggctgaggattatgaagaaatcagatgcgaagggcttcggtttgcaaccaaaaggatctttaaagggattcatagaaagcgcggcaaagtgaaagattatgttaggcttytaattaatgtcgtgcacattttgcgatcatcaatccaagtttatgtgttatcgttttcttatatttgaggaaaaacatgcatttttagtttgatatatgaattatcagacttttgtttatgtcaagttattaatgaatgacatataggaccctatataaataatagggaaaactcgtcgttttagattaattaatgctttgccataaatgtttgtttatttgc

SEQ ID NO: 2003 - protein, 116 aa, Glycine max
  misc_feature: Ceres Clone ID no. 471171
  misc_feature (1)..(116): Bit score of 147.4 for HMM based on sequences of FIGURE 3.
  misc_feature (1)..(102): Pfam Name: AUX_IAA Pfam Description: AUX/IAA family
  misc_feature: Functional Homolog Of SEQ ID NO. 129
  misc_feature (57)..(57): Xaa is any aa, unknown, or other
MNEGASKMYVKVSMDGAPFLRKIDLGLHKGYSDLALALDKLFGCYGMVEALKNADNXEHVPIYEDKDGDWMLVGDVPWEMFMESCKRLRIMKKSDAKGFGLQPKGSLKGFIESAAK

SEQ ID NO: 2004 - DNA, 1447 bp, Glycine max
  misc_feature: Ceres Clone ID no. 472859
  misc_feature: Encodes the peptide sequence at SEQ ID NO. 2005
tcttcatctcaaagtttcactctcactcttcttcttcttcttcttcatcctttctgatctgtgctgttttttcagggtacaacaaaattgggtgctttcggttaaactgtgatgtctccgccagtgctgagcataggggaggaggagggtaaaagcaatgtcactttgttggtttcctcatcaaccaccatggaaagtgtgtgtctcaagagcttagaatttaaagagcgcaactacatgggattatctgattgttcttctgtggacagctcggttccgtccttctctgaagagactaaaagtaatctgaacctgaaagccactgaactcaggctcgggcttccaggatcacagtctcctgatagagattctgatctttgcttaagaagctcaactcaatttgatgaaaaaactttgtttccgttgcgtcctttgactgatgatcaccattcttcagccaagactgctgttttgggaaacaaaagagggttctctgatgccatgaacggcttctcctcagaggggaaattcctagttgattcggaggccgccaatccgatactgtctcccaggcctgcttctaacttgggattaaaacctggttctacacttgagaaggttggagttcagcaaaccaaaatgaaagaagtagcaacaacaaaggccaatgaagctagacccactattgatggttctgcaaataataataacagtgcaccagctaccaaggctcaggttgtgggatggcctcctataagatcattccggaaaaattcattggctaccacttcaaagaacaatgaagaagttgatggaaaagtgggggttggtgcactgtttgtcaaggtcagtatggatggtgctccctatttaaggaaagtagacttgaagaattactctacatatccagaattatcttctgctctagaaaagatgttcagctgttttactatgagtaaatgtggatctcatggaattctgggcagggagatgctgaatgaaaccaagctgaaggaccttcttcatggatcagaatatgttcttacatatgaggacagagagggcgattggatgcttgtgggtgatgttccctgggagatgtttattgaaacatgcaagaggctgaggatcatgaagagttctgatgccattggtctagctcccagggctgttgaaaaatgtaagagcagaacctaggcagtaccagtgttcctcttcgaacatggtgtattggaagcgagaactgaaggcatatgggactggatagaatctcatactaagctgccataatccttctattgtttattatgtgtccgttttatgttgtcatggcgtttatgatttagtaagcttcttttcaagattgttgtgataaaacttaacaaaactctaagacttgactgtgggagtagctatattttatgtacccgagttaatgttatggttg

SEQ ID NO: 2005 - protein, 361 aa, Glycine max
  misc_feature: Ceres Clone ID no. 472859
  misc_feature (1)..(361): Bit score of 294.3 for HMM based on sequences of FIGURE 3.
  misc_feature (66)..(353): Pfam Name: AUX_IAA Pfam Description: AUX/IAA family
  misc_feature: Functional Homolog Of SEQ ID NO. 129
MSPPVLSIGEEEGKSNVTLLVSSSTTMESVCLKSLEFKERNYMGLSDCSSVDSSVPSFSEETKSNLNLKATELRLGLPGSQSPDRDSDLCLRSSTQFDEKTLFPLRPLTDDHHSSAKTAVLGNKRGFSDAMNGFSSEGKFLVDSEAANPILSPRPASNLGLKPGSTLEKVGVQQTKMKEVATTKANEARPTIDGSANNNNSAPATKAQVVGWPPIRSFRKNSLATTSKNNEEVDGKVGVGALFVKVSMDGAPYLRKVDLKNYSTYPELSSALEKMFSCFTMSKCGSHGILGREMLNETKLKDLLHGSEYVLTYEDREGDWMLVGDVPWEMFIETCKRLRIMKSSDAIGLAPRAVEKCKSRT

SEQ ID NO: 2006 - DNA, 791 bp, Glycine max; identical to SEQ ID NO: 1382
  misc_feature: Ceres Clone ID no. 474845
  misc_feature: Encodes the peptide sequence at SEQ ID NO. 2007

SEQ ID NO: 2007 - protein, 188 aa, Glycine max; identical to SEQ ID NO: 1383
  misc_feature: Ceres Clone ID no. 474845
  misc_feature (1)..(188): Bit score of 232.1 for HMM based on sequences of FIGURE 3.
  misc_feature (10)..(179): Pfam Name: AUX_IAA Pfam Description: AUX/IAA family
  misc_feature: Functional Homolog Of SEQ ID NO. 129

SEQ ID NO: 2008 - DNA, 1092 bp, Glycine max
  misc_feature: Ceres Clone ID no. 482388
  misc_feature: Encodes the peptide sequence at SEQ ID NO. 2009
tctttctccttctccccaattctcaaaccttacctagtattttcgtttctgaacccaattaattaagcacacaaggaccataacatacctatacctcaatatcacaagtcttatggaggcagagcgagacaagtacaagatgatcaactttgaagaaaccgagttacgactcggcctgccactcagtggaaacgagacgctcaaaaacacttgcagcactgggaagagggttttttcggatactgccgtggatttgaagcttaacctttcctcaacctcaaacagtgcttcttctgacctggctaaagagaagaacatcactgctgctgcacctcctgctaacgacccagcaaagccacctgcaaaggcacaagtggtggggtggccaccagtgaggtctttcagaaagaacattgttcaaaggagtaacaacaatgagggcgaaaaagccgccacaagtagtagcaacaatgtgaacacgggagcagctttcgtgaaggtgagcatggatggtgctccttatttacgcaaggtggatttgaagttgtacaagagctaccaagagttgttggatgcgctggctaaaatgttcagttcattcaccattgacaagtgtggatcccaaggcatgaaagacttcatgaacgagagcaaattgattgatcttctcaacggctctgattacgtaccaacctatgaagacaaagatgctgactggatgctcgttggtgacgtaccgtgggaaatgttcgtggaatcatgcaagcgcctgcgtataatgaaaggatctgaggcaatcgggctagcaccaagagcagtggaaaagtgcaagaacagaagctagagtcaaatttgtaaattccactttcgacaacaatctgctctatctgttgctcttgggcgtccacggaaagcattaatgctaatttytcgagcaaggggtagtctaatataggagccaagttgttacataatgtgtcggtaccatttcttagaaataattttcttgtatatgtattgtgtattttatatatgtgagaaaatatataatttggaaattagggacaagaaataatgaagtatgttttatat

SEQ ID NO: 2009 - protein, 243 aa, Glycine max
  misc_feature: Ceres Clone ID no. 482388
  misc_feature (1)..(243): Bit score of 306.5 for HMM based on sequences of FIGURE 3.
  misc_feature (11)..(235): Pfam Name: AUX_IAA Pfam Description: AUX/IAA family
  misc_feature: Functional Homolog Of SEQ ID NO. 129
MEAERDKYKMINFEETELRLGLPLSGNETLKNTCSTGKRVFSDTAVDLKLNLSSTSNSASSDLAKEKNITAAAPPANDPAKPPAKAQVVGWPPVRSFRKNIVQRSNNNEGEKAATSSSNNVNTGAAFVKVSMDGAPYLRKVDLKLYKSYQELLDALAKMFSSFTIDKCGSQGMKDFMNESKLIDLLNGSDYVPTYEDKDADWMLVGDVPWEMFVESCKRLRIMKGSEAIGLAPRAVEKCKNRS

SEQ ID NO: 2010 - DNA, 985 bp, Zea mays
  misc_feature: Ceres Clone ID no. 499878
  misc_feature: Encodes the peptide sequence at SEQ ID NO. 2011
acggcctctctgccttttccttttccttcccccgctttctccttccttcctcccccctccccgctcccctcgcccagccaccggccatgtcggtggagacggagcgcagctccaccgagtcctccggggcctccgggctcgacttcgaggacaccgcgctcacgctcaccctccgcctcccgggctccgcgccttccgccgccgcggcctccctgtccctctcctcctcgtcgtcctccgccttccccgaccccgaccgcaagcgcgcctcctccgacgccgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctccaggcgtacgccggctacgaccagctgctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgttcgtggaaacctgccagcgccttcgtctgatgaaaggttcagaggccgtgaacttggcaccgagagccgcccgatgaggcacactccgttgggcgttggcacgcactggcgtcttgaaggaaagcgggaactctgctggtcttgatgaggatcttcacgtgagataggaacgtgtgtacagttgtcgccttatggtattgagttgaggaaacttggaggttccattacttgtctgtagtctctactttatatagatgcgaagaagcttgagatacacattgcctacaatgtcttttgatgaataagaccagacagcaccgat

SEQ ID NO: 2011 - protein, 217 aa, Zea mays; identical to SEQ ID NO: 1355
  misc_feature: Ceres Clone ID no. 499878
  misc_feature (1)..(217): Bit score of 265.1 for HMM based on sequences of FIGURE 3.
  misc_feature (18)..(215): Pfam Name: AUX_IAA Pfam Description: AUX/IAA family
  misc_feature: Functional Homolog Of SEQ ID NO. 129

SEQ ID NO: 2012 - DNA, 1616 bp, Glycine max; identical to SEQ ID NO: 218
  misc_feature: Ceres Clone ID no. 511737
  misc_feature: Encodes the peptide sequence at SEQ ID NO. 2013

SEQ ID NO: 2013 - protein, 354 aa, Glycine max
  misc_feature: Ceres Clone ID no. 511737
  misc_feature (1)..(354): Bit score of 298.8 for HMM based on sequences of FIGURE 3.
  misc_feature (66)..(346): Pfam Name: AUX_IAA Pfam Description: AUX/IAA family
  misc_feature: Functional Homolog Of SEQ ID NO. 129
MSPPTLVTEEEGRSTVASDSSQSLDCFSQNGAGLKERNYLGLSDCSSVDSCASTVPSLCDEKKENMNLKATELRLGLPGFQSPEREPDLFSLSSPKLDEKPLFPLLPTKDGICSSGQKAVVSGNKRGFADTMDGFSQGKFAGNTGMNAVLSPRPSGAQPSAMKETPSKLSERPCSTNNGTGHNHTGASISGSAPASKAQVVGWPPIRSFRKNSMATTTNKNNDEVDGKPGVGALFVKVSMDGAPYLRKVDLRSYTTYQELSSALEKMFLSCFTLGQCGSHGAPGREMLSESKLRDLLHGSEYVLTYEDKDGDWMLVGDVPWEMFIETCKRLKIMKGSDAIGLAPRAMEKSKSRI

SEQ ID NO: 2014 - DNA, 1507 bp, Glycine max
  misc_feature: Ceres Clone ID no. 512627
  misc_feature: Encodes the peptide sequence at SEQ ID NO. 2015
gtgcttaatggaaggcccttgagcttttctttctttctctgctctcttttcttttaggtttccactctcacacactctccctcttctctttctctgcaataatctctcttctcttcttcactctctcaactcctgccaaacccccatttccgcagttcttaaatttggagtctgatgtctccgccattgctggttaccgaagatgaagggcagtgccatgcctcgatggtagcatctgcatcttcaccatccctgaactgtttctccctaaatgaggccggatttaaagaatgcaattacctgggattgtcagattgctcttcggtggacagttctactgtcccgaatttgtctgatgagaaaaaggagaatctgaatttgaaggctactgagttgaggcttggccttccgggatcccagtcacctgaaagggagacagaacttttctcgttgagctcaacaaaacttgatgagaaaccactgttccctttgcttcctacaaaggatggaatctgctcattgtctcaaaaaactgtggtctcgggcaacaaaagaggttttgctgacacaatggaccctgagtttcctggcaatgcagggataaacatgatgctatcacctaaaccttctggagttcagcctaccacagtgaaagaaataccaagcaaggtgttacaagaacttccttcagcggcaaatggaactggtcataaccatacatcaggagcttctatcagtggcagtgcaccggctgctaaggcacaggttgttggttggcctcctataagatcatttaggaaaaactcattggccaccacttcaaagaataatgatgaagtagatggaaaaccgggtgcagcagcactctttgtgaaggtcagcatggatggtgctccctatctgaggaaggtagatctaagaaattatacaatgtaccaggaactgtcttctgcccttgagaaaatgttcagctgtttcactctaggtcaatgtggttcccatggagctccaggaagagaaatgttgagtgagagcaagctgaaggacctcctgcatggttcagaatatgtactcacttatgaagataaagatggtgactggatgcttgtcggagatgtaccatgggatatgttcattgacacatgcaaaagactgaaaatcatgaagggttctgatgccattggcttagctcccagggccatggaaaaatccaggagcaggtgctagttggtattggaacatgaagagtgtggaaagagaacttatgatataaatgactgaatgccgggttttgatggttaactgctattcaagatgttgtctatggttacaagtatcataatagtgtcttggtcttttgtttgtgttacatttgtttctactataataccttatgaagctaccttgaatattagtaattgtggagcttgtaatctttataggaacatgtttgtttggataagttgaatgtatgttgcaatcagtgtattgttttcaatgttttgcc

SEQ ID NO: 2015 - protein, 350 aa, Glycine max
  misc_feature: Ceres Clone ID no. 512627
  misc_feature (1)..(350): Bit score of 296.8 for HMM based on sequences of FIGURE 3.
  misc_feature (67)..(342): Pfam Name: AUX_IAA Pfam Description: AUX/IAA family
  misc_feature: Functional Homolog Of SEQ ID NO. 129
MSPPLLVTEDEGQCHASMVASASSPSLNCFSLNEAGFKECNYLGLSDCSSVDSSTVPNLSDEKKENLNLKATELRLGLPGSQSPERETELFSLSSTKLDEKPLFPLLPTKDGICSLSQKTVVSGNKRGFADTMDPEFPGNAGINMMLSPKPSGVQPTTVKEIPSKVLQELPSAANGTGHNHTSGASISGSAPAAKAQVVGWPPIRSFRKNSLATTSKNNDEVDGKPGAAALFVKVSMDGAPYLRKVDLRNYTMYQELSSALEKMFSCFTLGQCGSHGAPGREMLSESKLKDLLHGSEYVLTYEDKDGDWMLVGDVPWDMFIDTCKRLKIMKGSDAIGLAPRAMEKSRSRC

SEQ ID NO: 2016 - DNA, 1098 bp, Glycine max
  misc_feature: Ceres Clone ID no. 520455
  misc_feature: Encodes the peptide sequence at SEQ ID NO. 2017
agagagagaaagagtcataataaagtgaaagaaaaagaaaaaggagagtagtgaaacaagaagaaaggagaagaagatggtgtttgaggaaaytgagctgaggcttggactgagactaggactccctggaaatggagccgcgccaacaactgaagctgctgcggaattaggagtgaggaagagagggttctctgaaactgaaaccgatgaaacaacctccgttgatttgatgcttaacctctctcccaaggaagcttctgctgctgctactactgatggagcagatccacgtgagaatccaaagacttcgccgaaggacaagaatcttcctcttctcgatcccgcaaagcctcctgccaaggcgcaagtggtgggatggccacctgtaaggtctttccggaagaacatgtttgcagcccaaaagagcagcggcggagaggaaagcgagaagaacagccctaatgcaagctttgtcaaagttagcatggatggagcaccttacctccgcaaagttgacttgaagatgtacaagagttaccctgagctctctgatgccttgggcaaaatgtttagctccttcaccattggaaattgtgaatcccaaggcttcaaggatttcatgaatgagagcaagttgatggatcttctgaacagctccgactatgtcccgacctatgaagacagggatggcgactggatgcttgtcggtgatgtgccatgggagatgtttgttgaatcatgcaagcgtttacgtatcatgaaaggaaaggaagctattggactggcaccaagagccgtggagaaatgcaagaacaggagctagactagtrgkratttycagtccaaaaccysctccatcatcgttagtggtgcccagtagatcgacttagcaactgaagaagcaaggttaagctgcagcagacacagatcgacagagcagggtgttaaaaatatagttaattaaatctgtgtatcattaattatggtttgttatgtaatatatatttcaaacaaagttgtgagatgtcttaagtataaattatgaacagaaacgatataataactctaaattatgttgcaagactttcttatttattt

SEQ ID NO: 2017 - protein, 248 aa, Glycine max; identical to SEQ ID NO: 1351
  misc_feature: Ceres Clone ID no. 520455
  misc_feature (1)..(248): Bit score of 261.3 for HMM based on sequences of FIGURE 3.
  misc_feature (1)..(240): Pfam Name: AUX_IAA Pfam Description: AUX/IAA family
  misc_feature: Functional Homolog Of SEQ ID NO. 129
  misc_feature (6)..(6): Xaa is any aa, unknown, or other

SEQ ID NO: 2018 - DNA, 1125 bp, Glycine max; identical to SEQ ID NO: 1386
  misc_feature: Ceres Clone ID no. 540858
  misc_feature: Encodes the peptide sequence at SEQ ID NO. 2019

SEQ ID NO: 2019 - protein, 183 aa, Glycine max; identical to SEQ ID NO: 1387
  misc_feature: Ceres Clone ID no. 540858
  misc_feature (1)..(183): Bit score of 231.6 for HMM based on sequences of FIGURE 3.
  misc_feature (10)..(174): Pfam Name: AUX_IAA Pfam Description: AUX/IAA family
  misc_feature: Functional Homolog Of SEQ ID NO. 129

SEQ ID NO: 2020 - DNA, 1091 bp, Glycine max
  misc_feature: Ceres Clone ID no. 556734
  misc_feature: Encodes the peptide sequence at SEQ ID NO. 2021
gtattaatgccaacctcacccaaacttaagggctccccacaacgtaataacgtgcctgcccctatacctcaccccacttactattattattgtacaacacaaccaggtccctgaatgctttttagagagagaaagagtaataataataaagtggaagaaaaagaattaggagagtgaaacaagaagaagaagaagaagaagaagaagaagaattgagaagatggtgtttgaggaaactgagctgaggctgggactgggactatgtctccctggaaatggaaccacggcaacaactgaagctgctgctgcggaattaggagtgaggaagagagggttctctgagactgaaactgatgaaacagccaccgttgatttgatgcttaacctctcacccaaggaagctgctgctgctgatggtgcagatccacgtgagaagccaaagacttcgccgaaggagaagacccttctgcttcccgatcccgccaagcctcctgccaaggcgcaagtggtgggatggccacccgtgaggtctttccggaagaacatgttcgcagcccaaaagagcagcggcggagaggaaagcgaaaagagcagccctaatgcaagctttgtcaaagttagcatggatggagcaccttacctccgcaaagttgacttgaagatgtacaagagttacccagagctctctgatgccttgggcaaaatgtttagctccttcaccattggaaattgtgaatcccaaggcttcaaggatttcatgaatgagagcaagttgatggatcttttgaacagctccgactatgtcccgacctatgaagacagggatggcgactggatgcttgtcggtgatgtgccatgggagatgtttgttgaatcatgcaagcgtttacgtatcatgaaaggaaaggaagctattggactggcaccaagagccgtggagaaatgcaagaacaggagctagactagtagttaccagtccaaaatctgctccatcatcattagcggtgcctagttgacttagtaactgaagcaaggttaagctgcagcagacacagagggagagagcagggtgttaaaaaatatagttaagt

SEQ ID NO: 2021 - protein, 246 aa, Glycine max
  misc_feature: Ceres Clone ID no. 556734
  misc_feature (1)..(246): Bit score of 264.1 for HMM based on sequences of FIGURE 3.
  misc_feature (1)..(238): Pfam Name: AUX_IAA Pfam Description: AUX/IAA family
  misc_feature: Functional Homolog Of SEQ ID NO. 129
MVFEETELRLGLGLCLPGNGTTATTEAAAAELGVRKRGFSETETDETATVDLMLNLSPKEAAAADGADPREKPKTSPKEKTLLLPDPAKPPAKAQVVGWPPVRSFRKNMFAAQKSSGGEESEKSSPNASFVKVSMDGAPYLRKVDLKMYKSYPELSDALGKMFSSFTIGNCESQGFKDFMNESKLMDLLNSSDYVPTYEDRDGDWMLVGDVPWEMFVESCKRLRIMKGKEAIGLAPRAVEKCKNRS

SEQ ID NO: 2022 - DNA, 1148 bp, Triticum aestivum
  misc_feature: Ceres Clone ID no. 570147
  misc_feature: Encodes the peptide sequence at SEQ ID NO. 2023
acaaagctggaccagaccagaccagaggcaggcagcattcgcagcagcagaagaagacgacgcagccgccaccgccaccgccaccaccgccgacgcgcgcagagctcgacactcgagagaggctgacgagggcgacgacgccggtggccatgtcggcggagacggagcggagctccacggagtcgtccgcggcgtccgggctcgacttcgaggacaccgcgctcacgctcaccctgcgcctccccggcgaccccgaccgcaagcgcggcgcctcctcctcctcctcctgctccctcgccgaccgctcctccctcctcgccgaggctccgccggcccccaaggagcgggtggttggctggccgccggtgaggtcgttccgcaagaacgcgctcgagaacgtcgccgccgggtccaccagggcggccgccgcgccggccaagttcgtcaaggtggccgtcgatggcgcgccctacctgcgcaaggtgaacctgcgggactacgccggctacgaccagctcctccgcgcgctccagggcaagttctgctcccacttcaccatcaggaagttcgccaacgacgagatgaagctggtggacgcggtgaacgggacggagtacgtgcccacctacgaggacaaggacggcgactggatgctcgtcggcgacgtcccctggaagatgtttgaggaagcctgccaacgcgtccgcctgatgaagaactccgaggccgtgaacgtagcacccagagctgcccggtgaggcacgccgcgtggcccttacgaacggtgctgccggaaaggaggaggaggctttgctctgccgaggagataggaatgtgtacagctatcggttaccactttgggtttacttgatgctcttgggtcgtgaaaagttgctggtttcattactcgtctgtagcagcaccactatagtctctactactacatatagaagatggtgatggtcaaagtactgggagcttgaaatatacgcctttacatatagtttgtttgtttgtctcttgatgaataagaccaagcttgcagaaactcggcgttctctgctgtttgcgcgcacccgtcgcgaggtcgcctgtgatgccgcaggcaacgcctttggctttgccttggtagagtttatttttgtgtc

SEQ ID NO: 2023 - protein, 202 aa, Triticum aestivum
  misc_feature: Ceres Clone ID no. 570147
  misc_feature (1)..(202): Bit score of 209.1 for HMM based on sequences of FIGURE 3.
  misc_feature (18)..(200): Pfam Name: AUX_IAA Pfam Description: AUX/IAA family
  misc_feature: Functional Homolog Of SEQ ID NO. 129
MSAETERSSTESSAASGLDFEDTALTLTLRLPGDPDRKRGASSSSSCSLADRSSLLAEAPPAPKERVVGWPPVRSFRKNALENVAAGSTRAAAAPAKFVKVAVDGAPYLRKVNLRDYAGYDQLLRALQGKFCSHFTIRKFANDEMKLVDAVNGTEYVPTYEDKDGDWMLVGDVPWKMFEEACQRVRLMKNSEAVNVAPRAAR

SEQ ID NO: 2024 - DNA, 653 bp, Zea mays
  misc_feature: Ceres Clone ID no. 571094
  misc_feature: Encodes the peptide sequence at SEQ ID NO. 2025
acctcttcaatcccagtcccacacaaagtttctcctcgatcctcatctccctctctcgagtcaagagcagagcagctaccaaacaagctctcctttcgcttccgatccatggagctcgatgccgacaacctgagcgccaccgagctccgcctcggcctgcctgggaccagcagcagcagcagagacgactggcagaagaagccgtcgccctccgtcggggccaagcgcgttctggacgacggcaccaagagcgaggcctcggggaccagcacggccgccggagacctcgacttcgaccacgacaccgccgcgcctcccaaggcgcaagtggtcgggtggccgccggtgagggcgtacaggaagaacaccttccaggcggcggcggccaaaaaggtcgagcagaagcagcagcagggaggcctgtacgtgaaggtgagcatggacggcgcgccgtacctcaggaaggtggacctccggatgtacaaggggtacagggagctcagggaggctctggacgcgctcttcaccaactccttctccgcggcggcggcaragggcggcggcgaccaccagcacgccatcgcctacgaggacaaggacggsgacctcatgctcgccggaracgtgccctgggatatgttcatctyttcgtg

SEQ ID NO: 2025 - protein, 181 aa, Zea mays
  misc_feature: Ceres Clone ID no. 571094
  misc_feature (1)..(181): Bit score of 203.1 for HMM based on sequences of FIGURE 3.
  misc_feature (7)..(181): Pfam Name: AUX_IAA Pfam Description: AUX/IAA family
  misc_feature: Functional Homolog Of SEQ ID NO. 129
  misc_feature (149)..(149): Xaa is any aa, unknown, or other
  misc_feature (165)..(165): Xaa is any aa, unknown, or other
  misc_feature (172)..(172): Xaa is any aa, unknown, or other
  misc_feature (180)..(180): Xaa is any aa, unknown, or other
MELDADNLSATELRLGLPGTSSSSRDDWQKKPSPSVGAKRVLDDGTKSEASGTSTAAGDLDFDHDTAAPPKAQVVGWPPVRAYRKNTFQAAAAKKVEQKQQQGGLYVKVSMDGAPYLRKVDLRMYKGYRELREALDALFTNSFSAAAAXGGGDHQHAIAYEDKDXDLMLAGXVPWDMFIXS

SEQ ID NO: 2026 - DNA, 1265 bp, Glycine max
  misc_feature: Ceres Clone ID no. 574451
  misc_feature: Encodes the peptide sequence at SEQ ID NO. 2027
gtattatacgtccccttgtcctgcccctgcccctataccatagaacattagtacccccacacacacccctcctctatctttcactattattgccacacaaatcaattaactgaatgcttagagagagaaagaggagaaggagtagtgataaggtgatcatagagcatattataagagagtgaaaactaatggaggttggcctcaagaaggagaacatggggtttgaggaaactgagttaaggcttggactgcctggaaacggaggcactgaagaagtgctcatcaggaagaggggtttctctgagactgaaactggtcatgaagatgagtctgccaccactgtggatttgatgcttaatctttcttctaaggaggccgcaaccactgctgctgctgctgcagatccaactgataagcacaagactttgcctaaggagaagacccttctgccagcagatcctgctaagcctccagccaagacgcaggtggtgggttggccacctgtgcggtccttccggaagaacatgttggctgtgcaaaagagcgttggagaagagagcgagaagaacagcagccctaatgcaagctttgtcaaagttagcatggatggagcaccttaccttcgcaaagtggacttgaagatgtacaagagttaccgagagctctctgattctttaggcaaaatgttcagctccttcacctttggcaattgtgaatcccaaggaatgaaggatttcatgaatgagagcaagctgaatgatctcttgaacagctctgattatgtcccaacctatgaggacaaggatggtgactggatgcttgtcggtgatgtcccatgggagatgtttgttgaatcatgcaagcgtttacgcatcatgaaaggaaaggaggctattggtcttggtcttgcaccaagagccatggcaaaatgcaagaacaggagctagactagtcgcacaattcatgacctgccccatcctttgtaattgtggtgcccagttggcttagtaactaaagtaaggataagctgcagcagacacggatggacattgcagggtgttgaattatagttaatttgtgtatcattatggtttgttataatatttcaaacaaaacaatgagatgcatgtctaattaagtactaattatgaacaggaacataatgactctcaatcatgttgttagacttggctttcttatatatctttgcttgttctgtgtgagtgcttgcttaataataattttaagatgtgtttgtctgttgt

SEQ ID NO: 2027 - protein, 252 aa, Glycine max
  misc_feature: Ceres Clone ID no. 574451
  misc_feature (1)..(252): Bit score of 279.0 for HMM based on sequences of FIGURE 3.
  misc_feature (10)..(242): Pfam Name: AUX_IAA Pfam Description: AUX/IAA family
  misc_feature: Functional Homolog Of SEQ ID NO. 129
MEVGLKKENMGFEETELRLGLPGNGGTEEVLIRKRGFSETETGHEDESATTVDLMLNLSSKEAATTAAAAADPTDKHKTLPKEKTLLPADPAKPPAKTQVVGWPPVRSFRKNMLAVQKSVGEESEKNSSPNASFVKVSMDGAPYLRKVDLKMYKSYRELSDSLGKMFSSFTFGNCESQGMKDFMNESKLNDLLNSSDYVPTYEDKDGDWMLVGDVPWEMFVESCKRLRIMKGKEAIGLGLAPRAMAKCKNRS

SEQ ID NO: 2028 - DNA, 1274 bp, Triticum aestivum
  misc_feature: Ceres Clone ID no. 923460
  misc_feature: Encodes the peptide sequence at SEQ ID NO. 2029
accaccactcccattctgcttcttctttatcacgccccgccttcccttccctctccgaggccagcaaacaaaaagagctcctttcctcctcccccttcccttcctcctcctcctcctcctcgggccttcgcctccttccaatgccgccgcccaatctcgaagcgcgcgactacatcggcctcggccccgccgcgcccgcgccctccgcctcctcctgctcctcctccgcctcgggcgaggccggcccgcacctcgcgctccgcctcggccttcccggccgcgacgagccggaggccgccgtcgacgccgcgctcacgctgggacctgctcccgctactgctaacgtcccgcacaggggcggcgccaagcgcgggttcgcagactcgctcctcgaccgtactgcccctgctgccggggctggcggggaggaggacaagcagaagggtgaagccgccgccgccgccggagccggagctccaccagctgccaaggcacaagttgttgggtggccgcctgttcggagctaccggaagaacacgctatccgccaatgccacaaagaccaaggcggagaacgaaggcagaagcgaggcaggatgctgctatgtcaaggtcagcatggatggggccccatacctgaggaaggtcgatcttaagacctactccagctatgacaacctttccctggagctggagaagatgttcagctgcttcatcactggcaaaagcagttcctgcaaaacatcgacgagagacaggctcactgatggttctagggctgatgctcttcaggaccaagagtatgtacttacctatgaggacaaggatgctgactggatgcttgttggtgatcttccttgggacttgtttaccactacttgtcggaaactgagaatcatgagaggctctgatgctgctggaatggccccaagatagctggaaccgatcggccagaacaaacaagcgtctgtccgtcctggcctctcctcctcctgaagtcttgtgtctgaatcacgcaagtgtggaattttgagttaacgctgcaaggcgccgctgaagggtgcgatggttgtctcaactctctgaaagtgtctgcgctgctgctagtttatctatctacgtgtgtagtggaatatgtgcgtcctactgtaaaacaatccgtttttgacctcgccgttgtagatggtcccttttggttcatgatgaaagatcaccgcctgtatgatgatgctttcgcctacgctcttacatatatatttgaagtcgtattttatg

SEQ ID NO: 2029 - protein, 264 aa, Triticum aestivum
  misc_feature: Ceres Clone ID no. 923460
  misc_feature (1)..(264): Bit score of 261.4 for HMM based on sequences of FIGURE 3.
  misc_feature (40)..(263): Pfam Name: AUX_IAA Pfam Description: AUX/IAA family
  misc_feature: Functional Homolog Of SEQ ID NO. 129
MPPPNLEARDYIGLGPAAPAPSASSCSSSASGEAGPHLALRLGLPGRDEPEAAVDAALTLGPAPATANVPHRGGAKRGFADSLLDRTAPAAGAGGEEDKQKGEAAAAAGAGAPPAAKAQVVGWPPVRSYRKNTLSANATKTKAENEGRSEAGCCYVKVSMDGAPYLRKVDLKTYSSYDNLSLELEKMFSCFITGKSSSCKTSTRDRLTDGSRADALQDQEYVLTYEDKDADWMLVGDLPWDLFTTTCRKLRIMRGSDAAGMAPR

SEQ ID NO: 2030 - protein, 390 aa, Picea sitchensis
  misc_feature: Public GI ID no. 116787773
  misc_feature (1)..(390): Bit score of 265.0 for HMM based on sequences of FIGURE 3.
  misc_feature (180)..(382): Pfam Name: AUX_IAA Pfam Description: AUX/IAA family
  misc_feature: Functional Homolog Of SEQ ID NO. 129
MEIEQNLKETELRLGLPGALSPVREHTKCPSSNEESSSSTSSELCLLSPRRPATEKKLFPEDKLESVAASAAEKYPYWHSAPPAPLLQSGYQFPRDVKSGGGAKRGFAEAMESRKVFSGGKWVFPVVTPGSDAEASKAKFLQQQGQLSSPKSSVVQGSASMWQQPQGDQYLSTATGVNNLNGNAKSIVMNDGGCSSSIGKEAAGQSKVAAQERPSQHGSSQNQSSAAVEAPPASKAQVVGWPPIRSFRKNTLAANSKPADDSEGKPGSNALYVKVSMDGAPYLRKVDLKMYNRYQELSSALEKMFSGFTIGQYGSHGIPGRDGLSESKLMDLLHGSEYVLTYEDKDGDWMLVGDVPWEMFVDSCKRLRIMKGSDAIGLAPRAMEKCKSRS

SEQ ID NO: 2031 - protein, 303 aa, Populus balsamifera subsp. trichocarpa
  misc_feature: Public GI ID no. 118484337
  misc_feature (1)..(303): Bit score of 184.8 for HMM based on sequences of FIGURE 3.
  misc_feature (44)..(291): Pfam Name: AUX_IAA Pfam Description: AUX/IAA family
  misc_feature: Functional Homolog Of SEQ ID NO. 129
MMEGCLGLLGGGGSSGASTNKSTLSKVEVIEAEASSYPVEAELELGLGLSLGSGGRGKGKANAWGECGRILTAKDFPSVVSQPQRPNNNNSMPSTCVVGAVSGTKRAADSVSHEGGSPTAGSQVVGWPPIRAYRMNSLVSQAKAARAEEDKGIGEKDKSKENLKKKICNGNKTNATGNEKGHLGFVKVNMDGVPIGRKVDLNAHACYETLAQALEEMFFRSTTTINSIGGQKPLSKFSKLLDGSSEFVLTYEDKEGDWMLVGDVPWGMFLTSVKRLRIMRTSEANGLAPRLQDRNEKQRSKPV

SEQ ID NO: 2032 - protein, 250 aa, Populus balsamifera subsp. trichocarpa
  misc_feature: Public GI ID no. 118484744
  misc_feature (1)..(250): Bit score of 311.8 for HMM based on sequences of FIGURE 3.
  misc_feature (16)..(242): Pfam Name: AUX_IAA Pfam Description: AUX/IAA family
  misc_feature: Functional Homolog Of SEQ ID NO. 129
MTSIMGAETADTYSMINYEETELRLGLPGGASNGNDGEAAKGNGKRGFSETVDLKLNLSTKETGKDGSDQEKVVMKEKTVAPRPNDPAKPPSKAQVVGWPPIRSFRKNVMAVQKNSNDEGEKASSSGTTGTAAFVKVSMDGAPYLRKVDLKLYKSYRELSDALGKMFSSFTIGNCGSQGTKDFMNESKLIDLLNSSEYVPTYEDKDGDWMLVGDVPWGMFVDSCKRLRIMKGSEAIGLAPRAVEKCKNRS

SEQ ID NO: 2033 - protein, 95 aa, Populus balsamifera subsp. trichocarpa
  misc_feature: Public GI ID no. 118486521
  misc_feature (1)..(95): Bit score of 141.2 for HMM based on sequences of FIGURE 3.
  misc_feature (1)..(94): Pfam Name: AUX_IAA Pfam Description: AUX/IAA family
  misc_feature: Functional Homolog Of SEQ ID NO. 129
MYVKVSVDGAPYLRKIDLKVYKSYPELLKALENMFKLTIGEYSENEGYNGSEFAPTYEDKDGDWMLVGDVPWDMFISSCKRLRIMKGSEARGLGC

SEQ ID NO: 2034 - protein, 248 aa, Populus balsamifera subsp. trichocarpa
  misc_feature: Public GI ID no. 118487775
  misc_feature (1)..(248): Bit score of 297.4 for HMM based on sequences of FIGURE 3.
  misc_feature (13)..(240): Pfam Name: AUX_IAA Pfam Description: AUX/IAA family
  misc_feature: Functional Homolog Of SEQ ID NO. 129
MTTSVLGTERTDLNYKETELCLGLPGAVGAKNEVETPNKATGKRGFAETVDLKLNLQAKEGVMDLNENIKNITSKDKNHLPAVTIKDPAKPPAKAQVVGWPPVRSYRKNVMAQKNASEEGEKASTGGSSAAFVKVCMDGAPYLRKVDLKMYRSYQELSDALAKMFSSFTMGNYGAQGMIDFMNESKLMDLLNSSEYVPSYEDKDGDWMLVGDVPWEMFVNSCKRLRIMKGSEAIGLAPRAMEKCKSRT

SEQ ID NO: 2035 - protein, 226 aa, Populus balsamifera subsp. trichocarpa
  misc_feature: Public GI ID no. 118488743
  misc_feature (1)..(226): Bit score of 403.5 for HMM based on sequences of FIGURE 3.
  misc_feature (11)..(226): Pfam Name: AUX_IAA Pfam Description: AUX/IAA family
  misc_feature: Functional Homolog Of SEQ ID NO. 129
MEGGVAYENDLNLKETELRLGLPGTGCTNEKGVSGARNNKRPFPETREEGGANGKSDAQHDDQETASAPKVQIVGWPPIRSYRKNSFQPKKAEDEAAAGMVQIVGWPPIRSYRKNSLQPKKAEDEAAAGMYVKVSMDGAPYLRKIDLKVYKGYPELLKALENMFKLTIGEYSEREGYKGSEYAPTYEDKDGDWMLVGDVPWDMFLSSCKKLRIMKGSEAIGLGCGA

SEQ ID NO: 2036 - protein, 200 aa, Vitis vinifera
  misc_feature: Public GI ID no. 157329767
  misc_feature (1)..(200): Bit score of 238.7 for HMM based on sequences of FIGURE 3.
  misc_feature (20)..(192): Pfam Name: AUX_IAA Pfam Description: AUX/IAA family
  misc_feature: Functional Homolog Of SEQ ID NO. 129
MPQFFFFFFFFPLPFCDFFLALRATNGSNHNQITTNNSSSAPAAKAQVVGWPPIRSFRKNTLATTSKNNDELDGKPGPGALFIKVSMDGAPYLRKVDLRTYSTYQELSSALEKMFSCFTIGQCGSHGTPGREMLSESKLRDLLHGSEYVLTYEDKDGDWMLVGDVPWELFINSCKRLKIMKSSDAIGLAPRVMEKSKNRN

SEQ ID NO: 2037 - protein, 359 aa, Vitis vinifera
  misc_feature: Public GI ID no. 157335726
  misc_feature (1)..(359): Bit score of 289.6 for HMM based on sequences of FIGURE 3.
  misc_feature (66)..(351): Pfam Name: AUX_IAA Pfam Description: AUX/IAA family
  misc_feature: Functional Homolog Of SEQ ID NO. 129
MSPPLLGVGEEEGQSNVTILASSASMESVCQISSGLKERNYMGLSECSSVDSSAISTDSDGNKSSLNLKATELRLGLPGSLSPGREPELCLLSSTKLDEKPLFPLHPSKDLTYTSSQKTVVSGNKRGFADAMNGFSEGKFLANSEVNVMLSPRPSPNKENLGSQPAKMKEMASPKIVQERPRATNETPPNHTGTGNNNSSAPATKAQVVGWPPIRSFRKNTLATTSKNTEVDGKAGPGALFVKVSMDGAPYLRKVDLRNYSAYQELSSALEKMFSCFTIGQYGSHGAPGREMLSESKLKDLLHGSEYVLTYEDKDGDWMLVGDVPWQMFIETCKRLRIMKSCDAIGLAPRAVEKCKNRN

SEQ ID NO: 2038 - protein, 192 aa, Vitis vinifera; identical to SEQ ID NO: 1751
  misc_feature: Public GI ID no. 157336601
  misc_feature (1)..(192): Bit score of 426.2 for HMM based on sequences of FIGURE 3.
  misc_feature (11)..(192): Pfam Name: AUX_IAA Pfam Description: AUX/IAA family
  misc_feature: Functional Homolog Of SEQ ID NO. 129

SEQ ID NO: 2039 - protein, 234 aa, Vitis vinifera
  misc_feature: Public GI ID no. 157336602
  misc_feature (1)..(234): Bit score of 300.3 for HMM based on sequences of FIGURE 3.
  misc_feature (8)..(226): Pfam Name: AUX_IAA Pfam Description: AUX/IAA family
  misc_feature: Functional Homolog Of SEQ ID NO. 129
MLGAERGFDFKETELCLGLPGGGGGEAETLKASGKRGFSETVDLKLNLQSKESVVDLNENVKCPPKEKNLLPCTKDPAKPPAKAQVVGWPPVRSFRKNIMAQKNSSEEGEKGSSGAAFVKVCMDGAPYLRKVDLKMYKSYQELSDALGKMFSSFTMGNYGAQGMIDFMNESKLMDLLNSSEYVPTYEDKDGDWMLVGDVPWEMFVDSCKRLRIMKGSEAIGLAPRAMEKCKNRC

SEQ ID NO: 2040 - protein, 279 aa, Vitis vinifera
  misc_feature: Public GI ID no. 157336794
  misc_feature (1)..(279): Bit score of 171.3 for HMM based on sequences of FIGURE 3.
  misc_feature (15)..(267): Pfam Name: AUX_IAA Pfam Description: AUX/IAA family
  misc_feature: Functional Homolog Of SEQ ID NO. 129
MSTEASSYPGEAELELGLGLSLGTGGGGGGGLVKPKQPSSAWGEYGRILTAKDFPSVLSNASSTAPRFSNSSAGPVSGTKRAADSAVSQEVGSATAASQVVGWPPIRAYRMNSLVNQAKALAAEDDKADSENDKFKDTLKKKPYTGSNKNNSTVKEKGHLGFVKVNMDGLPIGRKVDLDAHACYGTLAQTLEDMFFRHNTTMPPIQKGQSTNPSKLLDGSSEFVLTYEDKEGDWMLVGDVPWGMFLSTVKRLRIMRTSEANGLAPRFQERSERQRSKPI

SEQ ID NO: 2041 - protein, 193 aa, Vitis vinifera
  misc_feature: Public GI ID no. 157340188
  misc_feature (1)..(193): Bit score of 259.7 for HMM based on sequences of FIGURE 3.
  misc_feature (1)..(185): Pfam Name: AUX_IAA Pfam Description: AUX/IAA family
  misc_feature: Functional Homolog Of SEQ ID NO. 129
MPGPAMKDVAAPSSPKPVQEKKPQASAANEHASAPAAKAQVVGWPPIRSFRKNTMASSAKNNEDAEGKSGLGCLYVKVSMDGAPYLRKVDLKIYCNYMELSSALEKMFSCFTIGQCGSHGLPGRDGLTESHLMDLLHGSEYVLTYEDKDGDWMLVGDVPWEMFTESCKRLRIMKGSEAIGLAPRAMEKCKNRN

SEQ ID NO: 2042 - protein, 161 aa, Vitis vinifera
  misc_feature: Public GI ID no. 157340285
  misc_feature (1)..(161): Bit score of 162.4 for HMM based on sequences of FIGURE 3.
  misc_feature (1)..(149): Pfam Name: AUX_IAA Pfam Description: AUX/IAA family
  misc_feature: Functional Homolog Of SEQ ID NO. 129
MQWRETRRRGCFLRCPGIAAPPLVNGKPRTRTKLWGGRQSAHIGGRTDRTEATKMYVKVSMDGAPFLRKIDLSSHQGYFNLVTAFEELFGCFGIGEALKDADSSEYIPIYEDKDGDWMLVGDVPWEMFIESCKRLRIKKKSETKNFGLQLNSLKELQKIND

SEQ ID NO: 2043 - protein, 244 aa, Vitis vinifera
  misc_feature: Public GI ID no. 157340286
  misc_feature (1)..(244): Bit score of 272.5 for HMM based on sequences of FIGURE 3.
  misc_feature (17)..(197): Pfam Name: AUX_IAA Pfam Description: AUX/IAA family
  misc_feature: Functional Homolog Of SEQ ID NO. 129
MSPQLPKPSPESSSAGLYFNDTELTLGLPGATKSGTKRGFSDTVGLNLRGPCNTDHASNPSENDVSGDSKPPPAKTQIVGWPPVKASRKNVAKISKYVKVAVDGAPYLRKVDLEMYGSYQQLLGSLEDMFSCFPIRNYLNERKLMDPVKGSDYMPTYEDRDGDWMLVGDVPWKMFVESCKRLRLMKSIEAIGLGKEVFFFFFSSFFFNIKLYFTDFFFFFLLKFCGAAPRESQKCTSTSGSKSL

SEQ ID NO: 2044 - protein, 320 aa, Vitis vinifera
  misc_feature: Public GI ID no. 157342778
  misc_feature (1)..(320): Bit score of 310.4 for HMM based on sequences of FIGURE 3.
  misc_feature (34)..(312): Pfam Name: AUX_IAA Pfam Description: AUX/IAA family
  misc_feature: Functional Homolog Of SEQ ID NO. 129
MSKQLEHDYIGLSEVSSMESSEKLTTDSEGSNGLNLKATELRLGLPGSESPERIDSVGGLDKNGYPLGVLKNLVSGAKRGFSDAIDGGSGKWVFSGSGGSETDLTKGGGLFSPRGGNGGGKHLGGSESNNQHSSLGTPVKNDVVPQSPKPMHEKKPQISAPAAKAQVVGWPPIRSFRKNSMASNLPKNDEDAEGKLGSGCLYVKVSMDGAPYLRKVDLKLYSTYMELSSALEKMFSCFTIGQCGSNGVPIRDGLSESRLMDLLHGSEYVLTYEDKDGDWMLVGDVPWEMFTDSCKRMRIMKSSEAIGLAPRAMEKCKSRN

SEQ ID NO: 2045 - protein, 215 aa, Vitis vinifera
  misc_feature: Public GI ID no. 157342874
  misc_feature (1)..(215): Bit score of 280.6 for HMM based on sequences of FIGURE 3.
  misc_feature (17)..(208): Pfam Name: AUX_IAA Pfam Description: AUX/IAA family
  misc_feature: Functional Homolog Of SEQ ID NO. 129
MPSNTADQSPDSGTTGMSLKDTELTLGLPGEAQVVIVGGKSCSKRGYSDTVDFRFRCCSGESSAKAEKVDWPGKEISGPGKAPDSKAQVVGWPPVRSVRKKALKSCKYVKVAVDGAPYLRKVDLEVHRSYQQLLMALETMFDCFTISNDLEESKIMNPVNGAEYVPTYEDKDGDWMLVGDVPWNMFVESCKRVRLMKSSEAIGLGNNVFFNWDLD

SEQ ID NO: 2046 - protein, 186 aa, Vitis vinifera
  misc_feature: Public GI ID no. 157348047
  misc_feature (1)..(186): Bit score of 411.4 for HMM based on sequences of FIGURE 3.
  misc_feature (11)..(186): Pfam Name: AUX_IAA Pfam Description: AUX/IAA family
  misc_feature: Functional Homolog Of SEQ ID NO. 129
MEKPVVYDNGLNLEATELRLGLPGTNEPEKQSSTSVRSKKRASPEMAEETRSKSSSCISDADDDAPPPKAQVVGWPPVRSYRKNSFQQRKGEAEGAGMYVKVSMDGAPYLRKIDLKVYKSYPELLNALENMFKFRIGEYSEREGYNGSDYTPAYEDKDGDWMLVGDVPWEMFISSCKRLRIMKGSE

SEQ ID NO: 2047 - protein, 268 aa, Vitis vinifera
  misc_feature: Public GI ID no. 157350506
  misc_feature (1)..(268): Bit score of 179.3 for HMM based on sequences of FIGURE 3.
  misc_feature (40)..(256): Pfam Name: AUX_IAA Pfam Description: AUX/IAA family
  misc_feature: Functional Homolog Of SEQ ID NO. 129
MDGGSGGGVCTSGSMSTVSKEDNLMVSTEVSSYPDEAELELGLGLSLGGGGGGGGGVKPQEQGWAQYGRILTAKDFPSTVSSSSSSSSSLSRANRTTVGTKRRADSVAASNNGSQVVGWPPIRAYRMNSLANQLEFNVQTQCNNTNGPLNTSFFVKVNMDGIPIGRKVDLSAHSCYETLAKTLEEMFQGPTTTVNAIESTRPSKLLDGSSDFVLTYEDKEGDWMLVGDVPWGMFLGSARRLRIMRTSDANGLAPRIQERNGRQRSMRI

SEQ ID NO: 2048 - protein, 199 aa, Vitis vinifera
  misc_feature: Public GI ID no. 157352085
  misc_feature (1)..(199): Bit score of 445.2 for HMM based on sequences of FIGURE 3.
  misc_feature (11)..(199): Pfam Name: AUX_IAA Pfam Description: AUX/IAA family
  misc_feature: Functional Homolog Of SEQ ID NO. 129
MENKVIYEKDLNLEATELRLGLPGTKKPEKQAPPSLKTSNKRALPDMNEESGSGNNSSVSDDGKSHRETAPAPKAQVVGWPPVRSYRKSCFQPKKTEAEEGRTYLKVSMDGAPYLRKIDLKVYKGYPELLKALEEMFKFSVGQYSEREGYNGSEYAPTYEDKDGDWMLVGDVPWNMFISSCKRLRIMKGSEARGLGCFL

SEQ ID NO: 2049 - protein, 238 aa, Vitis vinifera
  misc_feature: Public GI ID no. 157360845
  misc_feature (1)..(238): Bit score of 319.1 for HMM based on sequences of FIGURE 3.
  misc_feature (14)..(230): Pfam Name: AUX_IAA Pfam Description: AUX/IAA family
  misc_feature: Functional Homolog Of SEQ ID NO. 129
MASIVCAERDKFNLNYEETELRLGLGLPGGGGNDGDVSKTSGKRGFSETVDLKLNLLSKDSVADQAEKMKEKSALPPSNDPAKPPAKAQVVGWPPVRSFRKNILTVQKNSSEEEKASSSAAFVKVSMDGAPYLRKVDLKMYKSYQELSDALGKMFSSFTIGNCGSQGMKDFMNESKLIDLLNGSDYVPTYEDKDGDWMLVGDVPWEMFVESCKRLRIMKGSEAIGLAPRAVEKCKNRS

SEQ ID NO: 2050 - protein, 231 aa, Brassica rapa
  misc_feature: Public GI ID no. 157849760
  misc_feature (1)..(231): Bit score of 314.3 for HMM based on sequences of FIGURE 3.
  misc_feature (2)..(223): Pfam Name: AUX_IAA Pfam Description: AUX/IAA family
  misc_feature: Functional Homolog Of SEQ ID NO. 129
MINFEATELRLGLPGGNHGGDMAMKNNGKRGFSETVDLKLNLSSTALDSVSGVDLENMKEKVVKPPAKAQVVGWPPVRSFRKNVMSGQKPTAGDATEGTEKTSSSNGATSSAAAYVKVSMDGAPYLRKIDLKLYKTYQDLSDALSKMFSSFTLGNYGPQGMKDFMNESRLIDLLNGSDYVPTYEDKDGDWMLVGDVPWGMFVDSCKRIRIMKGSEAIGLAPRALEKCKNRS

SEQ ID NO: 2051 - protein, 242 aa, Brassica rapa
  misc_feature: Public GI ID no. 157890958
  misc_feature (1)..(242): Bit score of 304.2 for HMM based on sequences of FIGURE 3.
  misc_feature (6)..(233): Pfam Name: AUX_IAA Pfam Description: AUX/IAA family
  misc_feature: Functional Homolog Of SEQ ID NO. 129
MIGELINLKATELCLGLPGGAEANENLEKSAVGNKRGFSETVDLMLNLQSNKEGAVDLNNVASASKDKTLLKDPAKPPAKAQVVGWPPVRNYRKNIITQQKTSGKEEASSEKAGNSGGGASGAALVKVSMDGAPYLRKVDLKMYKSYKDFSDALAKMFSSFTMGKYGAQGMIDFMNESKLMDLLNSSEYVPSYEDKDGDWMLVGDVPWEMFVDSCKRLRIMKGSEAIGLAPRAMEKYCKNRS

SEQ ID NO: 2052 - protein, 335 aa, Medicago truncatula
  misc_feature: Public GI ID no. 163889362
  misc_feature (1)..(335): Bit score of 290.3 for HMM based on sequences of FIGURE 3.
  misc_feature (51)..(327): Pfam Name: AUX_IAA Pfam Description: AUX/IAA family
  misc_feature: Functional Homolog Of SEQ ID NO. 129
MSPTAVVTEDEGRRKLSSTMERNYLGLSDCSSVDSCDSTLPSLCDEKKVNLNLKATELRLGLPGSQSPEREMDSDFYLTKLDEKPLFPLLPAKDGLQKNVVSGNKRGFADTVDGFSQGKFNGNTGINVMLSPRPAGAQASTVKEMPSKVLQERPCAARGTAGHNHAGAASVAGCAPASKAQVVGWPPIRSFRKNSMGTASKNNNDEVDGKPGPAALFVKVSMDGAPYLRKVDLRTYATYQQLSSALEKMFSCFTLGQCGSHGAPGKEMMSESKLRDLLHGSEYVLTYEDKDGDWMLVGDVPWEMFIDTCRRLKIMKGSDAIGLAPRAMEKSKSRS

SEQ ID NO: 2053 - protein, 189 aa, Arabidopsis thaliana
  misc_feature: Public GI ID no. 164604680
  misc_feature (1)..(189): Bit score of 365.5 for HMM based on sequences of FIGURE 3.
  misc_feature (5)..(189): Pfam Name: AUX_IAA Pfam Description: AUX/IAA family
  misc_feature: Functional Homolog Of SEQ ID NO. 129
MDEFVNLKETELRLGLPGTDNVCEAKERVSCCNNNNKRVLSTDTAKEIESSSRKTETSPPRKAQIVGWPPVRSYRKNNIQSKKNESEHEGQGIYVKVSMDGAPYLRKIDLSCYKGYSELLKALEVMFKFSVGEYFERDGYKGSDFVPTYEDKDGDWMLIGDVPWEMFICTCKRLRIMKGSEAKGLGCGV

SEQ ID NO: 2054 - protein, 189 aa, Arabidopsis thaliana
  misc_feature: Public GI ID no. 164604690
  misc_feature (1)..(189): Bit score of 362.8 for HMM based on sequences of FIGURE 3.
  misc_feature (5)..(189): Pfam Name: AUX_IAA Pfam Description: AUX/IAA family
  misc_feature: Functional Homolog Of SEQ ID NO. 129
MYEFVNLKETELRLGLPGTDNVCEAKERVSCCNNNNKRVLSTDTAKEIESSSRKTETSPPRKAQIVGWPPVRSYRKNNIQSKKNESEHEGQGIYVKVSMDGAPYLRKIDLSCYKGYSELLKALEVMFKFSVGEYFERDGYKGSDFVPTYEDKDGDWMLIGDVPWEMFICTCKRLRIMKGSEAKGLGCGV

SEQ ID NO: 2055 - protein, 189 aa, Arabidopsis thaliana
  misc_feature: Public GI ID no. 164604722
  misc_feature (1)..(189): Bit score of 361.1 for HMM based on sequences of FIGURE 3.
  misc_feature (5)..(189): Pfam Name: AUX_IAA Pfam Description: AUX/IAA family
  misc_feature: Functional Homolog Of SEQ ID NO. 129
MDEFVNLKETELRLGLPGTDNVCEAKERVSCCNNNNKRVLSTDTEKEIESSSRKTETSPPRKAQIVGWPPVRSYRKNNIQSKKNESEHEGQGIYVKVSMDGAPYLRKIDLSCYKGYSELLKALEVMFKFSVGEYFERDVYKGSDFVPTYEDKDGDWMLIGDVPWEMFICTCKRLRIMKGSEAKGLGCGV

SEQ ID NO: 2056 - protein, 190 aa, Arabidopsis lyrata
  misc_feature: Public GI ID no. 164604756
  misc_feature (1)..(190): Bit score of 366.1 for HMM based on sequences of FIGURE 3.
  misc_feature (5)..(190): Pfam Name: AUX_IAA Pfam Description: AUX/IAA family
  misc_feature: Functional Homolog Of SEQ ID NO. 129
MDEFVNLKETELRLGLPGTDNVYEEKESIISCCNNNNKRALSSDNEKEIESSSRKTETSPPRKAQIVGWPPVRSYRKNNIQTKKNESEHEGQGIYVKVSMDGAPYLRKIDLSCYKGYSELLKALEVMFKFSVGEYFERDGYKGSDFVPTYEDKDGDWMLIGDVPWEMFICTCKRLRIMKGSEAKCLSCGV

SEQ ID NO: 2057 - protein, 190 aa, Arabidopsis lyrata
  misc_feature: Public GI ID no. 164604758
  misc_feature (1)..(190): Bit score of 364.4 for HMM based on sequences of FIGURE 3.
  misc_feature (5)..(190): Pfam Name: AUX_IAA Pfam Description: AUX/IAA family
  misc_feature: Functional Homolog Of SEQ ID NO. 129
MDEFVNLKETELRLGLPGTDNVCEEKESIISCCNNNNKRALSSYNEKEIESSSRKTETSPPRKAQIVGWPPVRSYRKNNIQTKKNESEHEGQGIYVKVSMDGAPYLRKIDLSCYKGYSELLKALEVMFKFSVGEYFERDGYKGSDFVPTYEDKDGDWMLIGDVPWEMFICTCKRLRIMKGSEAKCLSCGV

SEQ ID NO: 2058 - protein, 225 aa, Ipomoea nil
  misc_feature: Public GI ID no. 194067755
  misc_feature (1)..(225): Bit score of 303.9 for HMM based on sequences of FIGURE 3.
  misc_feature (2)..(217): Pfam Name: AUX_IAA Pfam Description: AUX/IAA family
  misc_feature: Functional Homolog Of SEQ ID NO. 129
MLNFEATELRLGLPGGGGGNDGEAVKSNGKRAFSDTVDLKLKLSSKESNVDQVENLKDNNNNVVTSPSDSTKPPAKAQVVGWPPVRSYRKNILSGQKAAGESSGGGAALVKVSVDGAPYLRKVDLKMYKSYHELSEALGKMFSSFTIGNCGTHGFKDFMNESKLIDLLNGSDYVPTYEDKDGDWMLVGDVPWNMFVDSCKRLRIMKGSEAIGLAPRAVEKCKNRS

SEQ ID NO: 2059 - protein, 220 aa, Zea mays
  misc_feature: Public GI ID no. 194693260
  misc_feature (1)..(220): Bit score of 266.1 for HMM based on sequences of FIGURE 3.
  misc_feature (18)..(218): Pfam Name: AUX_IAA Pfam Description: AUX/IAA family
  misc_feature: Functional Homolog Of SEQ ID NO. 129
MSVETERSSTESSGASGLDFEDTALTLTLRLPGSAPSAAAAAAASLSLSSSSSSAFPDPDRKRASSDADPGRSSPLAASSDAAPAPKARVVGWPPVRSYRKNALADAAGSSKAAKFVKVAVDGAPYLRKVDLQAYAGYDQLLRALQDKFFSHFTIRKFADDERKLVDAVNGTEYVPTYEDKDGDWMLVGDVPWKMFVETCQRLRLMKGSEAVNLAPRAAR

SEQ ID NO: 2060 - protein, 226 aa, Zea mays
  misc_feature: Public GI ID no. 194696804
  misc_feature (1)..(226): Bit score of 273.0 for HMM based on sequences of FIGURE 3.
  misc_feature (7)..(222): Pfam Name: AUX_IAA Pfam Description: AUX/IAA family
  misc_feature: Functional Homolog Of SEQ ID NO. 129
METVVGDLMATELRLGLPGTVDDCSQPQLVKATPPSTPRGKRRATADAVEEAAGAEEASKRDAETAPPAAKAPVVGWPPVRSYRKSCFQQASSKQAAAAKQEAAAAAPGCTASSAAATNTSSCSSAAVVVGSFVKVSMDGAPYLRKVDLRMYRGYRELREALEAMFVSSSSANNLSEFAVTYEDKDGDLMLVGDVPFEMFASTCKKLRIMKRSEATGLGSSSARQQ

SEQ ID NO: 2061 - protein, 293 aa, Zea mays
  misc_feature: Public GI ID no. 194702982
  misc_feature (1)..(293): Bit score of 157.8 for HMM based on sequences of FIGURE 3.
  misc_feature (40)..(278): Pfam Name: AUX_IAA Pfam Description: AUX/IAA family
  misc_feature: Functional Homolog Of SEQ ID NO. 129
MRGGGAGPTAAFMSDEPPPADAEEVEENSGAEEEDEETVVEQDDDELELGLCLGSKQQQQQHPPPCRILTARDLQPRSLSPDSSVSSSSPAAGAGTAAPSKRAKADAAPNSPGTVASGHPQSFGVVGWPPIRTFRMNSLFNQAKENASEAGAKKPIVEPDMQEDKEESKKGRTVGWVKVNMEGDIIGRKVDLNAHRSYKTLASALELMFMKPSIGLCTSSSSKTLKLLDSSSEYQLTYEDRDGDWMLVGDVPWEMFVGSVKRLKIMRTSDAKGLGPRFQGSHRPTAACTRGRT

SEQ ID NO: 2062 - protein, 281 aa, Zea mays
  misc_feature: Public GI ID no. 194706696
  misc_feature (1)..(281): Bit score of 254.5 for HMM based on sequences of FIGURE 3.
  misc_feature (40)..(272): Pfam Name: AUX_IAA Pfam Description: AUX/IAA family
  misc_feature: Functional Homolog Of SEQ ID NO. 129
MPPPPPLLEPRDYLGAGATSSCCSSCCSSGREGAGPHLALRLGLPGSDDSPGRGADTEHARAHVDAALTLGPGPGPAPPRGSAKRGFADSLDRSAKLDGVAADDAAGGVTRVAGAAAGAPPAAKAQVVGWPPVRSYRKNTLAASATKTNGGDEGRSEAGCCYVKVSMDGAPYLRKVDLKTYSSYEDLSLGLEKMFSCFITGQNSSCKTSRRDRLTDGSRVDALQDQEYVLTYEDKDADWMLVGDLPWDLFTTFCRKLRIMRGSDAAGMAPPRPPEQTVRNK

SEQ ID NO: 2063 - protein, 271 aa, Zea mays
  misc_feature: Public GI ID no. 194708498
  misc_feature (1)..(271): Bit score of 302.9 for HMM based on sequences of FIGURE 3.
  misc_feature (7)..(263): Pfam Name: AUX_IAA Pfam Description: AUX/IAA family
  misc_feature: Functional Homolog Of SEQ ID NO. 129
MATTTDLGFEATELRLGLPGGGGGGEPALGGEGRSSSSASGKRGFAETIDLKLKLEPAAVVEAEEEEEDHGVAVALEKEEEAGKMKRSPSQSSVAAAAAAVLADPAEKPRAAKAQVVGWPPVRSFRKNIMSVQSDKGAAAANGDKSSPAAGGGAAFVKVSLDGAPYLRKVDLKMYRSYQQLSKALENMFSSFTIGSCGSQGMNGMNESKLVDLLNGSEYVPTYEDKDGDWMLVGDVPWEMFVESCKRLRIMKGSEAIGLAPRAMEKCKNRS

SEQ ID NO: 2064 - protein, 246 aa, Zea mays; identical to SEQ ID NO: 1752
  misc_feature: Public GI ID no. 194708620
  misc_feature (1)..(246): Bit score of 400.9 for HMM based on sequences of FIGURE 3.
  misc_feature (25)..(238): Pfam Name: AUX_IAA Pfam Description: AUX/IAA family
  misc_feature: Functional Homolog Of SEQ ID NO. 129

SEQ ID NO: 2065 - protein, 229 aa, Zea mays
  misc_feature: Public GI ID no. 194708660
  misc_feature (1)..(229): Bit score of 131.6 for HMM based on sequences of FIGURE 3.
  misc_feature (19)..(219): Pfam Name: AUX_IAA Pfam Description: AUX/IAA family
  misc_feature: Functional Homolog Of SEQ ID NO. 129
MAWRGPLGAGEEALDSGLELSLGLPAYFARPSGLDAAREEPAEASAYAIQAASGSNVSKARVRPAGAAPVVGWPPVRSFRRNLAASSSRPSSGKHTRQEGSAKDGLFVKINMDGVPIGRKVDLTAYGGYADLSAAVGKLFRGLLAAQRDRAATAGGEEEEEGEGPVIGGDYTLVYEDDEGDRVLAGDVPWEMFVATAKRLRVLKSSDVPASSVTLGAGGPERSAADCCC

SEQ ID NO: 2066 - protein, 243 aa, Arabidopsis thaliana
  misc_feature: Public GI ID no. 186478946
  misc_feature (1)..(243): Bit score of 374.5 for HMM based on sequences of FIGURE 9.
  misc_feature (53)..(83): Pfam Name: VQ Pfam Description: VQ motif
  misc_feature: Functional Homolog Of SEQ ID NO. 850
MENSPRYREATNLIPSPRCHNSNNSCGMSSSSESNKPPTTPTRHVTTRSESGNPYPTTFVQADTSSFKQVVQMLTGSAERPKHGSSLKPNPTHHQPDPRSTPSSFSIPPIKAVPNKKQSSSSASGFRLYERRNSMKNLKINPLNPVFNPVNSAFSPRKPEILSPSILDFPSLVLSPVTPLIPDPFDRSGSSNQSPNELAAEEKAMKERGFYLHPSPATTPMDPEPRLLPLFPVTSPRVSVNKR

SEQ ID NO: 2067 - protein, 211 aa, Vitis vinifera
  misc_feature: Public GI ID no. 157358741
  misc_feature (1)..(211): Bit score of 362.2 for HMM based on sequences of FIGURE 9.
  misc_feature (52)..(82): Pfam Name: VQ Pfam Description: VQ motif
  misc_feature: Functional Homolog Of SEQ ID NO. 850
MENSPKPLEGQNPSLIPSPNSHSTNSSSSSSSNSNGLHHPPTPKPITRSESNPYPTTFVQADTSSFKQVVQMLTGSSETAKQASASKPVSDPRTHIPPIKTGAKKQPGFKLYERRNSLKNLKLSPLIPGFPEILSPSMLDFPALVLSPVTPLIPDPFNRSPMNSCTEEKAIAEKGFFLHPSPATTPRDSEPRLLSLFPVTSPRVPGSSTSS

SEQ ID NO: 2068 - DNA, 1191 bp, Glycine max
  misc_feature: Ceres Clone ID no. 652496
  misc_feature: Encodes the peptide sequence at SEQ ID NO. 2069
  misc_feature (368)..(368): n is a, c, t, g, unknown, or other
acaagctcaataagcaaaaacaaccctctttccttttttttatttttcttcctcaagccttgttttttcactcttctatatttcttctccaatccccacccaaatcacccctaaccctttgaaagattttaatttgtttgttttggtgcaaggagagagagaggagagtgagagatggaaatcagctcaaggcttcaagaaagagagaaccacaaccacatccataaccataaccacccttgctcctatgaactctccaacagrgcaatgtgagcaactgcatgagcagcagcaacagcaatggcatccaaatcccaacaccaccactcactcccaaaaccattcccagatctgattccaacccttancctaccacttttgtccaagctgacacctccactttcaagcaagtagtccaaatgctaactggctcatcagacaccacaaaacaagcatcacaagatccacaaccaccacaaccaccatcatcatcatcatccagaaacttcaacataccccccatcaaggccccaccaaagaagcaacaaggaggcttcaagctctatgagaggaggaacagcctcaagaacagcctcatgctcaacaccttgatgcccaattttgcttataatcacaacaacaattctccaagcttctcaccaagaaacaacatgcctgagatcctctccccaagccttcttgacttcccttcccttgctctaagccctgttacaccattgaatgatgacccttttgacaagtcctccccttcattggggaactcgtcagaggaggataaagccatagctgaaaagggcttckacttgcatscctctcccatgaccactccaagagactcagaaccacagctcttgcctttgttcccagttacctcacctagagtctcatcacaatcaccttcttgatcttgatgagatgaaaagagattgtgttcctgtgctgtggatgattggttaattacatcatgggttttttattttgatttgaatatggtttatggtttcctctatcaacaaggtacaaaagcttttgtctaattgtaaaagtggctttcttaccatgaaatggcaactcttttctttattctcctgctttgttttcccacctcaaaatattggtatcttttcttgttttccctttccataaatgaaaaaaaaagtttctttgtac

SEQ ID NO: 2069 - protein, 214 aa, Glycine max
  misc_feature: Ceres Clone ID no. 652496
  misc_feature (1)..(214): Bit score of 258.7 for HMM based on sequences of FIGURE 9.
  misc_feature (27)..(57): Pfam Name: VQ Pfam Description: VQ motif
  misc_feature: Functional Homolog Of SEQ ID NO. 850
  misc_feature (29)..(29): Xaa is any aa, unknown, or other
  misc_feature (181)..(181): Xaa is any aa, unknown, or other
  misc_feature (184)..(184): Xaa is any aa, unknown, or other
MSSSNSNGIQIPTPPLTPKTIPRSDSNPXPTTFVQADTSTFKQVVQMLTGSSDTTKQASQDPQPPQPPSSSSSRNFNIPPIKAPPKKQQGGFKLYERRNSLKNSLMLNTLMPNFAYNHNNNSPSFSPRNNMPEILSPSLLDFPSLALSPVTPLNDDPFDKSSPSLGNSSEEDKAIAEKGFXLHXSPMTTPRDSEPQLLPLFPVTSPRVSSQSPS

SEQ ID NO: 2070 - protein, 210 aa, Vitis vinifera
  misc_feature: Public GI ID no. 157338257
  misc_feature (1)..(210): Bit score of 311.1 for HMM based on sequences of FIGURE 9.
  misc_feature (53)..(83): Pfam Name: VQ Pfam Description: VQ motif
  misc_feature: Functional Homolog Of SEQ ID NO. 850
MENTVKTQDREKTSPITSPNSNGSNCSSSSNSTGLQIQTPPLTPKPISRSDSNPYPTTFVQADANSFKQVVQRLTGSSKPTQDPPTKACNIPPIRTGQKKQGFKLYERRSQLKNGLMINPLVHGYVQNNSGFSPRKPEILSPSLLDFPKLVLSPVTPLTEDPFNKSSEEKAIAEKGFYLHPSPMSTPRDSEPQLLPLFPVTSPRVSGSSS

SEQ ID NO: 2071 - DNA, 702 bp, Solanum lycopersicum
  misc_feature: Ceres Annot ID no. 8458881
  misc_feature: Encodes the peptide sequence at SEQ ID NO. 2072
atggaaatcaattcaagaattcaagatagagagaacccatcttccataaactcaccaagaagcaatggaacaagtcctacaagcaacagcaatggatcagttatccaaaatccaaccccaccactgaccccaaaaacaatttctagatctgaaacaactaacccatacccaacaacttttgttcaagctgatacatcttctttcaaacaagtggttcaaatgctaactggatcatctgaaacttctgcgaaacaatcatctgcttcagatccatcttcttcttcaaattcaaattcaaattcagcaaaaagttcaattcccccaattcgaacagcaccgaagaaacctgggttcaagctttacgagaggagaaacagtttgaaaaatgggtttatgattagccctttgattcctggaattcatcctcagaattcgagtttttctcctcggaacaaaccggagattctctcacccagtattctagattttccttcacttgctttaagccctgttacgccattgaatgaagacccatttaataaatcatcaccattaacgaatctatctgaagaagataaagctattgctgagaagaagttttatttgcatccttcaccaagaagaacaccgagagactctgaaccacagcttttgcctctgtttccggtgagttctcctagagtttcagggtcttcttcttga

SEQ ID NO: 2072 - protein, 233 aa, Solanum lycopersicum
  misc_feature: Ceres Annot ID no. 8458881
  misc_feature (1)..(233): Bit score of 331.0 for HMM based on sequences of FIGURE 9.
  misc_feature (54)..(84): Pfam Name: VQ Pfam Description: VQ motif
  misc_feature: Functional Homolog Of SEQ ID NO. 850
MEINSRIQDRENPSSINSPRSNGTSPTSNSNGSVIQNPTPPLTPKTISRSETTNPYPTTFVQADTSSFKQVVQMLTGSSETSAKQSSASDPSSSSNSNSNSAKSSIPPIRTAPKKPGFKLYERRNSLKNGFMISPLIPGIHPQNSSFSPRNKPEILSPSILDFPSLALSPVTPLNEDPFNKSSPLTNLSEEDKAIAEKKFYLHPSPRRTPRDSEPQLLPLFPVSSPRVSGSSS

SEQ ID NO: 2073 - DNA, 1145 bp, Miscanthus x giganteus
  misc_feature: Ceres Clone ID no. 2055796
  misc_feature: Encodes the peptide sequence at SEQ ID NO. 2074
atcctcttcctcctcttcccctctcctccccggccctcttctcttctccgccaacgccaaaacccacacactccaatggaggtttccaccaagcaactcctccccatgccttatcagcaagaccccaactccccttcctcttccacctcttcttcttcgtcgtcgtccacctccccatctcacccccaccaccgtgcgcagccccacaacctcccgcagtcccccaggcccatcccgcgcaccatcgacaccactccgttccccaccaccttcgtccaggccgacaccacctcgttcaagcaggtcgtccagatgctcaccggcgccgagccgcccaccaagaacgacgcgacgacgacaggggcagctgctgccaacagcggcagcgccgggaccggcggcggccaagcggctagcggcgggccgtgccggcccaagaagccgtctttcaagctgtacgagcggcggagcagcctgaagaacctgaagatgatcgcgccgctggcgatgggcccgccgccgtcgccgcggacgagggccacgccggagatcctgtcgccgagcgtcctggacttcccgtccctgaggctcagcagcccggtgacgccgctcaccggcgaccccttcaaccgctcgccggcgtcgacgtcgtcgtcctccgaggaggccgagcgcgccgccatcgccgagaggggcttcttcctccacccgtccccgaggggcggcgccgagcccccgcgcctgctcccgctcttccccgtcacctcgccccggatggcggcgccgtccgagtgaagatccggcccgcctctcatctcgtcgcgggcgcgcgctaccgtaccgtagccaccaccgccagtactactacaaccgccgccgtactgcccttccgttctggttttgtaaggtgcttgctttgctgttcttcttgatcgacgctgctgctgctgtaatttttgctcccttcttgaaacgaacgaagaagggagttcttttttttcttcatttcggagcggcgacacgcgagcgatctgatgatccaggctcgatcgctcgattcctgatcgctcgcgggagcctccggaatgaaatgatggatggatgaattagataattaattaatgatgaagcttaatcttgagatt

SEQ ID NO: 2074 - protein, 239 aa, Miscanthus x giganteus
  misc_feature: Ceres Clone ID no. 2055796
  misc_feature (1)..(239): Bit score of 478.9 for HMM based on sequences of FIGURE 9.
  misc_feature (60)..(90): Pfam Name: VQ Pfam Description: VQ motif
  misc_feature: Functional Homolog Of SEQ ID NO. 850
MEVSTKQLLPMPYQQDPNSPSSSTSSSSSSSTSPSHPHHRAQPHNLPQSPRPIPRTIDTTPFPTTFVQADTTSFKQVVQMLTGAEPPTKNDATTTGAAAANSGSAGTGGGQAASGGPCRPKKPSFKLYERRSSLKNLKMIAPLAMGPPPSPRTRATPEILSPSVLDFPSLRLSSPVTPLTGDPFNRSPASTSSSSEEAERAAIAERGFFLHPSPRGGAEPPRLLPLFPVTSPRMAAPSE

SEQ ID NO: 2075 - DNA, 980 bp, Panicum virgatum
  misc_feature: Ceres Clone ID no. 1804762
  misc_feature: Encodes the peptide sequence at SEQ ID NO. 2076
attcccactccctctcgcctccgcacagacccgtcagacaccccgtccctccctcctcgccgtggaaccaacgcccagcgcgcgcgcgcgcgagcacgagaacccccaccgcgtatggaagttgctgcggcgaagcaactcctccccatggcgcggggccccaactccccgtcctcgtccacctcctcctcctccccgtcctccgccgcctccccgtcgccgcgccagccgcagtcccagcccgtcccgccgtcgcccaagcccgtgccgcgcatcatcgacaccacgcccttcccgaccaccttcgtgcaggccgacaccaccaacttcaagcaggtcgtgcagaggctcaccggctccgacacgccgccgtcggcccagaacaagcccgccaagacccaccaccaccaccaccacggcgccagcggcctcgccggcgggcccaagaagccggccttcaagctctacgagcgccggatcggcaagaacaacctcaagatgatcgcgccgctggcgatggccgcggccgcggccgcgggggcgtcgccgcggaagccgggccccgaggtgctgtcgcccagcgtgctcaacttcccgtccctggcgctcgggagccccgtcacgccgctggtgtcggaccccttcaaccggtcgccggcgtccgcgtcgccgggcgaggaggccgccgagcgcgcggccatcgcgcgcaagggcttcttcctgcacccgtccccgagggccgccgagccgccgcggctgctgccgctgttccccgtcacgtcccccaggatggcgccctccgccgccgccgccgcggcgccgtcgtcgcagtgaccgggcaccgcgctgccggagaattcctagtatttgcgtgagaaacttgctgtttaactactccttgcgtgatgtaatttttgctcatactagtcctgaaccgatcgccaagaaacggaaagaagaatcacactcttgagcttctc

SEQ ID NO: 2076 - protein, 239 aa, Panicum virgatum
  misc_feature: Ceres Clone ID no. 1804762
  misc_feature (1)..(239): Bit score of 410.7 for HMM based on sequences of FIGURE 9.
  misc_feature (58)..(88): Pfam Name: VQ Pfam Description: VQ motif
  misc_feature: Functional Homolog Of SEQ ID NO. 850
MEVAAAKQLLPMARGPNSPSSSTSSSSPSSAASPSPRQPQSQPVPPSPKPVPRIIDTTPFPTTFVQADTTNFKQVVQRLTGSDTPPSAQNKPAKTHHHHHHGASGLAGGPKKPAFKLYERRIGKNNLKMIAPLAMAAAAAAGASPRKPGPEVLSPSVLNFPSLALGSPVTPLVSDPFNRSPASASPGEEAAERAAIARKGFFLHPSPRAAEPPRLLPLFPVTSPRMAPSAAAAAAPSSQ

SEQ ID NO: 2077 - DNA, 691 bp, Panicum virgatum
  misc_feature: Ceres Clone ID no. 1993740
  misc_feature: Encodes the peptide sequence at SEQ ID NO. 2078
attcccactccctctcgcctccgcacagacccgtcagacaccccgtccctccctcctcgccgtggaaccaacgcccagcgcgcgcgcgcgcgagcacgagaacccccaccgcgtatggaagttgctgcggcgaagcaactcctccccatggcgcggggccccaactccccgtcctcgtccacctcctcctcctccccgtcctccgccgcctccccgtcgccgcgccagccgcagtcccagcccgtcccgccgtcgcccaagcccgtgccgcgcatcatcgacaccacgcccttcccgaccaccttcgtgcaggccgacaccaccaacttcaagcaggtcgtgcagaggctcaccggctccgacacgccgccgtcggcccagaacaagcccgccaagacccaccaccaccaccaccaccaccaccacggcgccagcggcctcgccggcgggcccaagaagccggccttcaagctctacgagcgccggatcggcaagaacaacctcaagatgatcgcgccgctggcgatggccgcggccgcggccgcgggggcgtcgccgcggaagccgggccccgaggtgctgtcgcccagcgtgctcaacttcccgtccctggcgctcgggagccccgtcacgccgctggtgtcggaccccttcaaccggtcgccggcgtccgcgtcgccgggcgaggagg

SEQ ID NO: 2078 - protein, 192 aa, Panicum virgatum
  misc_feature: Ceres Clone ID no. 1993740
  misc_feature (1)..(192): Bit score of 253.8 for HMM based on sequences of FIGURE 9.
  misc_feature (58)..(88): Pfam Name: VQ Pfam Description: VQ motif
  misc_feature: Functional Homolog Of SEQ ID NO. 850
MEVAAAKQLLPMARGPNSPSSSTSSSSPSSAASPSPRQPQSQPVPPSPKPVPRIIDTTPFPTTFVQADTTNFKQVVQRLTGSDTPPSAQNKPAKTHHHHHHHHHGASGLAGGPKKPAFKLYERRIGKNNLKMIAPLAMAAAAAAGASPRKPGPEVLSPSVLNFPSLALGSPVTPLVSDPFNRSPASASPGEE

SEQ ID NO: 2079 - DNA, 1239 bp, Brassica napus
  misc_feature: Ceres Clone ID no. 1038729
  misc_feature: Encodes the peptide sequence at SEQ ID NO. 2080
atatcgagttaggttttaggagttccttctctgcgaaatcgagctttaagctgctgggttgtctcaagatcttagtattggctggttagatccgattacatccgtctctctctctctctctagacccaaacccctccctcccccccctcccccccatacccctcccgcaccctcgattcgaaaacatgccatcgattgtgattgcgaggaaccaggcgagcggtcagaacttggtcgattcgactaagctcgcaagaatcgtaaatgattccaaaacgtctctccctaaagagaagaaggataagaaggagaggagaaaacacaggacagaaaagcgtgagaaatctcacagacattcttctaaaaagtccagcaagtccccaggcgtgtctgagaagagtggtgtgaccgaggagctcgagggacctcaaaaccacctcggttatctgtctgatggaagtctgaatagtaacaagaggaaaagagatgtctctcctccggctgttgagagtctcatcaaagttgtgcctgtagcaggtaagcctctacgtattcgtttgaccttcaaaaaacccaaggttgaaagtcctttgccccaagaggatgttgttgcttgttccacttccggtgctgtctctctcaatctggcaccacgagctgccgtatgctcttctgtatgtgagcctgagctgaatattccctcaacatctgaggccttaatagaagaaacaaagaagatatgtgagcctgaagtgaatgtcccctcaacatcagaagctgcaatagctggtgaagtaaagaagagaaggaaacacaagccgagcaaagaagaccggtacaatgcattgtttgatgattggactccaatttccaccactgccatggaggttgatttttcctctaaggacgatgacgactggctatttggtgggagcaggacgaaagagagaagaaactgcaaagcatcaaacaagattgatgaagacgtgcgcgcatcttgtgattcgtcttggccaaaagctcagtttctgtctcaagtcgggatctattctttaccgtacaccgtcccgttctagtgtttgttatgttaagtctttgctctgtgtacagtaacactgattgtaacaacagttctctaatctaacccaattttgatacggttcattttttgatcatggtgtaacaactagactatcaatgtgtaacgaaaatgtattattcaaatcaatggcaaaattg

SEQ ID NO: 2080 - protein, 296 aa, Brassica napus
  misc_feature: Ceres Clone ID no. 1038729
  misc_feature (1)..(296): Bit score of 207.2 for HMM based on sequences of FIGURE 12.
  misc_feature: Functional Homolog Of SEQ ID NO. 1024
MPSIVIARNQASGQNLVDSTKLARIVNDSKTSLPKEKKDKKERRKHRTEKREKSHRHSSKKSSKSPGVSEKSGVTEELEGPQNHLGYLSDGSLNSNKRKRDVSPPAVESLIKVVPVAGKPLRIRLTFKKPKVESPLPQEDVVACSTSGAVSLNLAPRAAVCSSVCEPELNIPSTSEALIEETKKICEPEVNVPSTSEAAIAGEVKKRRKHKPSKEDRYNALFDDWTPISTTAMEVDFSSKDDDDWLFGGSRTKERRNCKASNKIDEDVRASCDSSWPKAQFLSQVGIYSLPYTVPF

SEQ ID NO: 2081 - protein, 444 aa, Zea mays
  misc_feature: Public GI ID no. 194691746
  misc_feature (1)..(444): Bit score of 984.3 for HMM based on sequences of FIGURE 12.
  misc_feature: Functional Homolog Of SEQ ID NO. 1024
MSRCFPYPPPVYLGNPVAVAEAESTAKKERERAHKKKDKRSDKKAPQLGETSKHSKHNHKKRKLEDVSTGDQEPKKVFKESAELLEKSGLSEEHGAPCFVQMFRDSPESSQDSSKRRKAVLPSPSQFKNGNIIRIKLKSNQDPQSVLLEKPRVLEQPLVQQMSSASSLSSKQSSINRKVNGRSTAGQQWVNGDSQAVQKSLVTETPSRAMQRTVPQPAVKVTRRADPQLSVKAPVGRSDLPPKFSGSVGPSPARVTRRFCPPPVKTQQRIQHPPSMVSQRVDPQAKVSQKEMGSAVCLPQAPHPPVLQKPKDLPVPKQREPITSLPKEEPCFSGRTVEADQGKEAKLSRSDRKKIHKTEKKNKKFRDLFVTWNPLLMENEGSDLGGQDWLFSSTRSSDGSMAQPTVSDGLGPIHPMVQQQPYLQPRATFLPDLHIYQLPYVVPF

SEQ ID NO: 2082 - DNA, 2892 bp, Sorghum bicolor
  misc_feature: Ceres Annot ID no. 8654342
  misc_feature: Encodes the peptide sequence at SEQ ID NO. 2083
atggcggcgagtggcaagctctcggcgaagccctccccgtcgccgacggtcgctcccgcctcgcgccccaaattcacagccgttaccttcctcggtgactgtgacgacgacgacgacttccaacctcctcgcccccgcccattgaagccttgcaatggcgccgccgcacttcggctccgcaagaagctcaaggcttcatcctcctccgcttcctccgggaaggagaacagttccgccgccggtggtgccgttgctgcggtggggatcgcctcgacagccgcgaaggatgccggaaccctagccacctgctcaagggttagtggcggcgttcccaaatcgaagaaacgaaaggccggagaaatttgcggcctctcgaggtacggatctgatagcaccaaactaagttgtaaaccgaagataggattggatagatatggatatggcaaagggagctccagttccttgcccaattcgttagaatcgagggttttggcgctcggtgcggtatgtgatttgggagttgggcgctgtgaggtggctcaagtagctggtaccttagttcttgaggaggggcacgccacagaggagctggctggctctgagtgtgatcctccaaaaacggagaagaagctgggcagttctggagctgtagagggacattatgactccaggttgattgaaccggggcttattgaatcagatgcaaaccgggagtctgtaactgcttgttcatatgattcagaagtgcttgattcagggattcttggctcactgactgataaacaggacacgaagaaagcaaacggggtggcatctgaatgtggttttgggcttcagaacgggaactatcacttgcattctctacagtcagagctcctaatgtcgaacgcaaagtatgattctagggtttttgctagcaatgaaatccaagagcctggtttgggagctggtaacttgatttcacaagagaggaacgtagcagcaggacattctgcatgtacaacccctgaaaatgtgactatggagaataaatcaagtgagcatgaggcttgtaaggggaagtgccgctctaattcatctgaatcaaagcttcaagaatcccatatgatccatgactttgaagttgatggttgtgatgatttcgagattgggacacagctcagtgagctcattaacttgtgtatgaaggattccatagagggacagttaaactttagtgcatctcccatggaacagaacacattggattctaagcgactcggttcagactatgaagtgaaatgccctctctgtggatcggatatatctgatttaagcgaggagctccggcagctgcatactaacaattgtcttgacgaaccagctaagaagctcaaaaatattgctgcttttgtgttgatcctctacttgatggaatctagtcccaaccataaaaaagagccctgtgctggacaaaatgttgaaactggacgtgttgtcgaatggttaagaaaccttgggttatccaagtatgaggaggtttttatcagagaagaagttgactgggaaaccttgcagtggctcactgaagaggatctgttgggtatcgggatcacctctcttggaccaagaaagaaaattatccatgctctaggagagttacggaagaaacatgacgatccctgtgaagtggaagatgtcgtgttaaattcagaaaatactaagaagactaaacttccgatgaatggtaataaattaattactgaatactttcaatgttcctcatttgatcaaagacaaagaagggtatgcaaagtcaacaagccatctaatctgaacgagaagaaaatttctagtgctaaaatacccactagaagaagtgctggtaaaggaaaggttaaagatacacctctttggtgttgcatcccagggaccccttttcgagtggatgcatttcgctacttgagaggcgattgttcccactggtttctcacacacttccatgtggatcattatcaaggcttgactagaagcttttgtcatgggaagatatactgttcgtcaattacagcaagtcttgtgcatcataagattggtatcccatgggatagattgcatgtattgaccctaaatgaaaagctcactattggtggagttagtttgacatgttttgatgccaatcattgccctggatcaatcattattctctttgagcctcccaacggtaaagctgttttgcacaccggagacttccggttttcttccgagatggccaacaatcctgttttgcagtcttctcatatccacactctaatacttgacacaacctattgcaatccacggtatgacttcccaagtcaagagattgtaatacagttcgttatcgaggccatccaagcagaagctttcaatccaaaaacattgtttttgattggtagctacacaattggaaaagaaagactgtttatggaggttgctcgtttgcttcagaagaaaatatatgttggagctgcaaagctgcaaatattgaaacatttagagcttcctcaggagattatgcactggtttacagccaatgaagcagaaagtcacatacatgttgtccccatgtggactctagcaagcttcaagcggatgaaatatttatcaaatcaatatgccggccagtttgacctcatagtggcgttttgtcctactggttgggcatttggcaaaggtaggaaaaagacaccaggcaaaaggtggcaacaaggatcaatcatcagatacgaagtgccctacagtgaacacagcagtttcacggaactgcaagaatttgtcaagttcatatcaccagagcacataatccctagtgtgaacaacgatggccctgagagtgcagatgctatgcttgcccagctgttaaacgagtag

SEQ ID NO: 2083 - protein, 963 aa, Sorghum bicolor
  misc_feature: Ceres Annot ID no. 8654342
  misc_feature (1)..(963): Bit score of 1471.0 for HMM based on sequences of FIGURE 20.
  misc_feature (848)..(946): Pfam Name: DRMBL Pfam Description: DNA repair metallo-beta-lactamase
  misc_feature (485)..(548): Pfam Name: SAM_1 Pfam Description: SAM domain (Sterile alpha motif)
  misc_feature: Functional Homolog Of SEQ ID NO. 1635
MAASGKLSAKPSPSPTVAPASRPKFTAVTFLGDCDDDDDFQPPRPRPLKPCNGAAALRLRKKLKASSSSASSGKENSSAAGGAVAAVGIASTAAKDAGTLATCSRVSGGVPKSKKRKAGEICGLSRYGSDSTKLSCKPKIGLDRYGYGKGSSSSLPNSLESRVLALGAVCDLGVGRCEVAQVAGTLVLEEGHATEELAGSECDPPKTEKKLGSSGAVEGHYDSRLIEPGLIESDANRESVTACSYDSEVLDSGILGSLTDKQDTKKANGVASECGFGLQNGNYHLHSLQSELLMSNAKYDSRVFASNEIQEPGLGAGNLISQERNVAAGHSACTTPENVTMENKSSEHEACKGKCRSNSSESKLQESHMIHDFEVDGCDDFEIGTQLSELINLCMKDSIEGQLNFSASPMEQNTLDSKRLGSDYEVKCPLCGSDISDLSEELRQLHTNNCLDEPAKKLKNIAAFVLILYLMESSPNHKKEPCAGQNVETGRVVEWLRNLGLSKYEEVFIREEVDWETLQWLTEEDLLGIGITSLGPRKKIIHALGELRKKHDDPCEVEDVVLNSENTKKTKLPMNGNKLITEYFQCSSFDQRQRRVCKVNKPSNLNEKKISSAKIPTRRSAGKGKVKDTPLWCCIPGTPFRVDAFRYLRGDCSHWFLTHFHVDHYQGLTRSFCHGKIYCSSITASLVHHKIGIPWDRLHVLTLNEKLTIGGVSLTCFDANHCPGSIIILFEPPNGKAVLHTGDFRFSSEMANNPVLQSSHIHTLILDTTYCNPRYDFPSQEIVIQFVIEAIQAEAFNPKTLFLIGSYTIGKERLFMEVARLLQKKIYVGAAKLQILKHLELPQEIMHWFTANEAESHIHVVPMWTLASFKRMKYLSNQYAGQFDLIVAFCPTGWAFGKGRKKTPGKRWQQGSIIRYEVPYSEHSSFTELQEFVKFISPEHIIPSVNNDGPESADAMLAQLLNE

SEQ ID NO: 2084 - protein, 693 aa, Vitis vinifera
  misc_feature: Public GI ID no. 157339371
  misc_feature (1)..(693): Bit score of 1165.3 for HMM based on sequences of FIGURE 20.
  misc_feature (579)..(677): Pfam Name: DRMBL Pfam Description: DNA repair metallo-beta-lactamase
  misc_feature (214)..(277): Pfam Name: SAM_1 Pfam Description: SAM domain (Sterile alpha motif)
  misc_feature: Functional Homolog Of SEQ ID NO. 1635
MSDDDDFQEIPLTQATQQPLKPSDSSRRPSKRPKAAATAAPGKENVPPSRKKRDCSEREELKSKGSYLCDSIESRLLNARSGGDGNITCGFSEESEGSYSCNSVESRLLKSRSGGDGDGNGGFCEESDEDFEQLDVLIRLCSEGEEEPDSDGFRFREQRGSGSEGRGLVRCPLCEIDISDLNDELRQVHTNGCLDRLEADNPFNDGSPVQTHQKVVDVSPVIGWIHSLGLGRYEEAFIREEIDWDTLQRLTEEDLLNIGVTALGPRKRIVHALSELRKGSTHTVDIHTHVPALSELRKQSTHGLAANKLITDYFPGSVTDRSRGCISSGERKAAEKIQLGSSRKQVVVKNHARSGKLRDLPLWCCIPGTPFRVDAFRYLRRDCSHWFLTHFHLDHYQGLTRSFCHGKIYCSAITARLVNMKIGIPWDRLQILPLNQKINIDGVDVTCLDANHCPGSIIILFEPSNGKAVLHTGDFRFSEEMTSMSVLQMCPIHTLILDTTYCNPQYDFPKQEAVIQFVIDAIQAEAFNPRTLFLIGSYTIGRERLFLEVARVLRKKVYVNAAKLHILECLEFQKEDMQWFTLNEQESHIHVVPMWTLASFKRLKHISNQYAGRFSLIVAFSPTGWTFGKGKKKTPGRRWQQGTIIRYEVPYSEHSSFTELREFVKFVSPVNIIPSVNNHGSESVDTMVRLLSS

SEQ ID NO: 2085 - protein, 530 aa, Physcomitrella patens subsp. patens
  misc_feature: Public GI ID no. 168035028
  misc_feature (1)..(530): Bit score of 620.1 for HMM based on sequences of FIGURE 20.
  misc_feature (410)..(511): Pfam Name: DRMBL Pfam Description: DNA repair metallo-beta-lactamase
  misc_feature (54)..(117): Pfam Name: SAM_1 Pfam Description: SAM domain (Sterile alpha motif)
  misc_feature: Functional Homolog Of SEQ ID NO. 1635
MNLNLECPVCQICIGGLSTAQREEHTNACLDKCKEEELGEVSEFAEAAMGQAAGRPDMAPVVTWLTNLNLAKYVDIFVKEEIDWDTLKWLTEEDLNSLGISALGPRRKILSAINELRNVPSTSQHMTAIKEGQKLSDSALPRRVPAPDNHTLAGPKASGNASTTEMPWRNTNPRRAISAVRNSRAIGTSGIPTWMCIPGTSFRVDAFKHTTGNCSNWFLTHFHTDHYQGLTRGFRHGKIFCSSITARLISLRIGVPLDRIQALPLNETVLIDGVRVTFIDANHCPGSVMILFEPPNGEVVLHTGDFRYYSDMASNDVLRKCRITTLILDTTYCDPQHDFPKQDSVIQFVIDAIQAEAFNPKTLFLIGTYTIGKEKLFLEVGKALQKYVYVGSAKQRLLDCMDLTEEDKRWLTTKDQESHIHVVPLWSVASFKRMGSISRHYHGRYDSIVAFSPTGCSFGKDKKRVQGRPGRRYQQGSIIRYEVPYSEHSSFTELKEFVRFIGSENIIPSVISSTGPTADAMVATLLNEES

SEQ ID NO: 2086 - DNA, 819 bp, Solanum lycopersicum
  misc_feature: Ceres Annot ID no. 8455967
  misc_feature: Encodes the peptide sequence at SEQ ID NO. 2087
atggatcccaaacaggctaaccacaacaatattaagcctactcatgatcagataaaagagttgcagattttgaaaaatgatgaaacgaacaaggtggctgctcccaaaagaaaagataggcatacaaaagttgaaggtagagggaggagaatacgtatgccggcgctctgtgcagcaagaatcttccagcttacgcgcgaattgggtcataaatctgatggtgagacaattcagtggctgctgcagcaagccgagccttcgattattgctgctactggcacagggacaatacctgcctcggctttagctgcagcagcctctgtttctcaacaggggatctctgtatcagctggtttaatgattgaatcgggggcgaatatcgcggggtctggtagcagtagaagtagtaatagtaggaccaattggccaatgatctgtgggaattttggaagaccccatttggctacagcaggaatgtggcctgcccctgcccctgttgtcactagttttgggtttcaatcctcatctgctccatcaagcgcgagtttaggtagtgatagttcaaattattacttacagaaaattgggtttcctggatttgatctgcctgcagctacaagtatgaatccgatgtgttttacttcaattcttggtggaagtaatcagcaactgccaggattggaactgggattatctcaagagggtcatttaggggttttgaaccagatataccagcaggcaagaatgcaacatccgcagcagcaacatcaacaacaacaacaatctccggaggaggattctcaaggatcaggacattaa

SEQ ID NO: 2087 - protein, 272 aa, Solanum lycopersicum
  misc_feature: Ceres Annot ID no. 8455967
  misc_feature (1)..(272): Bit score of 120.5 for HMM based on sequences of FIGURE 14.
  misc_feature (27)..(201): Pfam Name: TCP Pfam Description: TCP family transcription factor
  misc_feature: Functional Homolog Of SEQ ID NO. 1151
MDPKQANHNNIKPTHDQIKELQILKNDETNKVAAPKRKDRHTKVEGRGRRIRMPALCAARIFQLTRELGHKSDGETIQWLLQQAEPSIIAATGTGTIPASALAAAASVSQQGISVSAGLMIESGANIAGSGSSRSSNSRTNWPMICGNFGRPHLATAGMWPAPAPVVTSFGFQSSSAPSSASLGSDSSNYYLQKIGFPGFDLPAATSMNPMCFTSILGGSNQQLPGLELGLSQEGHLGVLNQIYQQARMQHPQQQHQQQQQSPEEDSQGSGH

SEQ ID NO: 2088 - DNA, 990 bp, Solanum lycopersicum
  misc_feature: Ceres Annot ID no. 8458734
  misc_feature: Encodes the peptide sequence at SEQ ID NO. 2089
atggaaactggccatcatcatcatgataatattggaaactccattcaaagactaaatttccccttacaattgttagaaaaaagagatgaagtagatcatacaacaacaatatgttcatcatcattacaacttcatccttataatcctacttctttacacatgatgactacctcaagtagtgatgcaccttgtgttaatcataaccaaaaatcaaaaactcatcaagacaagaaacaacaaccacaacaaacaaaaaaaccaacaacaacaaaggatagacatactaaggttgatggtcgcggtcgaagaattcgaatgccagcaacatgtgcagctagggtttttcaacttactagagaattaggtcacaaatctgatggtgaaaccattgaatggctattacaacaagctgaacctgctgttattgctgctactggtactggtactattccagctaattattcatcacttaatatttctttaagaagttctagacatcatagtgctagtaactacctagcacataatcataataatttcggtcatgtttatcatgaccgaaattattttaacggggttggtttattttcgtcagaaaataattcatttttccctagtgggaatttgaacatgttacaagcaaaggaggagttatgtgatgatcacgatgataatgataatgataatgataataatactggacggattaagcggagtcatcatcatgaccttaataattgttctatgtggggatcttctagtaataataatgatagtattgagaattcaaatattagaggagggatattgaattttatgaattttcatcaaccaattttggggacacgtggcgatggcggtgggacggcggcggaagggcaatgggggatgttgacggcggcgatgaattcgtatagacaaagtggtggtcatgctagtggttcttctaatcaacgtaatgaaggagatgatcatcaacatcattcttga

SEQ ID NO: 2089 - protein, 329 aa, Solanum lycopersicum
  misc_feature: Ceres Annot ID no. 8458734
  misc_feature (1)..(329): Bit score of 441.7 for HMM based on sequences of FIGURE 14.
  misc_feature (75)..(256): Pfam Name: TCP Pfam Description: TCP family transcription factor
  misc_feature: Functional Homolog Of SEQ ID NO. 1151
METGHHHHDNIGNSIQRLNFPLQLLEKRDEVDHTTTICSSSLQLHPYNPTSLHMMTTSSSDAPCVNHNQKSKTHQDKKQQPQQTKKPTTTKDRHTKVDGRGRRIRMPATCAARVFQLTRELGHKSDGETIEWLLQQAEPAVIAATGTGTIPANYSSLNISLRSSRHHSASNYLAHNHNNFGHVYHDRNYFNGVGLFSSENNSFFPSGNLNMLQAKEELCDDHDDNDNDNDNNTGRIKRSHHHDLNNCSMWGSSSNNNDSIENSNIRGGILNFMNFHQPILGTRGDGGGTAAEGQWGMLTAAMNSYRQSGGHASGSSNQRNEGDDHQHHS

SEQ ID NO: 2090 - DNA, 978 bp, Solanum lycopersicum
  misc_feature: Ceres Annot ID no. 8461366
  misc_feature: Encodes the peptide sequence at SEQ ID NO. 2091
atggaatttagagagtcaaatagcaaaaacaaccaagatggtgggagtaatagcaataataatagtaatgaaaataatagcaatgtgatttctactaaaattgttaagaagccatcgaaagaccgtcacaccaaggtggatggtcgagggcggcgcattcgaatgccggctttatgcgccgccagggtttttcagctaaccaaagaattgggtcataagtcggatggcgaaaccatagagtggctattgcaacaagctgaaccgtcgattatagctgcgacgggaacaggtacaattccggctaatttctcaactcttaatgtctctttacgcagcagcgggactacaatttcagctccgccgtcgaaatctgcgccgcttttcattcacggcggtgctgccactatgctgggtttccaccaccagattccgggcaacagttttgggcaagacccagatgagaatttcatgaagaagaggtatagagaagatacaactgcagcatcaacttcaccatcgtcatcatcagctaaaccggaaagaaccggagttcaaggtcacgaaccggatcaagaatcgaaacccggttcatcgaatccctctagctacataccgactcccgccatgtgggctgttggtccggcggccggtaacgtcggaaacacgttctggatgctaccaggtacctcatcaaccatgcagagaattggtggtttcgagttaccgggaggtggccggttcagtccggttcaactaggatcaatgtttttgcagcagccacagccggttcagcagctggggttgggtgtgacagagacaaatatgggaatgttggcatcgatgaatgcatataacagtagtagtagtaggggtagtgggattgatttggggatgaatttggaacaacatcatcatcatcaaaatcagcctcaaggtagtgacagtggtgatgaaaatcacaaagattcccaatcataa

SEQ ID NO: 2091 - protein, 325 aa, Solanum lycopersicum
  misc_feature: Ceres Annot ID no. 8461366
  misc_feature (1)..(325): Bit score of 403.5 for HMM based on sequences of FIGURE 14.
  misc_feature (24)..(265): Pfam Name: TCP Pfam Description: TCP family transcription factor
  misc_feature: Functional Homolog Of SEQ ID NO. 1151
MEFRESNSKNNQDGGSNSNNNSNENNSNVISTKIVKKPSKDRHTKVDGRGRRIRMPALCAARVFQLTKELGHKSDGETIEWLLQQAEPSIIAATGTGTIPANFSTLNVSLRSSGTTISAPPSKSAPLFIHGGAATMLGFHHQIPGNSFGQDPDENFMKKRYREDTTAASTSPSSSSAKPERTGVQGHEPDQESKPGSSNPSSYIPTPAMWAVGPAAGNVGNTFWMLPGTSSTMQRIGGFELPGGGRFSPVQLGSMFLQQPQPVQQLGLGVTETNMGMLASMNAYNSSSSRGSGIDLGMNLEQHHHHQNQPQGSDSGDENHKDSQS

SEQ ID NO: 2092 - DNA, 1278 bp, Sorghum bicolor
  misc_feature: Ceres Annot ID no. 8683537
  misc_feature: Encodes the peptide sequence at SEQ ID NO. 2093
atggacgcgccgtcgagcagcacgagcacgagcaccaacagcagccggagcgcctccgagcagcaccaccagcagcagcagcagaaccgccaccaccaccaccagcagcagcagcaggcggtggcgcaccacccgttctactacgccgcagcagcaaacgcggccgggatggcgccgttcatggggtcgctggccatcgcgcccgccgccgccgggggcggcgcgggggaggtgcagcagctggcgcagcagtcggcggcggcgcctgcagcaggatcgtccggcggcggtggcgctgctgctgccgcggcggacaagaagaacaaggcggccgtggccgtggtgcctgcggcgggggccgggagcggcagcaagcggcccaccaaggaccggcacaccaaggtggagggccgcgggcggcggatacggatgccggcgctgtgcgcggcgcgggtgttccagctcacgcgggagctgggccacaagacggacggcgagaccatcgagtggctgctgcagcaggcggagcccgccatcgtggccgccacggggaccggcaccatcccggccaacttctcctcgctcgccgtctccctccgctccggagcctcgcacccgtcctccgcgtcccgcgccgccgccgccgcggccttccaccacctcccgccggcgcaggcgcagcacgaggtcgccgccatgctcggcgcctggaaccaccatcaccagcagcagcagcagcttctctcaccgcctccgcaccaccaccaccagcaggcgccgcaagatcccggcgctggggagttcatgaggaagcgctacagggatggcgccgacgacctgttcaaggaccccgcggcgcgccagcagcagcagcatcatcccgacgacggcggcggcggcggcgagggggacgccgaggaccacaaggcccgcgtgacgccagccactgcaatgtgggctctggcgcccaacagcgccggtggcggcgccttctggatgcagcccacgtgggcgttcggtggcggcggcggcggcggcgggagcacggtgcaggcgccgctccagttcatgtcaacaagcagaagcggcaacaacttccccgccgggacgaccatggacgccaacatcggcatgctcgccgcgctcaacaacgccagcagcggcggcgtccagcaccagcagccggacgaggggcagcagccgccggagatgccccagcgccaccgcggcgcgaacggcggcgacgccgggcgtggcgccgcgagcccccagcagtaa

SEQ ID NO: 2093 - protein, 425 aa, Sorghum bicolor
  misc_feature: Ceres Annot ID no. 8683537
  misc_feature (1)..(425): Bit score of 223.3 for HMM based on sequences of FIGURE 14.
  misc_feature (121)..(302): Pfam Name: TCP Pfam Description: TCP family transcription factor
  misc_feature: Functional Homolog Of SEQ ID NO. 1151
MDAPSSSTSTSTNSSRSASEQHHQQQQQNRHHHHQQQQQAVAHHPFYYAAAANAAGMAPFMGSLAIAPAAAGGGAGEVQQLAQQSAAAPAAGSSGGGGAAAAAADKKNKAAVAVVPAAGAGSGSKRPTKDRHTKVEGRGRRIRMPALCAARVFQLTRELGHKTDGETIEWLLQQAEPAIVAATGTGTIPANFSSLAVSLRSGASHPSSASRAAAAAAFHHLPPAQAQHEVAAMLGAWNHHHQQQQQLLSPPPHHHHQQAPQDPGAGEFMRKRYRDGADDLFKDPAARQQQQHHPDDGGGGGEGDAEDHKARVTPATAMWALAPNSAGGGAFWMQPTWAFGGGGGGGGSTVQAPLQFMSTSRSGNNFPAGTTMDANIGMLAALNNASSGGVQHQQPDEGQQPPEMPQRHRGANGGDAGRGAASPQQ

SEQ ID NO: 2094 - DNA, 892 bp, Gossypium hirsutum
  misc_feature: Ceres Clone ID no. 100038893
  misc_feature: Encodes the peptide sequence at SEQ ID NO. 2095
gggaattccaagctacacaacacaacatcatatagcaaaaatgaaggagacccactaggccatcaaagtcactgaattgagggtcaccttcagatcatgtactaggagagccaaaccaccaaaaagatataatcccactctctcatacatgatcatggatgaaaatgggatccgcaggccgaactttcctcttcagctcctagaaaagaaggaacaacctcgttccgaccctgccgacgtcgacaccagctccaaaccaaccttggaacctccctccaagaaacctccacctaagaggacttcgaccaaggaccggcacaccaaagtggaaggccgaggccgtcgcatccgcatgccggctacgtgtgctgctagggttttccagctaacaagggagcttggtcacaaatcagatggtgaaaccattgagtggttgctccaacaagctgagcctgcggtttttgctgccacggggacaggtactatccctgcaaatttcacgtcccttaatatttcactaagaagttcaggttctagcatgtcggcttcatacttgaggaacacatatttcaatccaaattttaccacacaaaaattgaggacggggagtgaatgggatcaaaggaatgtccttgacgattcatctcaacaacaacaacagcaacgaagggttttatttcctggtgttgctttatcatctgaagattcattgaactttcctggtactagtagcactactttgaacgcgttcttgcaagctaagcaagagattcgggacgccgagtccgcggatactagtatagggaagaggaggccggagcagcaagaatcgccacaaaatcagggtgggaagttacttgatacaatctaatacgggttcgattccgacaag

SEQ ID NO: 2095 - protein, 240 aa, Gossypium hirsutum
  misc_feature: Ceres Clone ID no. 100038893
  misc_feature (1)..(240): Bit score of 213.5 for HMM based on sequences of FIGURE 14.
  misc_feature (43)..(222): Pfam Name: TCP Pfam Description: TCP family transcription factor
  misc_feature: Functional Homolog Of SEQ ID NO. 1151
MIMDENGIRRPNFPLQLLEKKEQPRSDPADVDTSSKPTLEPPSKKPPPKRTSTKDRHTKVEGRGRRIRMPATCAARVFQLTRELGHKSDGETIEWLLQQAEPAVFAATGTGTIPANFTSLNISLRSSGSSMSASYLRNTYFNPNFTTQKLRTGSEWDQRNVLDDSSQQQQQQRRVLFPGVALSSEDSLNFPGTSSTTLNAFLQAKQEIRDAESADTSIGKRRPEQQESPQNQGGKLLDTI

SEQ ID NO: 2096 - DNA, 875 bp, Gossypium hirsutum
  misc_feature: Ceres Clone ID no. 100041554
  misc_feature: Encodes the peptide sequence at SEQ ID NO. 2097
cagccaatcttttcagcttaaccccccccccaaaaaaaaaagaaaaagaaaaaaactaagtgagaacattttcagtgagcctagttgaaattgtatacagttttggggttttgtttggtgccgcatgtcaaattcagaggctgctgctaaaaacggagcaacaatggatacccagagacaacaagcgccggggaacggtgcccttgccgtcaagaaacctccctccaaagaccgtcacagtaaagtagacggtcgtggacggaggataaggatgcccatcatttgcgccgctcgtgttttccagttgactcgcgagttgggtcataagtccgacggtcagaccatcgagtggctgttacgccaggccgagccttccatcatagccgctacaggtacggggacgactccagccagcttctccacagtgtcagtttccgtccgcggcggagccaattccacttctttgccgtcaacgacttcttcgtcgttggattataagcctttgttgggttccaccccttttttactcggaaaacgtgtccggcccgacgacgataacgccgggaaggacgattccagaggggccacggtgggaccgggcgtggggtctatcgtggggcccgctggaacggacacgggtgcgttctgggctgttccagctaggcctgactttggtcaaatatggagcttcgcgcccccgcctcctcccgagatggtggtacaaacagcggctcagcaaccagctgcagctgcgtttttcgttcagcaacagcaagcgatgggtgaagcgtcggcggcgagggttggcaattatcttcccggtcatctgaatttgttagcctccttgtcgggtgctccgggaggttcgggtcaaa

SEQ ID NO: 2097 - protein, 250 aa, Gossypium hirsutum
  misc_feature: Ceres Clone ID no. 100041554
  misc_feature (1)..(250): Bit score of 250.9 for HMM based on sequences of FIGURE 14.
  misc_feature (18)..(233): Pfam Name: TCP Pfam Description: TCP family transcription factor
  misc_feature: Functional Homolog Of SEQ ID NO. 1151
MSNSEAAAKNGATMDTQRQQAPGNGALAVKKPPSKDRHSKVDGRGRRIRMPIICAARVFQLTRELGHKSDGQTIEWLLRQAEPSIIAATGTGTTPASFSTVSVSVRGGANSTSLPSTTSSSLDYKPLLGSTPFLLGKRVRPDDDNAGKDDSRGATVGPGVGSIVGPAGTDTGAFWAVPARPDFGQIWSFAPPPPPEMVVQTAAQQPAAAAFFVQQQQAMGEASAARVGNYLPGHLNLLASLSGAPGGSGQ

SEQ ID NO: 2098 - DNA, 726 bp, Zea mays
  misc_feature: Ceres Clone ID no. 100759169
  misc_feature: Encodes the peptide sequence at SEQ ID NO. 2099
caagcaccacaagcgcaagccctcgcttccttgacctcactctttcgctctcactagctctaacgccgccgtcgactcgacggcgctgccgaacctctactgcgtactgccccacgtcatcacaccaaatcaggttagcagacccacaagaacagttcgtgggtcagcaaatccattcctaggaccgatattcctccagctccctgaacaggaaaaaaacacatctttgtgtgtatttataccatggtctaatcggctatggacgccaccggagatgccggcggaggtcgccgccccaacttccctttgcagcttctggagaagaaggaggaacagccttgctccacgtccccagcagctgctgtgggtgctggggctaatgggtcgggagagatgcagatgaagaaggtggcgccgccgaaacgcacatcgagcaaggaccggcacacgaaggtggacgggcgcgggcggcgcatccggatgccggcaatctgcgcagctcgggtgttccagctgacgagggagctggggcacaggacggacggcgagacaatcgagtggctgctgcagcaggcggagcccgcggtgatcgcggccacgggcaccggcaccatcccggccaacttcacctcgctcaacatttctctccgctcctcgggctcctccttctccatcccagcgcacctccgtgctgccggtttgcccggcccacgcttcagcggcgcg

SEQ ID NO: 2099 - protein, 156 aa, Zea mays
  misc_feature: Ceres Clone ID no. 100759169
  misc_feature (1)..(156): Bit score of 132.9 for HMM based on sequences of FIGURE 14.
  misc_feature (46)..(154): Pfam Name: TCP Pfam Description: TCP family transcription factor
  misc_feature: Functional Homolog Of SEQ ID NO. 1151
MDATGDAGGGRRPNFPLQLLEKKEEQPCSTSPAAAVGAGANGSGEMQMKKVAPPKRTSSKDRHTKVDGRGRRIRMPAICAARVFQLTRELGHRTDGETIEWLLQQAEPAVIAATGTGTIPANFTSLNISLRSSGSSFSIPAHLRAAGLPGPRFSGA

SEQ ID NO: 2100 - DNA, 1301 bp, Arabidopsis thaliana
  misc_feature: Ceres Clone ID no. 156994
  misc_feature: Encodes the peptide sequence at SEQ ID NO. 2101
aaggaccatattataacctctctatctctctctaagtatcagcaaaaaaacagagatttatatagagagaaaaaaaactatggctcacataaagatctaacagagacagtagtatagtcccacttccccaccaccaaagcttcgatcatcatcatcatcatcatcatggatccggatccggatcataaccatcgacccaacttccctctccagcttcttgattcttctacctcctcctcttccacttccttagccatcatctctactacttccgaacctaactccgaacctaagaagcctcctcctaaacgaacctctactaaagaccgacacaccaaagtcgaaggccgaggccgtcggatccgtatgcctgccatgtgtgctgcacgtgtctttcagctcacacgtgagcttggtcacaaatccgacggtgaaactattgagtggctactccaacaagcagaaccagcggttatagccgctacagggactggaaccattccggctaacttcacttctttaaacatctcacttcgtagctcaagatcttctctctctgctgctcatcttcgtacaactcctagtagctattactttcattcaccacatcagtccatgactcatcatcttcaacatcagcatcaggttcgtcccaagaacgagtcacattcttcgtcttcttcttcttcacagcttttagatcacaaccaaatgggtaactatctagtacaatcaactgctggatctttacctacgagtcagagtcctgcaacggcaccgttttggagtagtggtgacaacacacagaatctttgggcttttaatattaatcctcatcattccggtgttgtcgccggagatgtttacaaccccaacagtggtggtagtggcggcggtagtggagttcatttgatgaattttgcagctcctattgctttgttttctggacagcctttggcttctggttatggagtatgaagtgggtttgtctgcagatgttgagctgtggttgtttgatgatcacgttggtcgccggagttggctccatcgccggagtaatgctagaccttaaggtttacaagccgttcaagactacttactaaacaaaccatgatgatgatgaagaagaagaaggtggtggagaaaaaaacaaaagatataaattttaatatatttcatttggggaaatgtgaataatgtaaaagttcttcgtttcgtataatttttatcttgcgtaatttatatacataatgtgttctcaatctataattgatgtggtgtttattgaaagtttgttaacc

SEQ ID NO: 2101 - protein, 270 aa, Arabidopsis thaliana
  misc_feature: Ceres Clone ID no. 156994
  misc_feature (1)..(270): Bit score of 279.4 for HMM based on sequences of FIGURE 14.
  misc_feature (41)..(228): Pfam Name: TCP Pfam Description: TCP family transcription factor
  misc_feature: Functional Homolog Of SEQ ID NO. 1151
MDPDPDHNHRPNFPLQLLDSSTSSSSTSLAIISTTSEPNSEPKKPPPKRTSTKDRHTKVEGRGRRIRMPAMCAARVFQLTRELGHKSDGETIEWLLQQAEPAVIAATGTGTIPANFTSLNISLRSSRSSLSAAHLRTTPSSYYFHSPHQSMTHHLQHQHQVRPKNESHSSSSSSSQLLDHNQMGNYLVQSTAGSLPTSQSPATAPFWSSGDNTQNLWAFNINPHHSGVVAGDVYNPNSGGSGGGSGVHLMNFAAPIALFSGQPLASGYGV

SEQ ID NO: 2102 - DNA, 1214 bp, Parthenium argentatum
  misc_feature: Ceres Clone ID no. 1604759
  misc_feature: Encodes the peptide sequence at SEQ ID NO. 2103
gacccctgttctcctctcctctcctccctccctctccctccttcaccagttcattccattcacttacccccctaaaccctatctcctctcctccactcacccttacaccatgtcatcatccgaagcccccactaacgccgttcctaactcagctaacgccgtcaccaataacagtaacggcgttttatccgttaaaaaacctccagctaaagaccgtcacagcaaggtcgacggacgtggccgtcgtatacgcatgccgatcatctgtgccgctagggtttttcagctcactcgtgagctaggtcacaagtccgacggtcaaactatcgagtggctcctccgtcaagctgagccgtcgattatcgccgccactggtaccggaactactccggctagcttctccactgtttcagttgtacggaattcgaactcgtctctctctgtagcgcttgaccagaaatcaccgtcgcatcaccaccacttaatctctccggctccgtttatcctcgggaaacgtctccggcctgaagacgacggtctcgacggaggagcaaaagacgataataatcataacagtcataacatgtcttcggctgttaacggcggaggaggaggaggaggaggattttgggcggtacaagggagaccggatttcggacaggtgtggagctttgcagcggcggcgccggagacggtggtggctccggcgaacgtgatggcggcacaacagaggtttatccagcagcagccgatgggagaggcgtcggcggctagggttgggaattatctaccgataactcatggacatttgaatttgcttgcgtcactttccggtccgccgccacagtcgtcgaacaaggatgacgataaccgttgacttgttgaccgcctataatgttcaaatgtggttcgtattggaggaatctggtgaagaagtctatatctacagggaaggttaatactctgctgcaacaatgatgaaaacaagtgaaattaatatggttttgttgctctgttttgaattcaatacggcctgaaactactgctgttggtggggttgctatcaatttgtgatccctcttattgttagattaatttgtgtgtgtgtgtggaaaataatgtaaacgttcgtcggtggtcgtcgtcgttgttatgtaagtgagattttttttcagggtgcgaataataagaaccatatgtatcgtggttttttg

SEQ ID NO: 2103 - protein, 255 aa, Parthenium argentatum
  misc_feature: Ceres Clone ID no. 1604759
  misc_feature (1)..(255): Bit score of 243.9 for HMM based on sequences of FIGURE 14.
  misc_feature (17)..(222): Pfam Name: TCP Pfam Description: TCP family transcription factor
  misc_feature: Functional Homolog Of SEQ ID NO. 1151
MSSSEAPTNAVPNSANAVTNNSNGVLSVKKPPAKDRHSKVDGRGRRIRMPIICAARVFQLTRELGHKSDGQTIEWLLRQAEPSIIAATGTGTTPASFSTVSVVRNSNSSLSVALDQKSPSHHHHLISPAPFILGKRLRPEDDGLDGGAKDDNNHNSHNMSSAVNGGGGGGGGFWAVQGRPDFGQVWSFAAAAPETVVAPANVMAAQQRFIQQQPMGEASAARVGNYLPITHGHLNLLASLSGPPPQSSNKDDDNR

SEQ ID NO: 2104 - DNA, 1638 bp, Panicum virgatum
  misc_feature: Ceres Clone ID no. 1791783
  misc_feature: Encodes the peptide sequence at SEQ ID NO. 2105
atcaggctccctggccggtcagcatctccccatccgtcccccttgcccttcgtcttcgccttgttcttggcttcctcggggcagggaagggaagaggggaaggaggaggcgagaccctgatttgatctgcttgcttttggttgccgagaagaggagaggggttggtgcagttggaggcgtgcctctgtgtctgtgtgcgcggagatggaccccaagttccccacacccccaccgctaaacaaaacggagcctaccaccgcgacgaccaccaccaccacctcctcgaccgcgcagcagcagcatcagcagctggatcccaaggactaccagcatcagcagccggcgcagcaccaggagcagcaccaccaccacctgcaaatccaaatccgccagccgccacagcaggacgggggcggcggcggcgccaaggagcagcagctgcaggtggcggcgccggcaggggagcggaaggtggcgctcgcgcccaagcggagctccaacaaggaccgccacaccaaggtcgatggccggggccgccggatccggatgcccgcgctctgcgccgcgcggatcttccagctcaccagggagctcggccacaagtccaacggcgagacggtccagtggctgctgcagcaggccgagccggccatcgtcgccgccaccggcacgggcaccataccggcgtccgcgctcgcctccgtcgcgccctcgctcccgtcgcccaactcagggctcgccaggccgcaccaccaccacgcgccccacatgtgggcgccgcccaccgcttcagccggcttctcctcgccggccttcttgaattccgccggcgccggcgccggcgacgccgctggtatcggcggcctcatgcagcggatggggctccccgctggcctcgagatgcccgccgggggcgccgccggagggaccctcggcgccggcggccacatcggcttcgcgcccatgttcgccggacacgccatgccggggctcgagcttgggctctcgcaggatggccacatcggcgtgctcgcggcgcacgcgcagtcgatcagccagttctaccaccaggtcggagctgcgggggccagcggccagctgcagcaccagcatcaccatcaccagcagcaggaggacggtgaggacgaggacgctgagtccgatgaagagtccggccagtagtgtaaccgttcaaccttgcgtttctgggtggttccttgaagaggagaggagaggaaggagagaaaaagtgtatgcacgccgcacgcaggccacgggatgcttctgctactcttgggttattattgttcgtcgagttgtgatgaatttttatgttcatttttttcttgcgtgatatcaaactcaatggaggccttttgctctgaggacttgttggatcaagatcatcccatggttcttcccactattctgtggatgatcacccagagccctctctccgacttccaggtgtataatagctgaaagctggatgaattggatcaatcgcccttgagtgagtgccttatttgtcattgcaaagtgtgtagatattcaggtaattttgctgttagaggtgttctttttatcggagtgatgatccacttattaaaaacaattgaagtagtggccggcaatttg

SEQ ID NO: 2105 - protein, 325 aa, Panicum virgatum
  misc_feature: Ceres Clone ID no. 1791783
  misc_feature (1)..(325): Bit score of 110.4 for HMM based on sequences of FIGURE 14.
  misc_feature (87)..(231): Pfam Name: TCP Pfam Description: TCP family transcription factor
  misc_feature: Functional Homolog Of SEQ ID NO. 1151
MDPKFPTPPPLNKTEPTTATTTTTTSSTAQQQHQQLDPKDYQHQQPAQHQEQHHHHLQIQIRQPPQQDGGGGGAKEQQLQVAAPAGERKVALAPKRSSNKDRHTKVDGRGRRIRMPALCAARIFQLTRELGHKSNGETVQWLLQQAEPAIVAATGTGTIPASALASVAPSLPSPNSGLARPHHHHAPHMWAPPTASAGFSSPAFLNSAGAGAGDAAGIGGLMQRMGLPAGLEMPAGGAAGGTLGAGGHIGFAPMFAGHAMPGLELGLSQDGHIGVLAAHAQSISQFYHQVGAAGASGQLQHQHHHHQQQEDGEDEDAESDEESGQ

SEQ ID NO: 2106 - DNA, 1781 bp, Panicum virgatum
  misc_feature: Ceres Clone ID no. 1809997
  misc_feature: Encodes the peptide sequence at SEQ ID NO. 2107
actccatttaccccgctaaaaaccatacacgccaagatatatacttgtgtctgtgtatatataccatggcctaattcaccatggacgtcgccggtgatggcggaggcggccgccgccccaacttccctctgcagctcctcgagaagaaggaggagcagccgtgctccagctcggctgccgtgggcggcaacgccgggaatggatcgggggccgccggaggcgaggtgcaggtgcgcaaggcggcgcccaagcgcagctcgaccaaggaccggcacaccaaggtggaaggtagagggcgtcgcatccggatgccggctctgtgcgcggcgcgggtgttccagctgacgcgggagctgggccacaagacggacggcgagaccatcgagtggctgctgcagcaggccgagccggcggtgatcgcggccaccggcaccggcaccatcccggccaacttcacctccctcaacatctccctccgctcctcgggctcgtccttctccgccccggctcacctccgcacggccttgcctagccccgccaccgccgcccggttcggccgcgctgacgcgtgggaccgggttgtcggcctgggcttcccttcggagggcccggcctcgtcgtcatcgtcgccgtccccgttgttgctcaacttccactcgggcagcgtcggccttgacgtgcagccgtcgccgtctgccgccgccgcagccgccgacatctcaaggaagaggcggtgggaacaagaaatgcagcaggcccagcagcagcagcagcaggcgcagcaatatcagcagcagatggcggggtacacgcagagccaaatgccgggaaccgtgtggatggtaccgagcagcaacaacacgccgggtggggcgccttccggcggcggcggcagcggtggaggaggcggcggcgagtccatctggacgttcccgcagatgggcagcgccacggccgcggccgccgtgtaccgggggaacgtgccgagcgggctacatttcatgaacttctctgcaccggtggcgctgcttcccgggcagcagctggggctcggcaccgtggggagcggcggtggaggcggtggcgagggccacatggggatcctcgccgccctcaatgcgtaccggacacaggccgcgacggatcccgcggcaggccagggcggcggagcaagtaccggaggaggagggtccggccagcagcaacacggtggcggccgcggcggcgagcggcatgagagcatgagcaccagcgactcgtagccgacgggggtctccgaggatcgcatacatcgcacagctggtgtggctttgatctgttctttgtcttggtttcaattttttttcctttctttttttgtggtttccttcgtcctcctcctcctagctagacaccccctgcgaggattacgctcagctccattccatggcatgcgataggatcagccacgatcctaacgcgggctgtgcttgtgacctgtgtgagtgagagagcggggtgtgccatgggagagggaagaggagggaaacgcagaagcagcagcagcagagattgttcattttgttctttagttttagggtttgcattgatcaagtgcgagcagaagagatttttatcgagcatggcaccattcatccgccgtgatggttcattctttttccccatccaaacaagcagtgctagttgctagttcttcttccatcttgctgcagagacttgagtattagtagttggttgcttgattattgtgctaaaacaatcttttttaaattttagctagc

SEQ ID NO: 2107 - protein, 393 aa, Panicum virgatum
  misc_feature: Ceres Clone ID no. 1809997
  misc_feature (1)..(393): Bit score of 556.6 for HMM based on sequences of FIGURE 14.
  misc_feature (50)..(269): Pfam Name: TCP Pfam Description: TCP family transcription factor
  misc_feature: Functional Homolog Of SEQ ID NO. 1151
MDVAGDGGGGRRPNFPLQLLEKKEEQPCSSSAAVGGNAGNGSGAAGGEVQVRKAAPKRSSTKDRHTKVEGRGRRIRMPALCAARVFQLTRELGHKTDGETIEWLLQQAEPAVIAATGTGTIPANFTSLNISLRSSGSSFSAPAHLRTALPSPATAARFGRADAWDRVVGLGFPSEGPASSSSSPSPLLLNFHSGSVGLDVQPSPSAAAAAADISRKRRWEQEMQQAQQQQQQAQQYQQQMAGYTQSQMPGTVWMVPSSNNTPGGAPSGGGGSGGGGGGESIWTFPQMGSATAAAAVYRGNVPSGLHFMNFSAPVALLPGQQLGLGTVGSGGGGGGEGHMGILAALNAYRTQAATDPAAGQGGGASTGGGGSGQQQHGGGRGGERHESMSTSDS

SEQ ID NO: 2108 - DNA, 1712 bp, Zea mays
  misc_feature: Ceres Clone ID no. 376567
  misc_feature: Encodes the peptide sequence at SEQ ID NO. 2109
tagattttcttattcgccccttctctctccttctattttcagagagtcccctcgcctctgcctgcctgtcccatccccagtccaccaagcagcgcccgtcaccatctctccccatcccctttgccactctcggtcttctccctcctcagggcaggcaggggaagcagaagaaggaagcgagagcacggagcctgatttggtttgctttttgttgcccagactcggagggagttggtgtctctgtgtgtgtggagatggaccccaagttccccccacccccaccgctaaacaaaacggagcccaccaccgcgacgaccaccaccacctcgaccgcgcagcagcagcagcagctggatcctaaggactaccaccagcagcagccggcgcagcaccaggagcaccaccaccacctgcaaatccaaactcaccagccgccgcagcaggacgggggcggcggagggaaggagcagcagcagctgcaggtggtggcgcagcccggggagaggaggcagcaggcgctcgcgcccaagcggagctccaacaaggaccgacacaccaaggtcgacggcaggggccggcggatccggatgcccgcgctctgcgccgcgcggatcttccagctcacgcgggaactcggccacaagtccgacggcgagaccgtccagtggctgctgcagcaggccgagccggccatcgtcgccgccaccggcacgggcaccataccggcgtccgcgctcgcctccgtcgcgccctcgctcccgtcgcccacctccgggctcgccaggccgcaccaccacatgtgggcgccgtccgccggcttctcctcgccctccttcctgaactctgccgccgcgggcacgggcgatgccgccggtatcatgcagcggatggggatccccgcgggcttcgagctgccgggagcctccgccgccggagccaccctcggcgccggcggccacatcggttttgcgcccatgttcgctggacacgccgccgccatgccggggctcgagctcgggctatcgcaggacggccacatcggcgtgctcgccgcgcagtcgatcagccagttctaccaccaggtgggtgctgccgccgccggcggcggccagatgcagcacgcgcacgggcaccatcatcaccatcaccagcagcaggaggacggggaggacgaccgcgaggacggcgagtccgatgacgagtctgggcagtagtagtgtaaccgttcaaccttttgcgttgctgaatcttccctcaagttggaaggagagaaaagtgtatgcgtgcagccacgggatgcttctgctactcttggactgttgttggtcgagttctgatggatttttgtgtccatttttttctcgtgtggtatccaaactcaacggaggcctctcttgctgtgaagacttgcggattcgagatcatcctcagttcttcccacaatctcatggagtggatgatcgccacagccttctctccgacttccaggtgtatactagctgagaaaatgatggattggatcgatcacccttgagtgagtgccttatttgttattgcacagtgtgtagatattcaggtaattttgcagttagagaggtgttccttttattgtagtagtgatcaacgttttaaaacaatcaaggtattctcctccacaggctgtctatgcaacgcaagtatagtacaattctagttcatgaccacgcataccg

SEQ ID NO: 2109 - protein, 319 aa, Zea mays
  misc_feature: Ceres Clone ID no. 376567
  misc_feature (1)..(319): Bit score of 131.4 for HMM based on sequences of FIGURE 14.
  misc_feature (80)..(229): Pfam Name: TCP Pfam Description: TCP family transcription factor
  misc_feature: Functional Homolog Of SEQ ID NO. 1151
MDPKFPPPPPLNKTEPTTATTTTTSTAQQQQQLDPKDYHQQQPAQHQEHHHHLQIQTHQPPQQDGGGGGKEQQQLQVVAQPGERRQQALAPKRSSNKDRHTKVDGRGRRIRMPALCAARIFQLTRELGHKSDGETVQWLLQQAEPAIVAATGTGTIPASALASVAPSLPSPTSGLARPHHHMWAPSAGFSSPSFLNSAAAGTGDAAGIMQRMGIPAGFELPGASAAGATLGAGGHIGFAPMFAGHAAAMPGLELGLSQDGHIGVLAAQSISQFYHQVGAAAAGGGQMQHAHGHHHHHHQQQEDGEDDREDGESDDESGQ

SEQ ID NO: 2110 - DNA, 1876 bp, Glycine max
  misc_feature: Ceres Clone ID no. 692646
  misc_feature: Encodes the peptide sequence at SEQ ID NO. 2111
ctctctcatctctcaaacccaacaaaaaaaaaccattactttacttcactttacatgtcgaactccgacgccaccactaacggcgtcagtaacggcgccatcattgatgcgcagagacagcaggccttagccgttaagaagccgccgtctaaggaccgtcacagcaaggtggacggccgagggcgccgcataaggatgccaatcatatgcgccgcacgtgtgttccagctcacgcgcgagcttggccacaagtccgacggtcaaaccatcgagtggctcctccgccaggccgagccctccatcatcgccgccaccggctccggaaccacccccgccagcttctcctccgtctccctctccgtccgcgccgccgccaactccctctcctccccttcctccacctccgaccacaagccccagttactctstcccactcccttcatcctcggcaagcgcatacgcaccgacgaagactcttccaaagacgaagctgtctccgtggggccctctcttgtgggcccttctactcctcccggactgtgggccctcccggcccggcccgatttcggacaaatttggagcttcgccgccgccgctgctcccgaaatggtgtcggtgtcgcagcagcagcaggcttcattgttcctcatcaccaccgtcagcagcagcagcaagccatcggagaagcttcggcggcgagggtgggaaattaccttcctggacatctgaatttgctcgcctcattgtctggtggacctgggaattctggtcggagagacgatgagcctcgttgattgtcacatcttcaacggtggtggtgatggtggtggtcggtggtgttggtgtttttttccgtatatatgcatattctcgtgttgtggttgctgtttttgttgtgtgtggcaagcaggagattcttagggttaggttttttcttagatttgagtggagaagtccatcgattaagaaattattcaattagggtttttgttttacttcctgctggtttggagaacttaactaggtttttagatgttggataattgttttagattccggggctttttttttttttttttttwatagcaaagcatttgatcatttgccataacagatctttttttgtttttgtatgagggggtgggtgtgggattaggagggaaaagggagaaactgaatattatgctaagtttgagaaagactgcagagtgatgctggaattgggtttcagaagcttggtccgtgtgcgagtgcagttgaatttgtaatgtaatgttgttgtactcaaagagagttcttctaagttgaagagcatggattggattgcattgttgcttctgtttcactttcatagtgggttattttgggctttgacttactgggtctacaagtatggtgtggttgaagtggttgcagttgaggtaattagtgcttgcaagcttgtttytkaagccagtgaattgtgtttccaaagttcaattgtcagtcccaraatgttggagtaccctactttccaacatgggttgaraattcatgtytyttggatgttgttggggcatgttttgagggattkaggttcatgtaaggtggttatgttgtgaatttggkgcagctytytgactytytcctccmctttcacgctccttgawggkgttttattcgttttcaraggtgactggtgtgtgaaagatkaaaaaaaaaaaagaagaaagctctggttgtactctgtatgacttctgctttgagatttttatcttcaattyttagccatttcttagattgatcagcgtgagaataatgttttcttgtatgtaagtggattgtttcgggtgccagaataaaaacccgtctgtttctttctttacctcttttcttc

SEQ ID NO: 2111 - protein, 224 aa, Glycine max
  misc_feature: Ceres Clone ID no. 692646
  misc_feature (1)..(224): Bit score of 184.0 for HMM based on sequences of FIGURE 14.
  misc_feature (16)..(209): Pfam Name: TCP Pfam Description: TCP family transcription factor
  misc_feature: Functional Homolog Of SEQ ID NO. 1151
  misc_feature (125)..(125): Xaa is any aa, unknown, or other
MSNSDATTNGVSNGAIIDAQRQQALAVKKPPSKDRHSKVDGRGRRIRMPIICAARVFQLTRELGHKSDGQTIEWLLRQAEPSIIAATGSGTTPASFSSVSLSVRAAANSLSSPSSTSDHKPQLLXPTPFILGKRIRTDEDSSKDEAVSVGPSLVGPSTPPGLWALPARPDFGQIWSFAAAAAPEMVSVSQQQQASLFLITTVSSSSKPSEKLRRRGWEITFLDI

SEQ ID NO: 2112 - DNA, 1372 bp, Arabidopsis thaliana
  misc_feature: Ceres Clone ID no. 8761
  misc_feature: Encodes the peptide sequence at SEQ ID NO. 2113
ctcaatcattagcttcttctcttctcttctctcacagagagagtaatcacaagccaagtgagaaaaagaaaacactaaacccagatcgaaaaccatgtctattaacaacaacaacaacaacaacaacaataacaacgatggtgttatgatctcatcaaacggagctttaatcgaacaacaaccatcagtcgttgtgaagaaaccaccggcgaaagatcgacatagcaaagtcgatggaagagggagaagaatccgtatgccgattatatgtgctgctcgtgtttttcagctaacgagagagcttggtcataagtcagatggccaaacaattgaatggttacttcgtcaagcagagccttctattatagctgcaacaggaactggtacaactccagcgagtttctcaactgcttctgtctctatccgtggagccaccaattctacttctttagatcataaacccacttctttacttggtggtacgtcaccgtttatacttgggaaacgtgttagagctgatgagtatagtaataatagtcataatcatagttctgttggtaaagatggagacctttacgacaacaccagctgggttttgggctgttccggcgaggccggattttggacaagtttggagttttgctggagctccacaagagatgtttttacaacaacaacatcatcatcagcaaccattgtttgttcatcagcaacagcaacaccaagctgcaatgggtgaagcttctgctgctagagttgggaattatcttccgggtcatcttaatttgcttgcttctttatccggtggatctcccgggtcggatcgaagagaggaagatccacgttaatggtttaagcccttttaggtttgagggcaaaatttggtatatatatttattatcttctcttctctattgttgtcattgtttctctatgtgtgtgttttagtgttgttagagattgatttggtttcaaaatctctgcaagtgatttgagagttttcgttagctttaagtaagttaaagacggttgtttttgattagggttaaattagggtttaagaatctgttgtttttttggagggagatgggagactgagttacggagatctgaagagttatatggattcggctggtttagctgtaaccgacgatgaaatcaaatctatgattcgattagccggtggtgatttaaacgacggcgtttcgttcgacggtctgcttaagatctttgggtgttgaaaaaaaaagttcgttttttttgacaccgcacattttccaactttattttgtttctcagttttgtttgtttgtttgcagaagtgtatttgtgtccacccagattttgttttatgttgttataaaaatgtgag

SEQ ID NO: 2113 - protein, 214 aa, Arabidopsis thaliana
  misc_feature: Ceres Clone ID no. 8761
  misc_feature (1)..(214): Bit score of 124.2 for HMM based on sequences of FIGURE 14.
  misc_feature (29)..(177): Pfam Name: TCP Pfam Description: TCP family transcription factor
  misc_feature: Functional Homolog Of SEQ ID NO. 1151
MSINNNNNNNNNNNDGVMISSNGALIEQQPSVVVKKPPAKDRHSKVDGRGRRIRMPIICAARVFQLTRELGHKSDGQTIEWLLRQAEPSIIAATGTGTTPASFSTASVSIRGATNSTSLDHKPTSLLGGTSPFILGKRVRADEYSNNSHNHSSVGKDGDLYDNTSWVLGCSGEAGFWTSLEFCWSSTRDVFTTTTSSSATIVCSSATATPSCNG

SEQ ID NO: 2114 - protein, 282 aa, Vitis vinifera
  misc_feature: Public GI ID no. 157341137
  misc_feature (1)..(282): Bit score of 117.6 for HMM based on sequences of FIGURE 14.
  misc_feature (17)..(191): Pfam Name: TCP Pfam Description: TCP family transcription factor
  misc_feature: Functional Homolog Of SEQ ID NO. 1151
MGENKPAEVKDFQIVIADKEEGKKQLAPKRSSNKDRHTKVEGRGRRIRMPALCAARIFQLTRELGHKSDGETIQWLLQQAEPSIIAATGTGTIPASALAAAGGSVSQQGTSISAGLHQKIDELGGSRSSRTSANLGRPHVATGLWPPVSGFGFQSSSGPSTTNLGNESSNYLQKIAFPGFDLPATNLGPMSFTSILGGSNQQLPGLELGLSQDGHIGVLNSQALSQIYQQMGQARVHQQQQHQHQHQHQHQQQPPAKDDSQGSGQSSIVENLGFFCNGFCTV

SEQ ID NO: 2115 - protein, 310 aa, Vitis vinifera
  misc_feature: Public GI ID no. 157355048
  misc_feature (1)..(310): Bit score of 503.2 for HMM based on sequences of FIGURE 14.
  misc_feature (35)..(238): Pfam Name: TCP Pfam Description: TCP family transcription factor
  misc_feature: Functional Homolog Of SEQ ID NO. 1151
MIMEGENGIRRPNFPLQLLEKNKDEVASTASNSGPQISEPPKKPPPKRTSTKDRHTKVDGRGRRIRMPATCAARVFQLTRELGHKSDGETIEWLLQQAEPAVIAATGTGTIPANFTSLNISLRSSGSSMSAPSHLRTSYYNPNFARNRTEWERNIDESLRRIATIGRKRQPEQDPSHSQMGNYLLQSGSGSIPSTHSQIPTTFWMVTNPSNQVMSGDPVWTFPSVNNSSMYRGTMSSGLHFMNFPTPMALLPGQQLGSGIGGSGGVADGHLGMLAALNAFRPLPGNGAPDSQQTASHPHNGGDHRHDTTS

SEQ ID NO: 2116 - protein, 359 aa, Vitis vinifera
  misc_feature: Public GI ID no. 157356388
  misc_feature (1)..(359): Bit score of 652.5 for HMM based on sequences of FIGURE 14.
  misc_feature (41)..(194): Pfam Name: TCP Pfam Description: TCP family transcription factor
  misc_feature: Functional Homolog Of SEQ ID NO. 1151
MMEGGDELHRPNFPFQLLEKKEEEACSSSEPNTNRSNSSLQIAAEPSKKPPPKRTSTKDRHTKVDGRGRRIRMPALCAARVFQLTRELGHKSDGETIEWLLQQAEPAVIAATGTGTIPANFTSLNISLRSSGSSMSVPSQLRSTYFNPNFSVPQRRSLFPGLSSENSSTLVNFQSNNLNSMFQAKQELRDTSLDLSETEESIGRKRRPEQDLSQQQMGSYLLQSSTGSIPASHGQIPANFWMLTNSNNQVMSADPIWPFPSVNNSNLYRGTMSSGLHFMNFPTPVALLPSQQLSSGGGGGSGGGGGGGGSGMGEGHFNMLAGLNPYRPVMGSGVSESQASGSQSHHGGDDRHDATSHHS

SEQ ID NO: 2117 - protein, 358 aa, Physcomitrella patens subsp. patens
  misc_feature: Public GI ID no. 168062031
  misc_feature (1)..(358): Bit score of 199.6 for HMM based on sequences of FIGURE 14.
  misc_feature (38)..(205): Pfam Name: TCP Pfam Description: TCP family transcription factor
  misc_feature: Functional Homolog Of SEQ ID NO. 1151
MAGMGQEYSGNEGQSSGGVGGMGSMSMPGGSGEQQQQQTPTPPAKKPPPKRTSTKDRHTKVDGRGRRIRMPATCAARIFQLTRELGHKSDGETIEWLLQQSEQSIIAATGTGTIPAIASSIQGSIRSSSSMAVAAAGRAGIHGSLGLAGPGEHVMEVTRAMEASRRISLGHGDPGMSHDMMAGFQHQDLVGGPSEMGEGMESPDSRLRKRPRGTLQSRMKEDPDQPARPQQQQQQQRSNAGDDLDAACKRIAGRTNFRGDLGPGGSGGSGQGNAPTSSSSGQAMVPLTALPSGVALMPRMNQGGQQMPGTGLGLGSEGHLGMLAALNAYSRNVTSDHQSMGGSGHQQGDSGDDPTSSQ

SEQ ID NO: 2118 - protein, 324 aa, Zea mays
  misc_feature: Public GI ID no. 194699186
  misc_feature (1)..(324): Bit score of 125.9 for HMM based on sequences of FIGURE 14.
  misc_feature (86)..(261): Pfam Name: TCP Pfam Description: TCP family transcription factor
  misc_feature: Functional Homolog Of SEQ ID NO. 1151
MDPKFPTPLALNKTEPTTATTTTTSTAQHHQLDPKDYQQQTAQHQEQQQHHHHPHLQIQIHQPPPPPQDGGGGVKEQQQLLQVVAQPGDRRQQALAPKRSSNKDRHTKVDGRGRRIRMPALCAARIFQLTRELGHKSDGETVQWLLQQAEPAIVAATGTGTIPASALASVAPSLPSPTSGLARPHHHHPHHMWAPSAGFSSPSFLNSAGAGDGTGIGGIMQRMGVPAGLELPGGGAAGGHIGFAPMFAGHAAAMPGLELGLSQDGHIGVLAAQSISQFYHQVGAAAGGSGQMQHPHGHQHHHHQQQEDGEDDREDGESDDESGQ

SEQ ID NO: 2119 - protein, 402 aa, Zea mays
  misc_feature: Public GI ID no. 194700766
  misc_feature (1)..(402): Bit score of 562.0 for HMM based on sequences of FIGURE 14.
  misc_feature (46)..(243): Pfam Name: TCP Pfam Description: TCP family transcription factor
  misc_feature: Functional Homolog Of SEQ ID NO. 1151
MDVTGDAGGGRRPNFPLQLLEKKEEQPCSTSPAVAVGAGANGSGEMQMKKVAAPKRTSSKDRHTKVDGRGRRIRMPAICAARVFQLTRELGHKTDGETIEWLLQQAEPAVVAATGTGTIPANFTSLNISLRSSGSSFSIPAHLRAAGPRFGGARGDPWERVVGVGLGFGAAAEDPPSATSSASSPLLLSFHSGSVGLDVSPSPSSAAAGSDLSKKRRWEQEMQQQHQQQYHQQQQMAGYTTQSQMPGAVWMVPSASSNAQAAAAAGGGGSNANESIWTFPQPASGGGGGAATVYRGVPSGLHFMNFPAAPMALVPGGGQQLGLGGPVPVGGAGNDSSGSASGGGGGEGHMGILAALNAYRAHSAVPDAAPAQNGAEGGSRQRQQHGGGGERQESVSPPSDGS

SEQ ID NO: 2120 - protein, 315 aa, Zea mays
  misc_feature: Public GI ID no. 194708622
  misc_feature (1)..(315): Bit score of 129.6 for HMM based on sequences of FIGURE 14.
  misc_feature (76)..(225): Pfam Name: TCP Pfam Description: TCP family transcription factor
  misc_feature: Functional Homolog Of SEQ ID NO. 1151
MDPKFPPPPPLNKTEPTTATTTTTSTAQQQQQQLDPKDYQQQQQQPAQHLQIQIHQSQQDGGGGGKEQQQLQVVAQPGERRQQALAPKRSSNKDRHTKVDGRGRRIRMPALCAARIFQLTRELGHKSDGETVQWLLQQAEPAIVAATGTGTIPASALASVAPSLPSPTSGLARPHHHMWAPSAGFSSPSFLNSAAAGTGDAAGIMQRMGIPAGFELPGASAAGATLGAGGHIGFAPMFAGHAAAMPGLELGLSQDGHIGVLAAQSISQFYHQVGAAAGGGGQMHHAHGHHHHHHQQQEDGEDDREDGESDDESGQ

SEQ ID NO: 2121 - protein, 395 aa, Gossypium barbadense
  misc_feature: Public GI ID no. 89357197
  misc_feature (1)..(395): Bit score of 575.5 for HMM based on sequences of FIGURE 14.
  misc_feature (82)..(249): Pfam Name: TCP Pfam Description: TCP family transcription factor
  misc_feature: Functional Homolog Of SEQ ID NO. 1151
MEGGGSDDHHHHHHSHHHHHQQPLHHYHHHHHRPTFPFQLLEKKEEDNQPCSCSSSLPFPSLPVSSSSADQHTSTRSISTHQISPETYKTPPPKRTSTKDRHTKVDGRGRMIRMPALCAARVFQLTRELGHKYDGETIEWLLQQAEPAVIAATGTGTIPANFTSLNISLRSSGSSMSVPSQLRSSGFSSNFSMQQRRSLSPGIGLETTPTPTTFLNFQSSSTSLGISEEAEESSLGRKRRPEQDLSSQHHQMGSYLLQSSTGTIPASHHGQVPANFWMVTNSNNQVMSGADPIWTFPSVNNSGLYRGTMSSGLHFMNFPTPMALLPGQQLGSSSSGADGGGGGGGSGGSSGISEGHLNMLAGLNPYRQDSGGTGVSESQVSGSHSHHGGGGGSDE

SEQ ID NO: 2122 - DNA, 764 bp, Gossypium hirsutum
  misc_feature: Ceres Clone ID no. 100050746
  misc_feature: Encodes the peptide sequence at SEQ ID NO. 2123
tccatttagagaaacgaaaaatgtgtccggttcgttcagatcccatccacagattccactccctgccactcgatcacttcgaccgtcttcccgactctctccttcttttaatcttcaacaagatcggcgacgttaaagctctcggccgatgctgccttgtctcccgtcgtttccattccctcgtccctcaagttgataacgttctcgttcgtgtcgattgtgtcatctccgacgacgattcttccccctcttcctcatcctccgacaagtcacgtcccgccggtcccttctccaacttcttgcgtctcgtcttcggaggcattgttaaaccccttcaagctttgggtcaattcctcggccctaaacgctcccttctcaatgaaacggttaacgccccttcctcttcctcatccgtcggtcgcggcgctgatgatgatgatgccgaaatgggccaagctggtgtcacccaccattcccctactcaagtgcttagaaatttcagcgagattcgtttcctccgaatcgaattacccagcggcgagttaggaattgacgatggagttctgttgaaatggagagcagatttcggatcaacccttgataactgcatcatccttggagctgcctccgttattaatgacgtgcattcgcaagtatcggagtatggcaacgatgggttttgcagcaacaatagcattaccggcaacggtgatgataatgggagtattccagagtcgttttataccaatggaggcttgaaatta

SEQ ID NO: 2123 - protein, 248 aa, Gossypium hirsutum
  misc_feature: Ceres Clone ID no. 100050746
  misc_feature (1)..(248): Bit score of 286.3 for HMM based on sequences of FIGURE 15.
  misc_feature (18)..(66): Pfam Name: F-box Pfam Description: F-box domain
  misc_feature: Functional Homolog Of SEQ ID NO. 1277
MCPVRSDPIHRFHSLPLDHFDRLPDSLLLLIFNKIGDVKALGRCCLVSRRFHSLVPQVDNVLVRVDCVISDDDSSPSSSSSDKSRPAGPFSNFLRLVFGGIVKPLQALGQFLGPKRSLLNETVNAPSSSSSVGRGADDDDAEMGQAGVTHHSPTQVLRNFSEIRFLRIELPSGELGIDDGVLLKWRADFGSTLDNCIILGAASVINDVHSQVSEYGNDGFCSNNSITGNGDDNGSIPESFYTNGGLKL

SEQ ID NO: 2124 - DNA, 1761 bp, Zea mays
  misc_feature: Ceres Clone ID no. 1061573
  misc_feature: Encodes the peptide sequence at SEQ ID NO. 2125
ctctcctcctggctcactctgtgcgctcctcggcgcgtgcccacgtctcccacgcctccctccctgcattccccccttcagatccggtctgccccgccgccgccgatgtccgaagatcccgtgggatcccgccgctggcggtgcgacctcggcggcgacgagcgctggctctcgggggccgctggcgacgaccaattcgaccgcctcccggacgcgctcctcctcgtcatcttcaaccgcatcggcgacgtcaaggcgctcggccgctgctccctcgtctcccgccgcttccacgagctcgtgcccctcgtcgactccgtcctcgtccgcgttgactgcgttatccccgacgagcccccctcctcctcgtcctcctcgtcaacgccgtcctctcctacggcgtccgtgcgcgcccgcggggtcttctcacagattgcgcgcatcgtgctcggcggcatcgtgaagcccatccaggcgcttggtcagatcctctcacccgccaactccgcctccggctttccggcatccgccgcttcgtcgctatcgtcgtcgtcgtcctcctcctcgccactgcctgctggggacgtgtcgcaccactcgccatcggaggtgctccgttccttcaaggagctccgccaccttcgcatcgagctcccagcgggcgagctcggcatggacgatggcgtgatgctcaagtggaaggctgacttcgggtccacactgggcagctgcgtcatccttggagcatcctcagcctcgccgtcgccctccccctcctcagctggctcagatagtccgagcgccgctccctctgatgacagtggccacaccgagcctgatgaatgtgacgattcaggaagcatccctgagtcgttctacacaaatggggggtttaagctgcgagtggtttggtcaatcagctcattgattgcggccgccgcgaggcattacttgctgcagccgatcattgctgatcacatgacgctcgagacattggacctgacagatgctgatggtcagggagtgctcaccatggacaagtgccaactgcaggagctgagggtgagaccggtgtcaacatctaggggctcacaccggacgctcatgccagagctttgcatgtggctgtggtatgcaccatgtattgagctgcctggggggttgttgctgaatggtgcaacgctggtggccatcaagccaagtgaggaaggaacaggggacacagtttggaatgaaactgctgatgcagcctgggtgttggatgcattcgaggagccatatagaacagcggcgaagatgcttctcaagcgaaggacctacagccttgagatgaattcattctaatctatgggagatggcattttggaagcttcagatgtgagaggatgttataactaatgttgtggatgcctttcatgcacctacttcggacgtggcaagtatgcgctattgtacgctatcagcaagaacatggatggaatcaaaacagaaattttgttaacttatgatgctggagtcgaaaggcaaaaccatggccgagttgattgtgttctctgagatcagatgtggcatagatagttttttttatatatatgtatccacatcaaggtactaactttatgtaatttctacttttggattgtggcattgtgccgcttgtttgcagaataacatgcaatgcgctctgtacatcaatgtgtgtcaagattggacccgtagatttggcattagtggaagctataaaattgttactagcacttc

SEQ ID NO: 2125 - protein, 412 aa, Zea mays
  misc_feature: Ceres Clone ID no. 1061573
  misc_feature (1)..(412): Bit score of 929.3 for HMM based on sequences of FIGURE 15.
  misc_feature (29)..(77): Pfam Name: F-box Pfam Description: F-box domain
  misc_feature: Functional Homolog Of SEQ ID NO. 1277
MSEDPVGSRRWRCDLGGDERWLSGAAGDDQFDRLPDALLLVIFNRIGDVKALGRCSLVSRRFHELVPLVDSVLVRVDCVIPDEPPSSSSSSSTPSSPTASVRARGVFSQIARIVLGGIVKPIQALGQILSPANSASGFPASAASSLSSSSSSSSPLPAGDVSHHSPSEVLRSFKELRHLRIELPAGELGMDDGVMLKWKADFGSTLGSCVILGASSASPSPSPSSAGSDSPSAAPSDDSGHTEPDECDDSGSIPESFYTNGGFKLRVVWSISSLIAAAARHYLLQPIIADHMTLETLDLTDADGQGVLTMDKCQLQELRVRPVSTSRGSHRTLMPELCMWLWYAPCIELPGGLLLNGATLVAIKPSEEGTGDTVWNETADAAWVLDAFEEPYRTAAKMLLKRRTYSLEMNSF

SEQ ID NO: 2126 - DNA, 1669 bp, Glycine max
  misc_feature: Ceres Clone ID no. 1655938
  misc_feature: Encodes the peptide sequence at SEQ ID NO. 2127
agatccagcccaattaatctctctctctagaatgtcttcccagcgcgcagatctagcgtgccggatcttcccggagcccgaaatcgaccacttcgaccggctaccggactcgctcctccttttggttttcaacaagatcggcgacgtcaaagccctaggccgctgctgcgtcgtctcgcgccgcttccactccctcgtcccgcaggtcgaaaacgtcgtcgtccgcgtcgactgcgtcatctccgacgacgactcttcctcctcctccgccgcctccgacaagtcccgcggccccttctggaacctcctccgcctcgtcttcggcggaatcgtgaaacccattcaaaccctcggccagtttctcggccccaaacgcccctcctcctccgccgccgctaccgccaccgccgccacatccccttcctctacctcctccctcgccgtcggttccgacgaagactctgacggcggcgtcacccaccactccccaacccaagtcctcaagaacttcaacgagattcgcctcctccggatcgagctccccagcggcgagctaggcatcgaagacggtgtgctcctcaaatggcgcgccgatttcggatcaaccctagacaattgcgtcatcctcggcgcctcctccgttttccaccctaaagacctaaccgaccccaccaccaccaattgcaacgcaaacgacgacaatggaagcatccctgactccttctacaccaacggcggcctcaaactgcgcgtcgtttggaccataagctccctcatcgccgcctccgccagacattacttgcttcaaccgataatctctgagcacgccaccctcgacaacttgttgctcactgacgccgatggccagggggtgctttacatgaaccgggagcagctggaagagctgagggtgaagccgctatcggcgtcgtcggcgtcgaagaggactcttgtcccggcgctcaacatgaggctctggtacgcgcctcacctggaattaccaactggggttgtgttgaagggtgccacgcttgttgctattagacccagcgagcaatcccccaacacggccaagaaggaggcgtcggatttgtcgtgggtttcgacggcgtttgaggagccgtataggacggccgccacaatgcttgtcaagaggaggacttattgccttgagatgaactcattctgatgcgtttctgagggaatgcagaatcattttacaggggagaaaatgttaagttcttcatagaagggaatcaggaaactcaaattttctttgggcggacatgaagtggaagcagcttggtcgctggaatcctgctctttccggcttctgaaactgtggcccacatttgagtagttactaaaaggagctgcaaatcattcaccaatcatgcttgaactgaaaactgaatgcatctgctgggtttttttaatttgaggcaatgcttgtaagagtgcacaccctgcaactaggaatgatcatgtaagagctttaagtttgtagtcatctgcccttataagatcgccgtgtgaatattctaggtatcagtttggtttgcctttgtgatatatttttctcaagttaaatgagcaatgtactttgcctctgtaattttaaataacttctggatgagtcaatcataccaaatgcaatacctgttcctgc

SEQ ID NO: 2127 - protein, 385 aa, Glycine max
  misc_feature: Ceres Clone ID no. 1655938
  misc_feature (1)..(385): Bit score of 850.1 for HMM based on sequences of FIGURE 15.
  misc_feature (19)..(67): Pfam Name: F-box Pfam Description: F-box domain
  misc_feature: Functional Homolog Of SEQ ID NO. 1277
MSSQRADLACRIFPEPEIDHFDRLPDSLLLLVFNKIGDVKALGRCCVVSRRFHSLVPQVENVVVRVDCVISDDDSSSSSAASDKSRGPFWNLLRLVFGGIVKPIQTLGQFLGPKRPSSSAAATATAATSPSSTSSLAVGSDEDSDGGVTHHSPTQVLKNFNEIRLLRIELPSGELGIEDGVLLKWRADFGSTLDNCVILGASSVFHPKDLTDPTTTNCNANDDNGSIPDSFYTNGGLKLRVVWTISSLIAASARHYLLQPIISEHATLDNLLLTDADGQGVLYMNREQLEELRVKPLSASSASKRTLVPALNMRLWYAPHLELPTGVVLKGATLVAIRPSEQSPNTAKKEASDLSWVSTAFEEPYRTAATMLVKRRTYCLEMNSF

SEQ ID NO: 2128 - DNA, 1867 bp, Panicum virgatum
  misc_feature: Ceres Clone ID no. 1861769
  misc_feature: Encodes the peptide sequence at SEQ ID NO. 2129
acactcgcagcggcagtccagccgtgagccgtgccgtgccgtgcgtgccgactaccagcgagcaatccgccgcgggggagtccgattgaggccacccaggcgggggccgcgcggccgaccggctctcacccggcgccgcgccgacgcctcctctccggatcccgatctgcgcggccgcgtgggtgcgtcaggggatggaggaggggcggcaggagcatgaggaggcggaggcggagggggtggagggctgcccgtgcggcgagggccgggaccagttcgaccgcctccacgacgcggtgctgctcgacgtcctcaaccgcatcggcgacgtcaaggcgctgggccgctgcgccctcgtctcgcgccgcttccacgcgctcgtcccgctcgtcgactccgtcttcgtccgcgtcgactgcgtcatccccgacgacccgccgccctccgcgtccgcgggccccggctccccgcagcagcagcacccccaccaccaggcgccggcggccgcgcgcggccgcggcgcgctcgcgcacttcgcgcgcgtcctgctcggcggcatcgccaggcccatccacgcgctcggccagatcctctcccccgccgcggccgccgtctccaggcgcgccgagccgccgcccgcctccccgcccgcgcccgccgcggacgtctcccaccactcgccctccgaggtgctccgctccttcaaggagctgcgccgcctccacatcgagcttcccacgggcgagctcggcatcgaagacggcgtgctcctcaagtggaaagccgatttcgggtccacccttggccgctgcgtcatcctcggcgcctcgtcggtcacgtccaagccgacgtcgccgttggcgcagcccgaaaccgctgctgacgacagcacggccgcctctcccgattccaacagggagactgaagagctggggagcgtacctgagtcgctctataccaatggaggcctcaagcttcgcgtcgtctggaccatcagctcgctgattgctgcgtcggcgaggcattacttgctgcagccgataatttctaatcatgcaactctggagagcttgaacctcactgatgctgacggacagggggtgctcaccatggacaagaggcagcttcaggagctgcgagtgcggccagtctcggcatcagctagctcgcatcgcacactcatgccggcactcagcatgcgactgcactacgcgccgctaattaagttgccttgtggaacgctgctgaagggtgcgacgctggtggcgatcagaccaagcgaagatgccctgagagagggtcaaggggttggggctgctggttctgttggtacatgttggatttcagaggcctttgaggagccatatcggactgccgcaaaggtgcttctcaagagaagcccatattgccttgaaatgaactcgttctgaccaccagggattcagttcaagagagttatacccttcttgcaggatggtgggatgctttttggatgaatataggagtatttataattcagtgcaggaaccggacaaatacgatctccatctggtgattctgattccagtgtcgtggtaactttgcttacctgtaagtatatatatacatgtctgtgttgggttactacaggcgaaatggaatgccattcgagtggaatctacagcaatgtactaagaagagaagcaatggaatgttcctcacttgagcttggtgcatggtgctcctaggccaagctaacattacgctttcctcaaggaagcccccaaagatttcgttattatcagcacctttttttttgtttaaatcttgtggggtcatgcttttggcactgtatcaattatagaccagaatatacagcccttttcag

SEQ ID NO: 2129 - protein, 411 aa, Panicum virgatum
  misc_feature: Ceres Clone ID no. 1861769
  misc_feature (1)..(411): Bit score of 721.5 for HMM based on sequences of FIGURE 15.
  misc_feature (26)..(74): Pfam Name: F-box Pfam Description: F-box domain
  misc_feature: Functional Homolog Of SEQ ID NO. 1277
MEEGRQEHEEAEAEGVEGCPCGEGRDQFDRLHDAVLLDVLNRIGDVKALGRCALVSRRFHALVPLVDSVFVRVDCVIPDDPPPSASAGPGSPQQQHPHHQAPAAARGRGALAHFARVLLGGIARPIHALGQILSPAAAAVSRRAEPPPASPPAPAADVSHHSPSEVLRSFKELRRLHIELPTGELGIEDGVLLKWKADFGSTLGRCVILGASSVTSKPTSPLAQPETAADDSTAASPDSNRETEELGSVPESLYTNGGLKLRVVWTISSLIAASARHYLLQPIISNHATLESLNLTDADGQGVLTMDKRQLQELRVRPVSASASSHRTLMPALSMRLHYAPLIKLPCGTLLKGATLVAIRPSEDALREGQGVGAAGSVGTCWISEAFEEPYRTAAKVLLKRSPYCLEMNSF

SEQ ID NO: 2130 - DNA, 1683 bp, Zea mays
  misc_feature: Ceres Clone ID no. 278913
  misc_feature: Encodes the peptide sequence at SEQ ID NO. 2131
ctcgttccataaaccctaacctcgttggattcgcggcaaaaatcctcccaattcggaaccctccgatgttccagctacctgcgggagctgagccgtgctcggtttggcgaaatttcgcacccctcttgtgctaggaccacccggttcaagctgttcctcggaagggtcaggtcttcaccggtgctctccggcgccggatccaggtttgttccggcgagaggtcggcctcttggtgggggccagcccagcttcgagctcaatttgccggcctgagatggaatcgcgactgcggtgccggtgcctcaggtagtcgcgtcgagtcgacgcgcgattcctgccatttgggtgggccagcctttcctggcaatctcggggggcgtttcgcctcgctgcgtggcagaaaggtgtgacgtgtgatgcatcccaaggctcgaatccacgccgacccggtgcgcgaggtcgaccacttcgactgcctgccggattcgctcgtcctgctcatcctgaacaaggtcgaggacgtgcggtcgctcggccggtgctacgccgtgtccaagcggctctgtgggctcgtttccctcgtccatgatgtgtatgtcaagattgaccgcgtcgttgcggtcgacggcgacgccgagggcacgctcaacctgtcctcgccgaagcctcggagcatcttctcgcacttcctgaggctgatgctcttcacaatcatcaagccgttccacaacatgcgcagccctaatggtactgcgaggccattgttcccgcagctctcgcagcactcaccggcacaggtgctcaggaacttcacgcacgtcaggaaccttcggatcgagctcccctctggggatgtgggtactgaggagggagttctcctgaaatggcgagcagagtatgggagcacacttgagaattgtgtgatcctggggggtacccgggttgaccgcaagcctgttggtggagagcatgagccagctttggaggacaatggaagcatgccagagtctttctataccaatggtgggctgaaacttcgtgtcgtctggacaatcagctctctaatcgcggcatcaacaaggcactatcttctccgctcaatcatcaatggccatcccacactacagagcttggtactgacagatgctgatggccaaggcacattgtgcatgggggcaaagcagctggaggagttcagagagaaccagttgtcggcctcggcatgttccaacaggactcaggtcccagcctgcaacatgaagctcaagtacgctccatatgttgaactgcctggtggtatggcgttgcaaggcgctactttggtggctatcaaaccctcacctgagggaagcaatggaagccaccctaaccgcaaggaagccgaaggattcgtctttggagcattcgatgggccatttaaagttgctgtgaagacgctgatgaagagacgcacttaccttctggagatgaatggcttctaggaatcttgtccatcttggtatcgagcttgttggtgctatgcatggtacatttagctgagtgtctcatctgtgtaatattcaagaaggcaccatctctagttgatgcttgctgtctgctgttttagctctttgtacagtgttaacatttggttatataaagatcatatcaagtcctctagtgtaatagtgaatcttatctcgc

SEQ ID NO: 2131 - protein, 354 aa, Zea mays
  misc_feature: Ceres Clone ID no. 278913
  misc_feature (1)..(354): Bit score of 784.3 for HMM based on sequences of FIGURE 15.
  misc_feature (16)..(64): Pfam Name: F-box Pfam Description: F-box domain
  misc_feature: Functional Homolog Of SEQ ID NO. 1277
MHPKARIHADPVREVDHFDCLPDSLVLLILNKVEDVRSLGRCYAVSKRLCGLVSLVHDVYVKIDRVVAVDGDAEGTLNLSSPKPRSIFSHFLRLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLKLRVVWTISSLIAASTRHYLLRSIINGHPTLQSLVLTDADGQGTLCMGAKQLEEFRENQLSASACSNRTQVPACNMKLKYAPYVELPGGMALQGATLVAIKPSPEGSNGSHPNRKEAEGFVFGAFDGPFKVAVKTLMKRRTYLLEMNGF

SEQ ID NO: 2132 - DNA, 1902 bp, Zea mays
  misc_feature: Ceres Clone ID no. 376230
  misc_feature: Encodes the peptide sequence at SEQ ID NO. 2133
agggaaagcattctccaatatccacctcctcctcgcccccctctctctctctaaaagaactgaaaagataagggggaaatcctcaagtgctcgttacataaaccctaacctcgttggattcgcagcaaaagcccaccaattggaagccctccgatgttccagctgcatgctggagctgagccgtgctcggtttgacgaaattttgcatcccttctgtgcttggaccacccgattgaggctgtttctccgagggggcgtgccagcggtttcgcggcccaggtcctcacctgtgctatccggcgccggatccgggtttgttccggtgagaggtcgggcttttggtggggtctgtacagcttggagctcaatttgccggcctgagttggagtcgcgactgcggtggcggtgattgaggtagtcgcgtcgatttggcacgcgtttcctgccatttgggtgagccagcctttcctggcaatcttggcgggcgtttcgtcttgctgcgtggcagaaaggtgtgacctttgtgccgtgcgatgcatcccaaggcacgaatccacgccgacccagtgcgcgaggtcgaccactttgactgcctgccggattcgctcgtcctgctgatcctgaacaaggtcgaggacgtgcgatcgctcggccggtgctacgccgtgtccaagcggctttgtgggcttgtcccccttgtccatgatgtgtatgtcaagattgaccgcgtcgtggcggtcgacggcgacgctgaggacgcgctcaacctgtcatcgccgaagcctcggaacatcttctcgcacttcctgaagctgatgctcttcaccatcatcaagcctttccacaacatgcgcaaccctaatggtactgggaggtcattgttcccgcagctctcgcaccactcgccagcgcaggtgctcaggaacttcacgcacatcaggaatcttcggatcgagctcccctctggggatgtgggtactgaggagggagttctcctgaaatggcgggcagagtatgggagcacacttcagagttgtgtgatcctggggggtacccgggttgaccgcaagcctgttggtggagagcatgagcagtctttggaggataatggaagcatgccagagtctttctataccaacggtgggctgaaacttcgtgtcgtctggacaatcagctctctaattgcggcatcaacgaggcactatcttctccgctcaatcatcaatgaccatcccacacttctgagcttggtactgacagatgccgatggccaaggcacattgtgcatgggggcagagcagctgaaggaattcagagagaaccagttgtcggcatcagcatgttccaacaggactcaggtcccagcctgcaacatgaagctcaagtatgctccatatcttgaactgcctggtggtatggcgttgcaaggcgccactttggtggctatcaaaccctcacctgacggaagcaatggaagccaccctaaccgtaaagaagctgacgcatttgtctttggagcatttgatgggccatttaaggctgctgtgaaggctttgatgaaraggcgcacttaccttctggagatgaatggcttctagaaatcttgtgttcgcggtggtatcgagcttgttggtgctatgcatggcacatttagctaagcttttcacctgtgtaatatccaagaaggcmccatctctagttgctgcttttagtctgctgttttagctctttgtacagtgttaacatttggttatataaaaatcgtatcaagttctctagtgtaatagtgaatctctccatagttcaccatcctggcccctggtgtaatatccaagaaatcatatcaggtacataacattcattttgggattgtgaattgaaagagactgatctgatgccgac

SEQ ID NO: 2133 - protein, 354 aa, Zea mays
  misc_feature: Ceres Clone ID no. 376230
  misc_feature (1)..(354): Bit score of 795.0 for HMM based on sequences of FIGURE 15.
  misc_feature (16)..(64): Pfam Name: F-box Pfam Description: F-box domain
  misc_feature: Functional Homolog Of SEQ ID NO. 1277
  misc_feature (343)..(343): Xaa is any aa, unknown, or other
MHPKARIHADPVREVDHFDCLPDSLVLLILNKVEDVRSLGRCYAVSKRLCGLVPLVHDVYVKIDRVVAVDGDAEDALNLSSPKPRNIFSHFLKLMLFTIIKPFHNMRNPNGTGRSLFPQLSHHSPAQVLRNFTHIRNLRIELPSGDVGTEEGVLLKWRAEYGSTLQSCVILGGTRVDRKPVGGEHEQSLEDNGSMPESFYTNGGLKLRVVWTISSLIAASTRHYLLRSIINDHPTLLSLVLTDADGQGTLCMGAEQLKEFRENQLSASACSNRTQVPACNMKLKYAPYLELPGGMALQGATLVAIKPSPDGSNGSHPNRKEADAFVFGAFDGPFKAAVKALMXRRTYLLEMNGF

SEQ ID NO: 2134 - DNA, 1778 bp, Glycine max
  misc_feature: Ceres Clone ID no. 636140
  misc_feature: Encodes the peptide sequence at SEQ ID NO. 2135
atttcaatctcttccctctctctctccctgtctttctctccttttccgtgtttatgcttcaccctttcatagatctgcctgaaaaaaacccctcaattccaaacccttgcgatccgatccaggtcaattaatttctctctctctctctctctctctagaatgtcttcccaacgcgcagatctagcgtgccggatcttcccggagcccgatgcctccgaaatcgaccacttcgaccggttaccggactcgctcctccttttggttttcaacaagatcggcgacgtcaaagccctaggccgctgctgcgtcgtctcgcgccgcttccactccctcgtcccgcaggtcgaaaacgtcgtcgtccgcgtcgactgcgtcatctccgacgacgactcctcttcctccgccgccgcctccgacaagtcccgcggccccttctggaacctcctccgcctcgtcttcggcggaatcgtgaaacccatccaaaccctcggtcagttcctcggccccaaacgcccctcctcctcctccgtcacgtccccttcctccaccacctcctcctcccccctcgccgtcggaaccgacgacgactccgacgccggcgtcacccaccactccccgacgcaagtcctcaaaaacttcaacgagattcgcctcctccggatcgagctccccagcggcgagctaggcatcgaagacggcgtgctcctcaaatggcgcgccgatttcggatcaactctcgacaattgcgtcatcctcggcgcctcctccgtcttccaccccaaagacaacctaaccgaccccatccccaccaccaattgcaacgcaaacgacgacaacggaagcatccctgattccttctacaccaacggcggtctcaaactgcgcgttgtgtggaccatcagttccctcatcgctgcctccgccaggcattacttgctccaacccattatctccgagcacgccaccctcgacaacttggtgctcaccgacgccgatggccagggggtactttacatgaacagggagcaactcgaggagctgagggtgaagccgctctcggcctcgtcggcgtcgaagaggactctcgttccggcgcttaacatgaggctgtggtacgcgccgcacttggaattaccaactggggttgtgttgaagggtgccactcttgttgctattaggcccagcgagctatcccccaatactgcgaagaaggaggcgtcggatttgtcgtgggtttcgacggcgtttgaggagccgtataggacggctgctacaatgcttgtcaagaggaggacttattgccttgagatgaactcattctgatgcgtttgtgagggaatgcagaatcatttgaaaagggagaaaatgttaagttcttcatagaagggaatcacaaaactcaaattttcttgggcggacatgaagtggaagcagcttggtcgctggaatcttgctctttccagcttctgaaactatggcccacatttgagtagttactaaaggagctgcaaatcattcaccaatcatgcttgaactgagaactgaatgcatctgctggtttttttaatttgaggcaatgcttgtaagagtgcacccctgcaactaggaatgatcatgtaagagctttaagtttgtagtcatctgtccctatcagatctctctgtgaatattctaggtatcagtttggtttgcctttatgatatatttttctcaagttaaatgagcaatgtactttgcttctgtaattttaaataacttctggatgagtcaatcatgcc

SEQ ID NO: 2135 - protein, 387 aa, Glycine max
  misc_feature: Ceres Clone ID no. 636140
  misc_feature (1)..(387): Bit score of 852.3 for HMM based on sequences of FIGURE 15.
  misc_feature (22)..(70): Pfam Name: F-box Pfam Description: F-box domain
  misc_feature: Functional Homolog Of SEQ ID NO. 1277
MSSQRADLACRIFPEPDASEIDHFDRLPDSLLLLVFNKIGDVKALGRCCVVSRRFHSLVPQVENVVVRVDCVISDDDSSSSAAASDKSRGPFWNLLRLVFGGIVKPIQTLGQFLGPKRPSSSSVTSPSSTTSSSPLAVGTDDDSDAGVTHHSPTQVLKNFNEIRLLRIELPSGELGIEDGVLLKWRADFGSTLDNCVILGASSVFHPKDNLTDPIPTTNCNANDDNGSIPDSFYTNGGLKLRVVWTISSLIAASARHYLLQPIISEHATLDNLVLTDADGQGVLYMNREQLEELRVKPLSASSASKRTLVPALNMRLWYAPHLELPTGVVLKGATLVAIRPSELSPNTAKKEASDLSWVSTAFEEPYRTAATMLVKRRTYCLEMNSF

SEQ ID NO: 2136 - protein, 361 aa, Picea sitchensis
  misc_feature: Public GI ID no. 116788455
  misc_feature (1)..(361): Bit score of 645.7 for HMM based on sequences of FIGURE 15.
  misc_feature (23)..(71): Pfam Name: F-box Pfam Description: F-box domain
  misc_feature: Functional Homolog Of SEQ ID NO. 1277
MYLEFCCKQNNKPSSEVQMPVTDHFDRLPNSLVLVIFNKLGDIKALGRCSAVSKRFNCLVPQVEDVVVKVDCVISSEESGSLSGRSRGFIGLFVKLVIGSIVKPLQALQQILGTKKVVLAEVSHHSPGEVLKNFKEIQNLRIELPGGELGVEDGVLLRWRAEFGSTLESCVILGSTSYFCEKNSRKNPRSAIQRTEEFNEGLDDNGNIPESFYTDGGLKLRVVWTISSLIAASARHYLLQQIISDHPTLQNLVLTDADGQGMLCMGKAQLREFRDKPLAASATASRTQVPALNMKLWYAPYLELPEGGGMEGATLVSIRPSDRPIKKDAEAFLAGAFDEPFGAAAKEMVKKRTYLLEMNSF

SEQ ID NO: 2137 - protein, 276 aa, Vitis vinifera
  misc_feature: Public GI ID no. 157335906
  misc_feature (1)..(276): Bit score of 221.3 for HMM based on sequences of FIGURE 15.
  misc_feature (4)..(52): Pfam Name: F-box Pfam Description: F-box domain
  misc_feature: Functional Homolog Of SEQ ID NO. 1277
MSEDSFDRLPDPLILVIFNSVADIKTLIRCRAVSKRFNSLVPQAETLVLKVDRVISTDSDGSFFLSFLKSIFRSLHHIISPKSLPIQPRPHNSPTQILRGFDRIRNLEIELPGGDLCLEKGAVLKWKAEFGKRLKSCVIMGYRGLGEGEELDFGGDMDGGLKVRVVWTISALIAASARHYLLRELIREHRELERDKSRTKVPAVQMRMRHEPLLELEGCGVRMGGATLVVVTPIKDGRKTGTEEAGLVCDAFEGMFGEAARTLLKTRTYLLEMNSF

SEQ ID NO: 2138 - protein, 355 aa, Vitis vinifera
  misc_feature: Public GI ID no. 157346764
  misc_feature (1)..(355): Bit score of 218.2 for HMM based on sequences of FIGURE 15.
  misc_feature (22)..(59): Pfam Name: F-box Pfam Description: F-box domain
  misc_feature: Functional Homolog Of SEQ ID NO. 1277
MGCFLKLQRIQTYMKPDHNEDDHFDGLSDELLSLIFSKVLDAESLCRCSAVSKRFASLIPLVDAVLLTIPPPKSKPNRGLFLNFGNSLQVTNFIAKLLQFLHQIVLPQSSVSFHSNEGSIHHFSSEVLKNFSHITSLHIQLPSHGGELGANGTGSLLKWEAEFGRELESCVVLGATYFERSNKISRIPKRQDRLHESSLATDELKLRVAWMISCLFAASARHCLLKQIIADNPMMLRSLVIEDGSKQGRLRMGEDQFKELRKCVNTRPPLERTKLPAICIKLWYVPLLELPASGCVMKGATLIVIRPLNQVMKMKSDGDLLAGAFDGEEEAEALCEAVREILKEKKPYLMEMNSF

SEQ ID NO: 2139 - protein, 399 aa, Vitis vinifera
  misc_feature: Public GI ID no. 157350362
  misc_feature (1)..(399): Bit score of 887.6 for HMM based on sequences of FIGURE 15.
  misc_feature (32)..(80): Pfam Name: F-box Pfam Description: F-box domain
  misc_feature: Functional Homolog Of SEQ ID NO. 1277
MASSMRPDPSTRIWPEPQNSPPPVMMMAEAIDHFDRLPDSLLLLVFNKIGDVKALGRCCVVSRRFHTLVPQVENVVVRVDCVISDDESSSAAGSLEKSRGPFSHLFRLVFGGIVKPLQALGQFLGPKRSAPTTSSSLAVGGGSEEDGDVDHQTGGVTHHSPTQVLKNFNEIRFLRIELPSGELGIEDGVLLKWRADFGSTLDNCVILGAASVICPGPTKGSGVQDSGNDAFCVSNGGDDNGSIPESFYTNGGLKLRVVWTISSLIAASARHYLLQPIIAEHKTLDSLVLTDADGQGVLCMNRDQLEELRVKPLSASSASKRTLVPALNMRLWYAPHLELPDGIVLKGATLVAIRPSEQSVTKKEVSDGSWVSAAFEEPYGTAAKMLVKRRTYCLEMNSF

SEQ ID NO: 2140 - protein, 346 aa, Physcomitrella patens subsp. patens
  misc_feature: Public GI ID no. 168017848
  misc_feature (1)..(346): Bit score of 660.7 for HMM based on sequences of FIGURE 15.
  misc_feature (2)..(50): Pfam Name: F-box Pfam Description: F-box domain
  misc_feature: Functional Homolog Of SEQ ID NO. 1277
MDHFDRLPDSVLLVIFNKVSDIKALGRCCAVSSRFHSLAPLVDNVVVKVDCVISGEDNGLNARGRGIISHFVRFVVGTFVKPLLALQHLLGSKKTILAEVSDHSPSEVLKNFKEIQNLRIELPGGELGIEDGVLLKWRAEFGSTLESCVILGAASLVKGVRPWFLNGREDGTSQAIAEDNETPSALSDESGTIPESFYTDGGLKVRVVWTISSLIAASARHYLLQQIISDHPTLESLVLTDADGQGMLCMNKEQLREFRDKPLAASASSNRTQVPALNMKLWYAPYLELPGGTGLKGATLVAIRPSEQPAHKETENFVLGAFEEPFKTATNLLVKRRTYLLEMNSF

SEQ ID NO: 2141 - protein, 348 aa, Physcomitrella patens subsp. patens
  misc_feature: Public GI ID no. 168035092
  misc_feature (1)..(348): Bit score of 677.8 for HMM based on sequences of FIGURE 15.
  misc_feature (5)..(53): Pfam Name: F-box Pfam Description: F-box domain
  misc_feature: Functional Homolog Of SEQ ID NO. 1277
MLATDHFDRLPDSLLLVIFNKVADIKVLGRCCAVSKRFHSLAPLVDNVVVKVDCVISGEENGLNARGRGIISHFVRFVVGTLVKPLQALTHLLGPKKTILAEVSHHSPSEVLKNFKEIQNLRIELPGGELGIEDGVLLKWRAEFGSTLESCVILGAASLGVRPWFLNGRDDGASQVAAEDNSETPSNLVDESGTIPESFYTDGGLKVRVVWTISSLIAASARHYLLQQIISDHPTLESLVLTDADGQGMLCMNKEQLREFRDKPLAASASSNRTQVPALNMKLWYAPYLELPEGTGLKGATLVAIRPSEQSARKEAENFVSGAFEEPFKTATNLLVKRRTYLLEMNSF

SEQ ID NO: 2142 - protein, 354 aa, Zea mays
  misc_feature: Public GI ID no. 194689642
  misc_feature (1)..(354): Bit score of 798.6 for HMM based on sequences of FIGURE 15.
  misc_feature (16)..(64): Pfam Name: F-box Pfam Description: F-box domain
  misc_feature: Functional Homolog Of SEQ ID NO. 1277
MHPKARIHADPVREVDHFDCLPDSLVLLILNKVEDVRSLGRCYAVSKRLCGLVPLVHDVYVKIDRVVAVDGDAEDALNLSSPKPRNIFSHFLKLMLFTIIKPFHNMRNPNGTGRSLFPQLSHHSPAQVLRNFTHIRNLRIELPSGDVGTEEGVLLKWRAEYGSTLQSCVILGGTRVDRKPVGGEHEQSLEDNGSMPESFYTNGGLKLRVVWTISSLIAASTRHYLLRSIINDHSTLLSLVLTDADGQGTLCMGAEQLKEFRENQLSASACSNRTQVPACNMKLKYAPYLELPGGMALQGATLVAIKPSPDGSNGSHPNRKEADAFVFGAFDGPFKAAVKALMKRRTYLLEMNGF

SEQ ID NO: 2143 - protein, 359 aa, Zea mays
  misc_feature: Public GI ID no. 194694596
  misc_feature (1)..(359): Bit score of 531.3 for HMM based on sequences of FIGURE 15.
  misc_feature (22)..(70): Pfam Name: F-box Pfam Description: F-box domain
  misc_feature: Functional Homolog Of SEQ ID NO. 1277
MQSKHRVFAEDLLLAAAAEGEDHFDRVPDSLVLLIFNKLADARSLGRCSAVSRRFSALVPLVDDACLRIDRVIPADAADAGAPRPRAALSHLLKSVLLAVLKPFAHCDAKSASPQKHAQQQQQQHHSPAQVLRNFSSIRSLRMELPVSDVGTDDGVVLRWKAVFGSTLQSCVILGGTRVDRAGPPHAPSSGSAPPAGDDDGGSIPESLYTNGGLKLRVVWTISSLIAAATRHYLLREIVKEHPTLERVALTDAGGQGTLSMGRDQLREFRDRPLAAAPAAAANRTQVPACNMKLRYAPLLELSDGTRIHGATLVVIKPVGDAGGKDLDELGAGAFDGPLREAVAALGKRRAYLLEMNGF

SEQ ID NO: 2144 - protein, 354 aa, Zea mays
  misc_feature: Public GI ID no. 194702530
  misc_feature (1)..(354): Bit score of 781.4 for HMM based on sequences of FIGURE 15.
  misc_feature (16)..(64): Pfam Name: F-box Pfam Description: F-box domain
  misc_feature: Functional Homolog Of SEQ ID NO. 1277
MHPKARIHADPVREVDHFDCLPDSLVLLILNKVEDVRSLGRCYAVSKRLCGLVSLVHDVYVKIDRVVAVDGDAEGTLNLSSPKPRSIFSHFLKLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLKLRVVWTISSLIAASTRHYLLRSIINGHPTLQSLVLTDADGQGTLCMGAKQLEEFRENQLSTSACSNRTQVPACNMKLKYAPYVELPGGMALQGATLVAIKPSPEGSNGSHPNRKEAEGFVFGAFDGPFKAAVKALMKRRTYLLEMNGF

SEQ ID NO: 2145 - DNA, 687 bp, Sorghum bicolor
  misc_feature: Ceres Annot ID no. 8655235
  misc_feature: Encodes the peptide sequence at SEQ ID NO. 2146
atgaccggagagtcgagctccccctgcagctcagcctcgacctcttcggagcaccaccagacggtgtggacgtcgcgaccgaagcggcccgcggggcggaccaagttccgggagacgaggcacccggtgttccgcggcgtccggaggcggggcaacgccgggcggtgggtgtgcgaggtgcgcgtgccggggaggcgcggctgcaggctctggctcggcaccttcgacaccgcggacgccgcggcccgcgcgcacgacgccgccatgctcgccatcgccggcgcgggcgcctgcctcaacttcgccgactcggcctggctcctcgccgtgccggcctcgtacgccagcctcgccgaggtccgccacgccgtcgcggaggccgtggaggagttcctgctccgtgaggtggtccaagaggacgatgcgctttcggccacgtcctcgacgccgccgtcgtccccgtccagcagcgacgacggaagcacctctgatggcggggagtcctctgaatctgattcgtctccggccgccaccggggcctcgccgttcgaattggacgtgttcaatgacatgagctgggacctgtactacgcgagcttggcgcaggggatgctcgtggaaccaccgtccgcggtcaccgcgttcatggacgaaggcttcgccgatgtgccactatggagctactag

SEQ ID NO: 2146 - protein, 228 aa, Sorghum bicolor
  misc_feature: Ceres Annot ID no. 8655235
  misc_feature (1)..(228): Bit score of 183.1 for HMM based on sequences of FIGURE 8.
  misc_feature (42)..(95): Pfam Name: AP2 Pfam Description: AP2 domain
  misc_feature: Functional Homolog Of SEQ ID NO. 644
MTGESSSPCSSASTSSEHHQTVWTSRPKRPAGRTKFRETRHPVFRGVRRRGNAGRWVCEVRVPGRRGCRLWLGTFDTADAAARAHDAAMLAIAGAGACLNFADSAWLLAVPASYASLAEVRHAVAEAVEEFLLREVVQEDDALSATSSTPPSSPSSSDDGSTSDGGESSESDSSPAATGASPFELDVFNDMSWDLYYASLAQGMLVEPPSAVTAFMDEGFADVPLWSY

SEQ ID NO: 2147 - DNA, 792 bp, Sorghum bicolor
  misc_feature: Ceres Annot ID no. 8672446
  misc_feature: Encodes the peptide sequence at SEQ ID NO. 2148
atgccggagggagaggtagaggtgtccagcagcccggcgtcgtccggggccacgtcgtcctcgccgccgccgtcgccgggggcgaggagccgcggcgcgggagcggagaagcgggcgcgggcgcgggacacggacggcatcggcagccggagccacccgtcgtaccgcggcgtccggatgcgggcgtggggcaagtgggtgtcggagatccgcgagccgcgcaagaagtcgcgcatctggctcggcacgttcccgaccccggagatggcggcgcgcgcgcacgacgccgccgcgctcgtcgtcaagggcccctccgccgtcctcaacttcccggacatggccgccgcgctcccgcgcccggcctccgcgtccccgcgcgacgtccagaccgccgccgcgcgcgccgccgccatggagccagctgccctggtcctggtgccgggtgcgggtggtgcgcccgcggaagccgccggcgccgcattgcagctgcagcccgccgctccaccagcggccgggcacggtcagcagcaggacgaggcggagctggaggcgatcgtggagctcccgcggctggacgaggactacctcatgaccacgttcggcgccactacgccctgctgcttgtcgtcgtcgttccacgacgtcgcgacgccgtggtgcgacgacacggtgtgggtcgacggcgacgccggcggctacgtggcggcgcagcacgacgactacctgttcgggctgctggacggcgatcacggatggtcgcagtcggttggtgccctcctgtggaacttgtga

SEQ ID NO: 2148 - protein, 263 aa, Sorghum bicolor
  misc_feature: Ceres Annot ID no. 8672446
  misc_feature (1)..(263): Bit score of 111.0 for HMM based on sequences of FIGURE 8.
  misc_feature (53)..(104): Pfam Name: AP2 Pfam Description: AP2 domain
  misc_feature: Functional Homolog Of SEQ ID NO. 644
MPEGEVEVSSSPASSGATSSSPPPSPGARSRGAGAEKRARARDTDGIGSRSHPSYRGVRMRAWGKWVSEIREPRKKSRIWLGTFPTPEMAARAHDAAALVVKGPSAVLNFPDMAAALPRPASASPRDVQTAAARAAAMEPAALVLVPGAGGAPAEAAGAALQLQPAAPPAAGHGQQQDEAELEAIVELPRLDEDYLMTTFGATTPCCLSSSFHDVATPWCDDTVWVDGDAGGYVAAQHDDYLFGLLDGDHGWSQSVGALLWNL

SEQ ID NO: 2149 - DNA, 576 bp, Sorghum bicolor
  misc_feature: Ceres Annot ID no. 8681332
  misc_feature: Encodes the peptide sequence at SEQ ID NO. 2150
atggcgacgagctcgggggagccgtcgccgcggtcgtccgggaagcacgcattctaccgcggcatccggtgccggagcggcaagtgggtgtcggagatccgggagccccgcaaggcgcgccggatatggctcggcacgtacccgaccgccgagatggccgcggccgcctacgacgtggctgcgcgcgcgctgcgcggcgccgacgccgtgctcaacttccccggcgcgatcgcgtcgcgcgcggcgccagcgtccgcgtcccccgccgacatacgcgccgcggcggcggccgccgccgccgcccagcagcacggcgtgatgatgagcggcggcgcgagcgcgacagctgacgcggcggcgagcttgtacaacacgccgcagcagcagcagcagcagcaggagatcggcggtgatgagttcatggacgaagaggccatcttcgagatgccgcagctgctgcggaacatggcggcggggatgatgatgagcccgccgaggctcagccccgacacctccgacgagtcgcccgacccgtccgaggccggggagagcctctggagctaccatgacccgtag

SEQ ID NO: 2150 - protein, 191 aa, Sorghum bicolor
  misc_feature: Ceres Annot ID no. 8681332
  misc_feature (1)..(191): Bit score of 133.6 for HMM based on sequences of FIGURE 8.
  misc_feature (17)..(67): Pfam Name: AP2 Pfam Description: AP2 domain
  misc_feature: Functional Homolog Of SEQ ID NO. 644
MATSSGEPSPRSSGKHAFYRGIRCRSGKWVSEIREPRKARRIWLGTYPTAEMAAAAYDVAARALRGADAVLNFPGAIASRAAPASASPADIRAAAAAAAAAQQHGVMMSGGASATADAAASLYNTPQQQQQQQEIGGDEFMDEEAIFEMPQLLRNMAAGMMMSPPRLSPDTSDESPDPSEAGESLWSYHDP

SEQ ID NO: 2151 - DNA, 705 bp, Sorghum bicolor
  misc_feature: Ceres Annot ID no. 8681502
  misc_feature: Encodes the peptide sequence at SEQ ID NO. 2152
atggccatggacgactcgtcctccggctccgagcccgagcccacctcgtcgtcctccgtggaggctcccgcgtccccgaccgcgtcgtcctccgactccgcctccgccgcgggcagcgacagcaagaagcggcggcgcaccaaggacgggcaccacccgacgtaccgcggcgtgcgcatgcgggcctggggcaagtgggtgtcggagatccgggagccccgcaagaagtcgcgcatctggctcggcaccttcgccaccgccgagatggcggcgcgcgcccacgacgtggccgcgctggcgatcaagggccgcgccgcgcacctcaacttcccggagctcgcgggcgagctcccgcgcccggccaccgccgcgcccaaggacgtccaggccgccgccgcgctcgccgccgccgcggacttcccggcaacgcccgccaatgcagccggcgccgacgacgactgtggcccggacgccagcgccgcctccgacgacgtctccgcctccgcctcgccaccgccggcaacgacgctggacaaccccgacgacgcgctgttcgacctccccgacctcctcctcgacctcagacacggggcctcgtcgtgccagctgctctcgtgcgcgccgtcgtggtacgacgacgtgtgcttctccggcgccgccgccggtgcgttccgcctggaggagccgctgctgtgggagtactga

SEQ ID NO: 2152 - protein, 234 aa, Sorghum bicolor
  misc_feature: Ceres Annot ID no. 8681502
  misc_feature (1)..(234): Bit score of 149.8 for HMM based on sequences of FIGURE 8.
  misc_feature (53)..(104): Pfam Name: AP2 Pfam Description: AP2 domain
  misc_feature: Functional Homolog Of SEQ ID NO. 644
MAMDDSSSGSEPEPTSSSSVEAPASPTASSSDSASAAGSDSKKRRRTKDGHHPTYRGVRMRAWGKWVSEIREPRKKSRIWLGTFATAEMAARAHDVAALAIKGRAAHLNFPELAGELPRPATAAPKDVQAAAALAAAADFPATPANAAGADDDCGPDASAASDDVSASASPPPATTLDNPDDALFDLPDLLLDLRHGASSCQLLSCAPSWYDDVCFSGAAAGAFRLEEPLLWEY

SEQ ID NO: 2153 - DNA, 699 bp, Sorghum bicolor
  misc_feature: Ceres Annot ID no. 8702206
  misc_feature: Encodes the peptide sequence at SEQ ID NO. 2154
atggacatggacgacgctcaggagcctgcctccccgacctccccgtccccgtcctcctcctcctcctcctcttcctcgtcgtcctccgtgggcccgaagaagcgggcgcgcaaggacggcagccgtcacccgacgtaccgcggcgtgcgcatgcggagctggggcaagtgggtgtcggagatcagggagccccgcaagaagtcccgcatctggctgggcaccttcgccaccgcggagatggcggcgcgcgcgcacgacgtggcggcgctcgccatcaagggcgcccgcgacgcgcacctcaacttcccgtcccaggcgcacctgctcccgcgcccggcctccgcggcgcccaaggacgtgcaggccgcggccgcgctcgccgccgccgccgacttccctcctctgccgtcgtcgtgcccctgccccggtgaaggcgcaggcaatgccaagagccccgagagcagcagctccgacgacgccagcgccagcgccgcgtcgccgcccccgcccccgcccccgccgccgccggccccgcaggaggacgccgagcccaacccggacgacgcgctgttcgacctcccggacctgctcctggacctgagatgctgcggcccgtcgtcgtgggccgttgccgacgacgacgtggccggcggcggcgcgttccggctcatcgaggagccgctgctgtgggagtactga

SEQ ID NO: 2154 - protein, 232 aa, Sorghum bicolor
  misc_feature: Ceres Annot ID no. 8702206
  misc_feature (1)..(232): Bit score of 146.1 for HMM based on sequences of FIGURE 8.
  misc_feature (44)..(95): Pfam Name: AP2 Pfam Description: AP2 domain
  misc_feature: Functional Homolog Of SEQ ID NO. 644
MDMDDAQEPASPTSPSPSSSSSSSSSSSSVGPKKRARKDGSRHPTYRGVRMRSWGKWVSEIREPRKKSRIWLGTFATAEMAARAHDVAALAIKGARDAHLNFPSQAHLLPRPASAAPKDVQAAAALAAAADFPPLPSSCPCPGEGAGNAKSPESSSSDDASASAASPPPPPPPPPPAPQEDAEPNPDDALFDLPDLLLDLRCCGPSSWAVADDDVAGGGAFRLIEEPLLWEY

SEQ ID NO: 2155 - DNA, 775 bp, Gossypium hirsutum
  misc_feature: Ceres Clone ID no. 100059159
  misc_feature: Encodes the peptide sequence at SEQ ID NO. 2156
cacaaacatgactgaatctgattcttcttcaaccaatgtgcccccaaaagaccagccgccaccaccaactgttcccatccctgacgctccgccgcaagagcagtcgccgaaaccatcatctactccattgatctcatcgaaagaaggcgtaagtgggaattccacatcgagaaagttgccggcggtttatcgaggagtaagaagcaggagtgggaaatgggtgtcggaaatacgtgagccgcgtaaaacgacgcgtatatggctagggacataccctacacctgaaatggcagccaccgcgtatgacgtggctgctcttgccctaaaaggtcccgacgcggaactgaactttccggatatggttcattcgtatccgaaagtgggttctacatcggcaactgatattcgtgccgccgctgctagtgccgccgcttctagactactacccaaggctgtaaccaacactgggtcatcatcaaaaaacgaggacaccacatcgactactgctatggagattacatgttcaggtcaagaatttatcgacgaggaagagcttttaaactttcccaatttgatggtggatatggcagggggaatgctagtaagccctccaaactggataaactcaccaccttctgatgattcaccagataattcagatgtagatacactatggacttacacttaaaatagaaaaattcactgtaaaagtgatgaatgagagagagtatacagtacaatgaaatgtagaagaagaagaagcatggtttaaaaa

SEQ ID NO: 2156 - protein, 226 aa, Gossypium hirsutum
  misc_feature: Ceres Clone ID no. 100059159
  misc_feature (1)..(226): Bit score of 139.2 for HMM based on sequences of FIGURE 8.
  misc_feature (59)..(109): Pfam Name: AP2 Pfam Description: AP2 domain
  misc_feature: Functional Homolog Of SEQ ID NO. 644
MTESDSSSTNVPPKDQPPPPTVPIPDAPPQEQSPKPSSTPLISSKEGVSGNSTSRKLPAVYRGVRSRSGKWVSEIREPRKTTRIWLGTYPTPEMAATAYDVAALALKGPDAELNFPDMVHSYPKVGSTSATDIRAAAASAAASRLLPKAVTNTGSSSKNEDTTSTTAMEITCSGQEFIDEEELLNFPNLMVDMAGGMLVSPPNWINSPPSDDSPDNSDVDTLWTYT

SEQ ID NO: 2157 - DNA, 892 bp, Triticum aestivum
  misc_feature: Ceres Clone ID no. 1004378
  misc_feature: Encodes the peptide sequence at SEQ ID NO. 2158
cagtaaaaacaccatcgctcaacctgctcaaccatctccactagctctcgactcagatggacgtcgccgacgctgcctccaagtccggccaccaggagcagggtcacaggacggtgtcatcggagccgccgaagcggccggcggggcggaccaagttccgtgagacacgacacccgctgtaccgcggcgtgcggcgccgtggccgggtcgggcagtgggtgtgcgaggtgcgcgtgccaggagtgaagggctccaggctctggctcggcaccttcaccaccgccgagatggcggcgcgcgcgcacgacgccgcggtgctcgcgctctccggccgcgccgcctgcctcaacttcgccgactccgcatggcggatgctgcccgtgctcgcggccgggtcgttctgcttcggcagcgcgcgggagatcaagcttgccgtcgccgtcgccgtcgtcgcgttccagctgcagcagaatattcctccagccgcgtgtccaacggtggagccgaccgacagcccgagcaactctctgttctacatgtcgtccggcgacctgctgtagctcgacgaggagcactggtttggcggcatggacgccgggtcgtactacgacagcttggcgcaggggatgctcgtggagccgccggacgacagagcgaggcgggaggacgccgagcagacgggcgtcgagacaccgacgccgctatggagctatttgtttgactaattcagcacgcagtgtaaagttgtcgatagttctgttgtgttcttcccgatctgggaacaaactgagtaggcagtttttttttgaacgttgtagtaggcagtttgaagctcccggtttctacttttgtgagaattggaccctaagattgctcatcattgttatttcac

SEQ ID NO: 2158 - protein, 167 aa, Triticum aestivum
  misc_feature: Ceres Clone ID no. 1004378
  misc_feature (1)..(167): Bit score of 106.0 for HMM based on sequences of FIGURE 8.
  misc_feature (40)..(93): Pfam Name: AP2 Pfam Description: AP2 domain
  misc_feature: Functional Homolog Of SEQ ID NO. 644
MDVADAASKSGHQEQGHRTVSSEPPKRPAGRTKFRETRHPLYRGVRRRGRVGQWVCEVRVPGVKGSRLWLGTFTTAEMAARAHDAAVLALSGRAACLNFADSAWRMLPVLAAGSFCFGSAREIKLAVAVAVVAFQLQQNIPPAACPTVEPTDSPSNSLFYMSSGDLL

SEQ ID NO: 2159 - DNA, 885 bp, Zea mays
  misc_feature: Ceres Clone ID no. 100812308
  misc_feature: Encodes the peptide sequence at SEQ ID NO. 2160
ccagcaagctcaagcaagcagccaccaccagcagcgatcagcggcagccatggacatgggccggcaccagctccagctccagcacgcggcctcctcgtcctccacctcggcgtcgtcctcgtccgagcaggacaagccgctctgctgctctggtcccaagaagcgccccgcggggcgcaccaagttccgggagacgcggcacccggtgttccgcggcgtgcggcggcggggcgccgcggggcggtgggtgtgcgaggtgcgcgtccccgggcggcgcggcgcgcggctgtggctcggcacctacctcggcgccgaggcggcggcgcgcgcgcacgacgccgcgatgctcgccctgggccgcggcgcggcctgcctcaacttccccgactccgcgtggctgctcgccgtgccgcccccgcccgcgctctcgggcggcctggacggcgcccgccgggccgcgctcgaggccgtcgcggagttccagagacgccgcttcggggcggcagccgccgacgaagcgacctcgggcacgtctcctccctcctcctcctcctcggcgasgaagccggcgccggcgattgagcgcgtgcctgtggaggccagtgagacggtggcgttggacggcgccgtgttcgagcccgactggttcggggacatggacttggacttgtactatgccagcctcgcggaagggctgctcgtggagccgccgcccccgcccccgcccgccgcctgggatcatggtgactgctgcgactccggagctgacgtcgcgctctggagctactagcaagctatagcagcaataagctccaccaactcatctgtactgtagtgtacttgtaccttgtaccttgtaccaaaatccaaattgatttgtagcga

SEQ ID NO: 2160 - protein, 246 aa, Zea mays
  misc_feature: Ceres Clone ID no. 100812308
  misc_feature (1)..(246): Bit score of 160.3 for HMM based on sequences of FIGURE 8.
  misc_feature (52)..(105): Pfam Name: AP2 Pfam Description: AP2 domain
  misc_feature: Functional Homolog Of SEQ ID NO. 644
  misc_feature (171)..(171): Xaa is any aa, unknown, or other
MDMGRHQLQLQHAASSSSTSASSSSEQDKPLCCSGPKKRPAGRTKFRETRHPVFRGVRRRGAAGRWVCEVRVPGRRGARLWLGTYLGAEAAARAHDAAMLALGRGAACLNFPDSAWLLAVPPPPALSGGLDGARRAALEAVAEFQRRRFGAAAADEATSGTSPPSSSSSAXKPAPAIERVPVEASETVALDGAVFEPDWFGDMDLDLYYASLAEGLLVEPPPPPPPAAWDHGDCCDSGADVALWSY

SEQ ID NO: 2161 - DNA, 946 bp, Zea mays
  misc_feature: Ceres Clone ID no. 100918973
  misc_feature: Encodes the peptide sequence at SEQ ID NO. 2162
atcgcaagacaagcagcagcagccaccactgccatcacatggagtacgccgccgtcggctacggctacgggtacgggtacgacgagcgccaggagccggcggagtccgcggacggcggcggcggcggcgacgacgagtacgcgacggtgctgtcggcgccacccaagcggccggcggggcggaccaagttccgggagacgcggcaccccgtgtaccgcggcgtgcggcggcgcgggcccgcggggcgctgggtgtgcgaggtccgcgagcccaacaagaagtcgcgcatctggctcggcaccttcgccacccccgaggccgccgcgcgcgcgcacgacgtggccgcgctggccctgcggggccgcgccgcgtgcctcaacttcgccgactcggcgcgcctgctccaggtcgaccccgccacgctcgccacccccgacgacatccgccgcgccgccatccagctcgccgacgccgcctcgcagcaggatgagactgccgccgttgccgctgacgtggtcgcgccctcgcaggcggacgacgtcgccgccgccgccgccgccgcggcggcgatgtacggcggcggcatggagttcgaccactcgtattgctacgacgacgggatggtgagcgggagcagcgaytgctgscaaagcggcgccggcgccggcggatggcatagcwtcgtggacggsgacgacgacgacggcgccagcgacatgacgttctggagttattgagctgtagagtctttctccagcgcaggaggttgggagaggagagaccacgctatggagttattactggactgggaagaaagtgggggtgccgggagcgagttcgaatttgaattcagaaactctgtactggcactggcccccgcggggaacgccccccccaagggcgagcgctatttccctccctttttgggtgctgggagaataataaa

SEQ ID NO: 2162 - protein, 232 aa, Zea mays
  misc_feature: Ceres Clone ID no. 100918973
  misc_feature (1)..(232): Bit score of 184.6 for HMM based on sequences of FIGURE 8.
  misc_feature (57)..(109): Pfam Name: AP2 Pfam Description: AP2 domain
  misc_feature: Functional Homolog Of SEQ ID NO. 644
  misc_feature (201)..(201): Xaa is any aa, unknown, or other
  misc_feature (203)..(203): Xaa is any aa, unknown, or other
  misc_feature (215)..(215): Xaa is any aa, unknown, or other
  misc_feature (218)..(218): Xaa is any aa, unknown, or other
MEYAAVGYGYGYGYDERQEPAESADGGGGGDDEYATVLSAPPKRPAGRTKFRETRHPVYRGVRRRGPAGRWVCEVREPNKKSRIWLGTFATPEAAARAHDVAALALRGRAACLNFADSARLLQVDPATLATPDDIRRAAIQLADAASQQDETAAVAADVVAPSQADDVAAAAAAAAAMYGGGMEFDHSYCYDDGMVSGSSXCXQSGAGAGGWHSXVDXDDDDGASDMTFWSY

SEQ ID NO: 2163 - DNA, 1170 bp, Zea mays
  misc_feature: Ceres Clone ID no. 1674836
  misc_feature: Encodes the peptide sequence at SEQ ID NO. 2164
tcatatttatatatatccaatccttcccacatcgcatccatccgctcagctcgatcgaacttcgcacacgcgtacattaattctcaggaacgtactggttggtggtggtagtagctactagctactataaactatggaccagatgctgggcaagcacctgcagatgccttccgtgactacgagcgccgcctgccagcagccgcagtcgccgccgccgtcgccgcagcagcagcagcagtaccggggcgtgcggaagcgcaagtggggcaagtgggtgtcggagatccggcagccgggcaccaagacgcgcatctggctcggcagcttcgagtcggccgagatggccgcggtggcgcacgacgtggcggcgctgcgcctgcggggccgcgacgcgcagctcaacttcccgggctgcgtcgcctggctaccccgcccggcgacctcgcacgcgcgcgacgtccgcgccgcggcggccgaggccgccgaccgcgtgcgctgcgacccggcgctgctgctgctccagcaggcggcggcggcgtcagcgcggtgccacgaccacaaccacgagttcggggccgggccggcgccggtggtcgagctcgggagcgacgaggagttcgagctggacctggactcgcccagcctctgggccgagatggccgaggccatgctcctggacccgccgggctgggccaccggcgtcgtcggcgacgcggcggaggtggccctgtgctggccacacggctccctctgggacgcctgctagctcggccaggcaccccggctctggctctgcctgcgagtgtttggccatggccgatgtggccaccggacgctgtttggtctcacaagtgtcgcagtgcttttggtgtgtgccactgtgagcgcgtctctgttgattctcccccgcgtgtggttttgctttacgtctgctgctgttgggcttgctgttttcgttcctgttatcatcttaccagtatcactaccattagctaggcaaaatgataacagtccagatcatctgaagacaaacaaaattagtacggctgtgccctgctgatactgatattatggtttggtctattcctgcattttgtactaatttgtgcagtcacattattcgagatgaccgtgcatgcaagtaccccacagaaaatgatcttgtattgt

SEQ ID NO: 2164 - protein, 210 aa, Zea mays
  misc_feature: Ceres Clone ID no. 1674836
  misc_feature (1)..(210): Bit score of 108.3 for HMM based on sequences of FIGURE 8.
  misc_feature (34)..(85): Pfam Name: AP2 Pfam Description: AP2 domain
  misc_feature: Functional Homolog Of SEQ ID NO. 644
MDQMLGKHLQMPSVTTSAACQQPQSPPPSPQQQQQYRGVRKRKWGKWVSEIRQPGTKTRIWLGSFESAEMAAVAHDVAALRLRGRDAQLNFPGCVAWLPRPATSHARDVRAAAAEAADRVRCDPALLLLQQAAAASARCHDHNHEFGAGPAPVVELGSDEEFELDLDSPSLWAEMAEAMLLDPPGWATGVVGDAAEVALCWPHGSLWDAC

SEQ ID NO: 2165 - DNA, 1135 bp, Zea mays
  misc_feature: Ceres Clone ID no. 1675695
  misc_feature: Encodes the peptide sequence at SEQ ID NO. 2166
tcatatttatatatatccaatccttcccacatcgcatccatccgctcagctcagctcgatcgaacttcgcacacgcgtacattaattctcaagaacgtactggttggtggtggtagtagctactagctactataaacgatggaccagatgctgggcaagcacctgcagatgccttccgtgactacgagcgccgcctgccagcagccgcagtcgccgccgccgtcgccgcagcagcagcagcagtaccggggcgtgcggaagcgcaagtggggcaagtgggtgtcggagatccggcagccgggcaccaagacgcgcatctggctcggcagcttcgagtcggccgagatggccgcggtggcgcacgacgtggcggcgcttcgcctgcggggccgcgacgcgcagctcaacttcccgggctgcgtcgcctggctgccccgcccggcgacctcgcacgcgcgcgacgtccgcgccgcggcggccgaggccgccgaccgcgtgcgctgcgacccggcgctgctgctgctccagcaggcggcggcagcgcggtgccacgaccacgaccacgaccacgaccgcgagttcggggccgggccggcgccggtggtcgagctcgggagcgacgaggagttcgagctggacctggactcgcccagcctctgggccgagatggcggaggccatgctcctggacccgccgggctgggccaccggcgtcgtcggcgacgcggcggaggtggccctgtgctggccacacggctccctctgggacgcctgctagctcggccaggcacccccgctctggctctgcctgcgagtgtttggccatggccgatgtggccaccggacgctgtttggtctcacaagtgtcgcagtgcttttggtgtgtgccactgtgagcgcgtctctgttgattctcccccgcgtgtggttttgctttacgtctgctgctgttgggcttgctgttttcgttcctgttatcatcttacctgtatcactaccattagctaggcaaaaatgatgacagtccagatcatttgaaaaccaacaaaattagtacggctgtgccctgctgatactgatattatggtttggtctattcctgcattttgtactaatttgtgcagtcacattattgg

SEQ ID NO: 2166 - protein, 212 aa, Zea mays
  misc_feature: Ceres Clone ID no. 1675695
  misc_feature (1)..(212): Bit score of 104.9 for HMM based on sequences of FIGURE 8.
  misc_feature (34)..(85): Pfam Name: AP2 Pfam Description: AP2 domain
  misc_feature: Functional Homolog Of SEQ ID NO. 644
MDQMLGKHLQMPSVTTSAACQQPQSPPPSPQQQQQYRGVRKRKWGKWVSEIRQPGTKTRIWLGSFESAEMAAVAHDVAALRLRGRDAQLNFPGCVAWLPRPATSHARDVRAAAAEAADRVRCDPALLLLQQAAAARCHDHDHDHDREFGAGPAPVVELGSDEEFELDLDSPSLWAEMAEAMLLDPPGWATGVVGDAAEVALCWPHGSLWDAC

SEQ ID NO: 2167 - DNA, 930 bp, Panicum virgatum
  misc_feature: Ceres Clone ID no. 1761575
  misc_feature: Encodes the peptide sequence at SEQ ID NO. 2168
aaatccaccggagacaccactcactcagaatcaaggcgaccgaagatcttcgagctaagcaaccgagagatgataagacgaagatgtgtccgatgatcaagaaggagatgagcgccgccgagtcgagcccgccgtgcagctgggcgtcgacctcaacctcgtcgccggagcaggggcgccaccagacggtgtggacgtcgccgcccaagaagcctgcggggcggaccaagttccgggagacgcggcaccccgtgttccgcggcgtccgtcgccgcggcaacgccgggcggtgggtgtgcgaggtgcgcgtgccgggccgccgcggctgcaggctctggctcggcaccttcgacgccgccgatgccgcggcgcgcgcgcacgacgccgccatgctcgccatcgccggcgcgggcgcctgcctcaacttcgccgactcggcgtggctgctcgccgtgccggcctcgtacgccagcctcgccgaggtgcgcagcgcggtcgccgaggctgtcgaggtcttccagcgccgcgaggcgctctcggtctcggagtctgaggacgacgccgagtcgtcgtcggcgccctcctcccccgccagcgtcgagctcgaaggggcttccaccgacggggaggagtcgtcggcgttcgaactggacgtgttcaacgacatgagctgggacctgtactacgcgagcatggcgcaggcgatgctcatggagccgccgtccgcggttccggcgttcggagaggatggcctcgccggcgccggcgatgtgccactgtggagctactagaagccgttgcacttggaatttcacaattttgtttctcatggctgccgatgccaaattttgagaccgtagtagttagtggttgctaattctggtagtgaaacagagcaagttgggaatagaaaaacatagcattccgctg

SEQ ID NO: 2168 - protein, 235 aa, Panicum virgatum
  misc_feature: Ceres Clone ID no. 1761575
  misc_feature (1)..(235): Bit score of 191.6 for HMM based on sequences of FIGURE 8.
  misc_feature (56)..(109): Pfam Name: AP2 Pfam Description: AP2 domain
  misc_feature: Functional Homolog Of SEQ ID NO. 644
MCPMIKKEMSAAESSPPCSWASTSTSSPEQGRHQTVWTSPPKKPAGRTKFRETRHPVFRGVRRRGNAGRWVCEVRVPGRRGCRLWLGTFDAADAAARAHDAAMLAIAGAGACLNFADSAWLLAVPASYASLAEVRSAVAEAVEVFQRREALSVSESEDDAESSSAPSSPASVELEGASTDGEESSAFELDVFNDMSWDLYYASMAQAMLMEPPSAVPAFGEDGLAGAGDVPLWSY

SEQ ID NO: 2169 - DNA, 943 bp, Gossypium hirsutum
  misc_feature: Ceres Clone ID no. 1847216
  misc_feature: Encodes the peptide sequence at SEQ ID NO. 2170
aagtagaaaaagaaagctcatttagttaatattttcccttgcatttccaaattcggaagttcatacagcaagtgatttcctaaaatacttggatcctaattcaagattatgatatggttgattctgggtcggtttctgaaagtggaactgatcgtccggtgaatttttccgatgaatatgtgatgttagcttcgagttatccaaagaggcgagctgggaggaagaagttccgggagactcgacacccggtgtaccgtggagttcgccggaggaatcccgggaagtgggtttctgaagtgagggagcctaataagaagtcgaggatttggcttggaactttcccgacggcggatatggcggcgcgtgctcacgacgtggcagctatagcactgagagggaagtcagcttgtttgaacttcgctgactcagcttggaatcttccggtcccggcttcttccgacccaaaggatattcaaaagacggcggcggaggtggcggagactttcagaacggctgagtgttcgtgcgggaattctagaaacgattcaaagagaagtgaaaacacggagatggagaaagggttttatttggacgaagaagcgttgtttgggacacaaagattttgggcaaatatggctgccggtatgatgatgtcacctcctcgttccggtcatgacggaggatgggaagaacatgaagtagatgattatgtacctttatggagttattctatttaaaagtaattttttcagacattttcaagcattcattggaatttttagttcgtagaaatcgccaccggcaattgccctttatgttttgtacgtacaacggtttttttggattgtacgggtagtgttgtaagtaaaaagattaatgtgtatatatacgatgtatatatacgtcataacttctccaaacaataaatttatagcttcatatc

SEQ ID NO: 2170 - protein, 207 aa, Gossypium hirsutum
  misc_feature: Ceres Clone ID no. 1847216
  misc_feature (1)..(207): Bit score of 345.2 for HMM based on sequences of FIGURE 8.
  misc_feature (45)..(96): Pfam Name: AP2 Pfam Description: AP2 domain
  misc_feature: Functional Homolog Of SEQ ID NO. 644
MVDSGSVSESGTDRPVNFSDEYVMLASSYPKRRAGRKKFRETRHPVYRGVRRRNPGKWVSEVREPNKKSRIWLGTFPTADMAARAHDVAAIALRGKSACLNFADSAWNLPVPASSDPKDIQKTAAEVAETFRTAECSCGNSRNDSKRSENTEMEKGFYLDEEALFGTQRFWANMAAGMMMSPPRSGHDGGWEEHEVDDYVPLWSYSI

SEQ ID NO: 2171 - DNA, 986 bp, Panicum virgatum
  misc_feature: Ceres Clone ID no. 1954322
  misc_feature: Encodes the peptide sequence at SEQ ID NO. 2172
aagcaaaaaaacactccaacacaattcaagcaggaccaaaggcagcaacagcaccccgggctcaagcgagcttgaagtggtcagaacaagatgtgccaaatcaagaaggagatgagcgccgagtcgggctccccgtgcagctcggccacgtcctcgacctcgacctcgtcggagcaccaccagacggtgtggtcgtcgccgccgaagcggcccgcggggcggaccaagttccgggagacgcggcaccccgtgttccgcggcgtgcggcgccggggcaacgccgggcggtgggtgtgcgaggtgcgcgtgccgggccgccgcggctgcaggctctggctcggcaccttcgacaccgccgagggggccgcgcgcgcgcacgacgccgccatgctcgccatcgccggcgcgggcgcctgcctcaacttcgccgactcggcgtggctcctcgcggtccccgcctcctacgccagcctcgccgaggtgcgccacgcggtcgccgaggccgtggaggagttccagcgccgggaggcgctcccggagcaggagggacgcgcgctcggccacgtctctysacgccgtctgtaccctgccagcgaggacggcagcgccaccgacggcgaggggtcctctgactcctccccggccaccggggcctcgccgttcgagctggacgcgttcaacgacatgagctgggacttgtactacgcgagcatggcgcaggcgatgctcatggagccgccgtctgcggtcatggagttcggcgacgccagcatcatcgatgtgccactttggagctactagaagcgatgctgctgagccggagcttagcttttccttttctttcacatggcctcggacgccatttcttttgcctgtatgtaattttacttctttgagaaaacagagcaaaacagagcatgcccatttgactttcttagactcgcaaaaacattcaaatctaacgcttaagttagcggttgaccctg

SEQ ID NO: 2172 - protein, 236 aa, Panicum virgatum
  misc_feature: Ceres Clone ID no. 1954322
  misc_feature (1)..(236): Bit score of 188.5 for HMM based on sequences of FIGURE 8.
  misc_feature (53)..(106): Pfam Name: AP2 Pfam Description: AP2 domain
  misc_feature: Functional Homolog Of SEQ ID NO. 644
  misc_feature (161)..(161): Xaa is any aa, unknown, or other
MCQIKKEMSAESGSPCSSATSSTSTSSEHHQTVWSSPPKRPAGRTKFRETRHPVFRGVRRRGNAGRWVCEVRVPGRRGCRLWLGTFDTAEGAARAHDAAMLAIAGAGACLNFADSAWLLAVPASYASLAEVRHAVAEAVEEFQRREALPEQEGRALGHVSXRRLYPASEDGSATDGEGSSDSSPATGASPFELDAFNDMSWDLYYASMAQAMLMEPPSAVMEFGDASIIDVPLWSY

SEQ ID NO: 2173 - DNA, 833 bp, Arabidopsis thaliana
  misc_feature: Ceres Clone ID no. 25524
  misc_feature: Encodes the peptide sequence at SEQ ID NO. 2174
agaaaaataacaaactctttaatgtcaccacagagaatgaagctatcaccaccaccagttaccaacaacgaaccaaccgccaccgcttctgccgttaaatcttgcggcggaggaggtaaagaaaccagctcatcgaccacgaggcatccagtgtaccacggagttcgcaaacgccgatggggaaaatgggtttcagagatcagagagccccggaaaaagtctcggatttggctcggatcttttccggtgccggagatggctgctaaagcctacgacgtggcagcgttttgtctaaaaggtagaaaagctcagctgaatttccctgaagaaatcgaggatctacctcgaccgtccacgtgtactcccagagatatccaagtcgcagcggccaaagcagccaacgccgtgaagatcatcaaaatgggagatgatgacgtggcaggaatagacgacggagatgatttctgggaaggcattgagctgcctgagcttatgatgactggaggtgggtggtcgccggagccttttgttgccggagatgatgccacgtggcttgtcgacggagacttgtatcagtatcagttcatggcgtgtctgtgagtgttgctgtcgattgtgtcgtattcgttatacgtgtacgttgtatcgttattgtgttggctcacttaatttaatgcatatgcatgtatattttcatttatttgtttctagtttattgttttacgcgattaataattagatacctgtttctcaagttagttatcaggtttgtacgcatctacaaaaatacgtataagtgtatgttcttatatacagtttttgtttgcataagc

SEQ ID NO: 2174 - protein, 192 aa, Arabidopsis thaliana
  misc_feature: Ceres Clone ID no. 25524
  misc_feature (1)..(192): Bit score of 104.6 for HMM based on sequences of FIGURE 8.
  misc_feature (43)..(94): Pfam Name: AP2 Pfam Description: AP2 domain
  misc_feature: Functional Homolog Of SEQ ID NO. 644
MSPQRMKLSPPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMTGGGWSPEPFVAGDDATWLVDGDLYQYQFMACL

SEQ ID NO: 2175 - DNA, 1053 bp, Glycine max
  misc_feature: Ceres Clone ID no. 482122
  misc_feature: Encodes the peptide sequence at SEQ ID NO. 2176
aactctcactccacaactcaactaagcgcaaaccaaaccaacacaaacaaaaacatctctcagcaaatgaatattctcggacaatcactccaccaatcaaacaacggcagctactcttgttcgtcgccggagactgcaaactcctctaaccttccgaccactccgaaagccgttcactccgacgaggaagtgaacacattagcatcggctcatcctaagaaacgtgcggggcgtcgaatttttaaggagacaaggcatcccgtgtacagaggagtgcggcggaggaacaacaacaagtgggtctgcgaggttcgtgttcccaacgacaagtccacgaggatttggctcggaacgtatccaacgcctgagatggccgcacgtgcgcacgacgtcgccgcgctctcgcttcgaggtaagtcggcgtgtctcaacttcgccgactcggcgtggcggttgcccttgccggcgtcgaccaatgcgaaggagattcggcgcgtggcggcggcggctgctgtagcgattgcggcggaagacagccgcggcaagcagttgcggactaatgcgattgatgccgttgctgattgcgaagttagcagcagtgacataggcgtcgatgaaaattgcaataacaataaagcttcgcagaggttttgtgatttggatgaaattacaatgccagatgcaccggtttttgaggacatgcatgagtggcttcagactatggctgctgaaccattaagatcacctacttttgtaacatatgttaatgttagggatgtctggaactttgtggaggatgatgctgaggtttccttgtggagcttcaccgtctgaagagcatgcaatttaggctttaggtgtatttagtgtgtttagctttctttctcttcttttggtttttgtacataattaggaacggaggactacgaaaatgtacaaagaccgaaacgatataaggagatagctatctaggtaggaacataaaagtgtgaaacattgtaacttttctcattcggttgtttttgtaaaataaaaattctattttcatcaatg

SEQ ID NO: 2176 - protein, 255 aa, Glycine max
  misc_feature: Ceres Clone ID no. 482122
  misc_feature (1)..(255): Bit score of 247.8 for HMM based on sequences of FIGURE 8.
  misc_feature (65)..(117): Pfam Name: AP2 Pfam Description: AP2 domain
  misc_feature: Functional Homolog Of SEQ ID NO. 644
MNILGQSLHQSNNGSYSCSSPETANSSNLPTTPKAVHSDEEVNTLASAHPKKRAGRRIFKETRHPVYRGVRRRNNNKWVCEVRVPNDKSTRIWLGTYPTPEMAARAHDVAALSLRGKSACLNFADSAWRLPLPASTNAKEIRRVAAAAAVAIAAEDSRGKQLRTNAIDAVADCEVSSSDIGVDENCNNNKASQRFCDLDEITMPDAPVFEDMHEWLQTMAAEPLRSPTFVTYVNVRDVWNFVEDDAEVSLWSFTV

SEQ ID NO: 2177 - DNA, 548 bp, Glycine max
  misc_feature: Ceres Clone ID no. 556990
  misc_feature: Encodes the peptide sequence at SEQ ID NO. 2178
gcaaacaaaaacactctcaacaaatgaatattctcggacaatcattcaacgaatcaaacaacggaagctactcttgttcgtcgccggagactggtagctcctctaacattccaaacacttttcactccgacgaggaagtgcacacactagcttcggcgcgtcctaagaaacgtgcggggcgtcgaatttttaaggagacaagacacccggtgtaccgaggagtacgaaggaggaacaacaacaagtgggtctgcgaggttcgtgttcccaacgacaagtccaccaggatttggcttggaacgtatccagtgcctgagatggccgcacgtgcgcacgacgtcgccgcgctcgcgcttcggggcaagtcggcttgcctcaacttcgccgactcggcgtggcggctgcccttgccggcgtcgacaaatgcgaaggagatacggcgagtggcggcggcggctgctgtagcgattgcggsggaagacagctgcggcgagcagttacagaatagtattgtgaatgatgccgttgctgatgattgtgaagttagc

SEQ ID NO: 2178 - protein, 175 aa, Glycine max
  misc_feature: Ceres Clone ID no. 556990
  misc_feature (1)..(175): Bit score of 164.2 for HMM based on sequences of FIGURE 8.
  misc_feature (62)..(114): Pfam Name: AP2 Pfam Description: AP2 domain
  misc_feature: Functional Homolog Of SEQ ID NO. 644
  misc_feature (151)..(151): Xaa is any aa, unknown, or other
MNILGQSFNESNNGSYSCSSPETGSSSNIPNTFHSDEEVHTLASARPKKRAGRRIFKETRHPVYRGVRRRNNNKWVCEVRVPNDKSTRIWLGTYPVPEMAARAHDVAALALRGKSACLNFADSAWRLPLPASTNAKEIRRVAAAAAVAIAXEDSCGEQLQNSIVNDAVADDCEVS

SEQ ID NO: 2179 - DNA, 979 bp, Triticum aestivum
  misc_feature: Ceres Clone ID no. 727588
  misc_feature: Encodes the peptide sequence at SEQ ID NO. 2180
atttagagctacacctctccacctcactagctccgaatatacagctacctcgttacaccacaaaccgctctcgacgccagctgcgactgatggacaccatcgccgcctggccgcagtttgacgggcaagagtacaggacggtgtggccggaggagcaggagtaccggacggtgtggtcggagccgccgaagcggcgggcggggcggaacaagttgcaggagacacgccacccagtgtaccgcggcgtgcgccgccgtggccgggaagggcagtgggtgtgcgagctgcgcgtgccggccggaagccggagttactccacgatctggctcggcaccttcgccagtgcccagatggcggcgcgcgcgcacgactcggccgcgctcgcgctctccggccgcgacgcgtgcctcaacttcgccgactccgcctggcggatgatgcccgtccacgcggccgggtcgttcaagttggccgccgcgcaggagatcaaggacgccgtcgccgtcgccctcaaggagttccaggagcaagcagcgccctgccgacgagtcaacggcgccgtcgtccacggccgaggagagcgcgctytccatcatccccagcgacctgtcggggctcgacaacgagcactggatcggcggcatggaagccggctcgtactacgcgagcttggcgcaggggatgctcatggagccgccggccgacggagcttcttggcgggaggaccgcgaacacgacgacggcttcgacacgtggctgtggagctactagtgtgatcaactgattaagcaatgtaaagttytagagagtagtactattactagattgtgtttcaccaaatatgggaagaatagagagtaagcatcgggggaaaggttcccccccaatgtgaaagccctcggtttctactcccggaagggcacaaatgagcttctttctttattctataaataaatagagaaatgagcagtagtagatc

SEQ ID NO: 2180 - protein, 228 aa, Triticum aestivum
  misc_feature: Ceres Clone ID no. 727588
  misc_feature (1)..(228): Bit score of 120.1 for HMM based on sequences of FIGURE 8.
  misc_feature (48)..(103): Pfam Name: AP2 Pfam Description: AP2 domain
  misc_feature: Functional Homolog Of SEQ ID NO. 644
  misc_feature (167)..(167): Xaa is any aa, unknown, or other
MDTIAAWPQFDGQEYRTVWPEEQEYRTVWSEPPKRRAGRNKLQETRHPVYRGVRRRGREGQWVCELRVPAGSRSYSTIWLGTFASAQMAARAHDSAALALSGRDACLNFADSAWRMMPVHAAGSFKLAAAQEIKDAVAVALKEFQEQAAPCRRVNGAVVHGRGERAXHHPQRPVGARQRALDRRHGSRLVLRELGAGDAHGAAGRRSFLAGGPRTRRRLRHVAVELLV

SEQ ID NO: 2181 - DNA, 1004 bp, Brassica napus
  misc_feature: Ceres Clone ID no. 972379
  misc_feature: Encodes the peptide sequence at SEQ ID NO. 2182
aaaacaaaatagtctctcttctctcaaacgattacaaaaaaatgacgtcatccaaccgttcttcatcaccaacatcatcgtcttcggaccaatctgatgtaactacaacaacaagcacccacttgtccgaaacttcaccgagaaacaacaaaagaaagagaagcaaggattcttcttcttcttcttcttcctcttcttcaaagcttaagcatcctgtttacagaggtgtacggatgagaagctggggcaaatgggtctccgagatccgacagcctcgcaaaaagactcgaatctggctcggtacattcgccaccgcagacatggcggcgcgtgctcacgacgtcgctgctctcgccatcaaaggctcctccgccgtcatcaacttcccggagcttgcctctatcctccctcgtccggcgtcatcctcgccgcatgatatccaagcagcagctgcggaagccgccgccatggtggtcgacggtaaattgtcggagtcagagtcggctgcgmcagagatgaaggaagcaccgccgtcgccggaatcttcttgcgcggcgacggagtytaagaaggaggagaggttggaggagattgtggagctgcctaacattgaagaggggagttatgacatgagcgtgaagtcacgctccgacctggattattytgagccgttggattgttgggtgtatcctcctccggccatagatytctatgaaragttyttggagttcgatttyttggagttatggagctttcctcacmcggaactgattaatccctaattaggttaattaccagtaagttgcattcatgtattgataaayacatttgtgttgtttttatttgtacgggatacgtagtataggaactgtagtggtagtatatgttgtgtaacatacggtaccaaggctwctatgcagctattgtaaaatgaaattatatttatatttgkacttatcagactgttattgtaacttggtaaatgaaagctatcgttacgcatt

SEQ ID NO: 2182 - protein, 246 aa, Brassica napus
  misc_feature: Ceres Clone ID no. 972379
  misc_feature (1)..(246): Bit score of 131.5 for HMM based on sequences of FIGURE 8.
  misc_feature (58)..(109): Pfam Name: AP2 Pfam Description: AP2 domain
  misc_feature: Functional Homolog Of SEQ ID NO. 644
  misc_feature (157)..(157): Xaa is any aa, unknown, or other
  misc_feature (175)..(175): Xaa is any aa, unknown, or other
  misc_feature (208)..(208): Xaa is any aa, unknown, or other
  misc_feature (223)..(223): Xaa is any aa, unknown, or other
  misc_feature (226)..(226): Xaa is any aa, unknown, or other
  misc_feature (227)..(227): Xaa is any aa, unknown, or other
  misc_feature (232)..(232): Xaa is any aa, unknown, or other
  misc_feature (241)..(241): Xaa is any aa, unknown, or other
MTSSNRSSSPTSSSSDQSDVTTTTSTHLSETSPRNNKRKRSKDSSSSSSSSSSKLKHPVYRGVRMRSWGKWVSEIRQPRKKTRIWLGTFATADMAARAHDVAALAIKGSSAVINFPELASILPRPASSSPHDIQAAAAEAAAMVVDGKLSESESAAXEMKEAPPSPESSCAATEXKKEERLEEIVELPNIEEGSYDMSVKSRSDLDYXEPLDCWVYPPPAIDXYEXXLEFDXLELWSFPHXELINP

SEQ ID NO: 2183 - protein, 215 aa, Medicago truncatula
  misc_feature: Public GI ID no. 110559316
  misc_feature (1)..(215): Bit score of 281.8 for HMM based on sequences of FIGURE 8.
  misc_feature (52)..(103): Pfam Name: AP2 Pfam Description: AP2 domain
  misc_feature: Functional Homolog Of SEQ ID NO. 644
MFTTNNSSYSHSISSEASSSYYNSLPESEIRLAASNPKKRAGRKIFKETRHPVYRGVRKRNLDKWVCEMREPNTKTRIWLGTFPTAEMAARAHDVAAMALRGRYACLNFADSVWRLPIPATSSIKDIQKAATKAAEAFRPDNTIMITNIETVVAVVATKELNMFCVEEEEEMLNMPEFWRNMALMSPTHSFEYHDQYEDFHFQDFQDDEVSLWNF

SEQ ID NO: 2184 - protein, 214 aa, Poncirus trifoliata
  misc_feature: Public GI ID no. 111218106
  misc_feature (1)..(214): Bit score of 370.5 for HMM based on sequences of FIGURE 8.
  misc_feature (45)..(96): Pfam Name: AP2 Pfam Description: AP2 domain
  misc_feature: Functional Homolog Of SEQ ID NO. 644
MDSLSSWSSPESRVGNFSDEDVVLLASSNPKKRAGRKKFRETRHPVYRGVRRRDSGKWVCELREPNKKSRIWLGTFPTAEMAARAHDVAVIALRGRLACLNFADSSWRLPLPASTDPKDIQKAAAEAAEAFRLEKDLRRVDDKMDEKEVVERTTMSDGVIFMDEEAVFGMPGLLTNMAEGMLLPPPPPPQCNRGGYEEDDVESNADVSLWSYSV

SEQ ID NO: 2185 - protein, 225 aa, Solanum tuberosum
  misc_feature: Public GI ID no. 114432126
  misc_feature (1)..(225): Bit score of 411.4 for HMM based on sequences of FIGURE 8.
  misc_feature (52)..(103): Pfam Name: AP2 Pfam Description: AP2 domain
  misc_feature: Functional Homolog Of SEQ ID NO. 644
MNIFETYYSDPLILTESSSSSSSSSSEEEIILASNNPKRPAGRKKFRETRHPIYRGIRMRNSGKWVCEVREPNKKSRIWLGTFPTAEMAARAHDVAALALRGRSACLNFADSAWRLPIPASSNSKDIQKAAAEAAEIFRSSSSEESEEVSGESDNSTTETPENAFFMNDEVQESSFFMDEEALFFMPGLIANMAEGLMLPPPQCAEMGDHYVEADAYMTLWNYSI

SEQ ID NO: 2186 - protein, 238 aa, Festuca pratensis
  misc_feature: Public GI ID no. 119709978
  misc_feature (1)..(238): Bit score of 173.7 for HMM based on sequences of FIGURE 8.
  misc_feature (56)..(109): Pfam Name: AP2 Pfam Description: AP2 domain
  misc_feature: Functional Homolog Of SEQ ID NO. 644
MCPIKKEMSGESGLSCSGEYHSPSTSPEQQQGHSQKQTAWTKRPAGRTKFRETRHPVFRGVRRRGNAGRWVCEVRVPGRRGSRLWVGTFDTAEIAARAHDAAMLALAAGDACLNFADSAELLAVPASYRNLAEVRHAVTEAVEDFERRQELGEKDALSGTSSSTPSSSSLTDDEEASSQNDNSPFELEVLSDMGWDLYYSSLAQGMMLMAPPFLAASAAFGDYGEVNLADVPLWSYQS

SEQ ID NO: 2187 - protein, 192 aa, Populus balsamifera subsp. trichocarpa
  misc_feature: Public GI ID no. 134038590
  misc_feature (1)..(192): Bit score of 358.6 for HMM based on sequences of FIGURE 8.
  misc_feature (22)..(73): Pfam Name: AP2 Pfam Description: AP2 domain
  misc_feature: Functional Homolog Of SEQ ID NO. 644
MLASRNPKKRAGRKKFRETRHPVYRGVRRRNSGKWVCEVREPNKKSRIWLGTFPTAEMAARAHDVAALALRGRSACLNFADSAWRLPVPASSEAKDIQKAAAEAAGGFRPEGCVGGELMRTGDEGEKAAETTAEAGEEVFYMDDEAVFGMPGLLANMAEGMLLPPPHCGGGGDGWDNMENIDADMPLWSFSI

SEQ ID NO: 2188 - protein, 231 aa, Populus balsamifera subsp. trichocarpa
  misc_feature: Public GI ID no. 134038594
  misc_feature (1)..(231): Bit score of 314.1 for HMM based on sequences of FIGURE 8.
  misc_feature (61)..(112): Pfam Name: AP2 Pfam Description: AP2 domain
  misc_feature: Functional Homolog Of SEQ ID NO. 644
MVMGGSNSFSPDKQESSLSSLLSDSSGSQQDSPSSNEKVLLATSRPKKRAGRRIFKETRHPIFRGVRKRNGDKWVCELREPNKKSRIWLGTYPTPEMAARAHDVAALAFRGKSACLNFADSAWRLPVPISNEAKDIRRAASEAAELFRTSDLGGQVMEDFRREDRGEVCSSTNDDIRDLPSENVGYIDEEAEFNMPGLLASMAEGLLLSPPHYTGDWNDGEIDADWSLWSS

SEQ ID NO: 2189 - protein, 197 aa, Populus balsamifera subsp. trichocarpa
  misc_feature: Public GI ID no. 134038598
  misc_feature (1)..(197): Bit score of 222.4 for HMM based on sequences of FIGURE 8.
  misc_feature (29)..(80): Pfam Name: AP2 Pfam Description: AP2 domain
  misc_feature: Functional Homolog Of SEQ ID NO. 644
MCLLCPTYVTSCFMKNKAGRKKFKETRHPVYRGVRRRNGNKWVCEVREPNKKSRIWVGTFKSPEMAARAHDVAALALKGELAALNFLDSALILPRAKSSSARDIQRAALAATEVLGRSASSCSSSSSPDHKKLSCVPNHSNATFFDEEALFNMPGLLDSMAEGLILTPPAMARGVYWDDMACSTDLTLWEDDYLDSQ

SEQ ID NO: 2190 - protein, 209 aa, Populus balsamifera subsp. trichocarpa
  misc_feature: Public GI ID no. 145322756
  misc_feature (1)..(209): Bit score of 306.4 for HMM based on sequences of FIGURE 8.
  misc_feature (49)..(100): Pfam Name: AP2 Pfam Description: AP2 domain
  misc_feature: Functional Homolog Of SEQ ID NO. 644
MPNDRQEASSFSDSSTSRRVVHSDEEVLLATSFPKKRAGRRIFRETRHPVFRGVRKRNGNKWVCEMREPNKKSRIWLGTYPTPEMAARAHDVAALALRGKSACLNFADSAWRLPVPVSKDSKDITRAANEAAELFRPQEFGENDVFFKEAVFAMPGENDVFFEEAVFDMPGLLVDMAEGLLLSPPRYVRNDCNDLDHMENGSDLSLWSY

SEQ ID NO: 2191 - protein, 221 aa, Populus balsamifera subsp. trichocarpa
  misc_feature: Public GI ID no. 148372079
  misc_feature (1)..(221): Bit score of 136.1 for HMM based on sequences of FIGURE 8.
  misc_feature (40)..(91): Pfam Name: AP2 Pfam Description: AP2 domain
  misc_feature: Functional Homolog Of SEQ ID NO. 644
MKNSRKQDQSQDSSKRNQDPKNNNESNKKAKSGGNAGRHPSYRGVRMRQWGKWVSEIRQPKKKSRIWLGTFPTPEMAARAHDVAALTIKGHSAHLNFPEIAHEFPRPASSSPKDIQAAAALAATLSCKTSQKGRETEAEDELMLPHSPDSTLASNETQEYSLSSPLRDDGDDTFIDLPDILQDQYQFDEFCYLSSWQLVGPETSDIGFWHHEEPFGNIPFK

SEQ ID NO: 2192 - protein, 197 aa, Populus balsamifera subsp. trichocarpa
  misc_feature: Public GI ID no. 148372097
  misc_feature (1)..(197): Bit score of 153.3 for HMM based on sequences of FIGURE 8.
  misc_feature (30)..(80): Pfam Name: AP2 Pfam Description: AP2 domain
  misc_feature: Functional Homolog Of SEQ ID NO. 644
MSGRHGDQSPRRPIRPPGGSSAQPASGRHPTFKGVRLRSGKWVSEIREPRKTTRVWLGTYPTPEMAATAYDVAALALKGTNTPLNFPESILSYPTPASASPGDIRAAAASAASARSPKRESGPNPEMGQPETEGSSSIITADVQSGQEIFDEEELLNMPNLLVDMAGGMLVSPPRINTLSSDDSPGSSDAESLWSYH

SEQ ID NO: 2193 - protein, 185 aa, Chrysanthemum x morifolium
  misc_feature: Public GI ID no. 151428244
  misc_feature (1)..(185): Bit score of 222.0 for HMM based on sequences of FIGURE 8.
  misc_feature (46)..(97): Pfam Name: AP2 Pfam Description: AP2 domain
  misc_feature: Functional Homolog Of SEQ ID NO. 644
MDIESHYLHQEKLSVVQPYLEPELMLASQNPKKRAGRKKFMETRHPIYWGVRSRKFGKWVGEVRHPITQSRVWLGTHDTADMAARAHDVAVLAMRGRSACLNFADSVWRLPIPQSSDVIDIQKAGAVAAKSFRPIVEIVKIVYQVDEDEIFGMIEGLMLPSPNTVGQGNIFDDVESFDDMPLWCS

SEQ ID NO: 2194 - protein, 211 aa, Hippophae rhamnoides
  misc_feature: Public GI ID no. 152206082
  misc_feature (1)..(211): Bit score of 358.3 for HMM based on sequences of FIGURE 8.
  misc_feature (46)..(97): Pfam Name: AP2 Pfam Description: AP2 domain
  misc_feature: Functional Homolog Of SEQ ID NO. 644
MATLHLLCVIPHPASRKRHEPFRPKRDSSCPKKPAGRKKFRETRHPVYRGVRLRKSGKWVCEVREPNKKSRIWLGTFLTAEIAARAHDVAAIALRGKSACLNFADSAWRLRIPETTCPKEIQKAAAEAAVAFQAELNDTTADHGLDVEETIVEAIFTEESSEGFYMDEEFMFGMPTLWASMAEGMLLPPPSVQFGPNYDFDGDADVSPLEY

SEQ ID NO: 2195 - protein, 180 aa, Thellungiella halophila
  misc_feature: Public GI ID no. 154200014
  misc_feature (1)..(180): Bit score of 186.2 for HMM based on sequences of FIGURE 8.
  misc_feature (29)..(80): Pfam Name: AP2 Pfam Description: AP2 domain
  misc_feature: Functional Homolog Of SEQ ID NO. 644
MENDDISLAEMRPKKKRAGRRIFKETRHPIYRGVRRRNGDKWVCEVREPIHQRRIWLGTYPTAEMAARAHDVAVLALRGRTACLNFSDSAWRLPAPESIDPDTIRRTAAEAAEIFRPPEFGDEITVFPSSGGGELATSEEGEGFAGMMMRLAEEPLMSPPRSYIDMNTSVYVEEERCYEE

SEQ ID NO: 2196 - protein, 212 aa, Ampelopsis brevipedunculata
  misc_feature: Public GI ID no. 156186839
  misc_feature (1)..(212): Bit score of 351.6 for HMM based on sequences of FIGURE 8.
  misc_feature (57)..(108): Pfam Name: AP2 Pfam Description: AP2 domain
  misc_feature: Functional Homolog Of SEQ ID NO. 644
MNTTSPPYSDPHPLRYTDTWGSPNLPDSDGASEELMLASTHPKKRAGRKKFRETRHPVYRGVRRRNSGKWVCEVREPNKTSRIWLGTFPTAEMAARAHDVAALALRGRGACLNFADSAWRLQVPSSLDAKDIQKAAAEAAEAFRPMENDEAMQDERREGSEVRMPENVFIMDEDDVFGMPGLLANMAEGLLMPPPYSVTDGYGGDDMAADAD

SEQ ID NO: 2197 - protein, 216 aa, Medicago sativa subsp. falcata
  misc_feature: Public GI ID no. 157094500
  misc_feature (1)..(216): Bit score of 278.6 for HMM based on sequences of FIGURE 8.
  misc_feature (52)..(103): Pfam Name: AP2 Pfam Description: AP2 domain
  misc_feature: Functional Homolog Of SEQ ID NO. 644
MITTNNSSYSHSISSKDFSPFDASSPDSEVRLASSNPKKRAGRKIFKETRHPVYRGVRKRNLDKWVCEMREPNTKTRIWLGTFPTAEMAARAHDVAAMALRGRYACLNFADSVWRLPIPATSKIKDIQKAAAEAAEAFRPDNTLMTNNIDTVVAVVATKELNMFCVEVEEEDEVLNMPELWRNMALMSPTHSFGYHEYEDIVVQDFQDDEVSLWNF

SEQ ID NO: 2198 - protein, 213 aa, Arabidopsis thaliana
  misc_feature: Public GI ID no. 157272923
  misc_feature (1)..(213): Bit score of 439.7 for HMM based on sequences of FIGURE 8.
  misc_feature (46)..(97): Pfam Name: AP2 Pfam Description: AP2 domain
  misc_feature: Functional Homolog Of SEQ ID NO. 644
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTDHGLDMEETMVEAIYTPEQSEGAFYIDEETMFGMPSLLDNMAEGMLLPPPSVQWNHNYDGEGDGDVSLWSY

SEQ ID NO: 2199 - protein, 213 aa, Arabidopsis thaliana
  misc_feature: Public GI ID no. 157272933
  misc_feature (1)..(213): Bit score of 442.9 for HMM based on sequences of FIGURE 8.
  misc_feature (46)..(97): Pfam Name: AP2 Pfam Description: AP2 domain
  misc_feature: Functional Homolog Of SEQ ID NO. 644
MNSFSAFSEMFGSDYEPQGGDYCPMLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTDHGLDMEETMVEAIYTPEQSEGAFYMDEETMFGMPSLLDNMAEGMLLPPPSVQWNHNYDGEGDGDVSLWSY

SEQ ID NO: 2200 - protein, 213 aa, Arabidopsis thaliana
  misc_feature: Public GI ID no. 157272937
  misc_feature (1)..(213): Bit score of 441.9 for HMM based on sequences of FIGURE 8.
  misc_feature (46)..(97): Pfam Name: AP2 Pfam Description: AP2 domain
  misc_feature: Functional Homolog Of SEQ ID NO. 644
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTDHGLDMEETMVEAIYTPEQSEGAFYMDEETMFGMPSLLDNMAEGMLLPPPSVQWNHNYDGEGDGDVSLWSY

SEQ ID NO: 2201 - protein, 213 aa, Arabidopsis thaliana
  misc_feature: Public GI ID no. 157272943
  misc_feature (1)..(213): Bit score of 441.6 for HMM based on sequences of FIGURE 8.
  misc_feature (46)..(97): Pfam Name: AP2 Pfam Description: AP2 domain
  misc_feature: Functional Homolog Of SEQ ID NO. 644
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTDHGLDMEETMVEAIYSPEQSEGAFYMDEETMFGMPSLLDNMAEGMLLPPPSVQWNHNYDGEGDGDVSLWSY

SEQ ID NO: 2202 - protein, 213 aa, Arabidopsis thaliana
  misc_feature: Public GI ID no. 157272949
  misc_feature (1)..(213): Bit score of 440.6 for HMM based on sequences of FIGURE 8.
  misc_feature (46)..(97): Pfam Name: AP2 Pfam Description: AP2 domain
  misc_feature: Functional Homolog Of SEQ ID NO. 644
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTDHGLDMEETMVEAIYTPEQSEGAFYMDEETMFGMPTLLDNMAEGMLLPPPSVQWNHNYDGKGDGDVSLWSY

SEQ ID NO: 2203 - protein, 213 aa, Arabidopsis thaliana
  misc_feature: Public GI ID no. 157272953
  misc_feature (1)..(213): Bit score of 439.6 for HMM based on sequences of FIGURE 8.
  misc_feature (46)..(97): Pfam Name: AP2 Pfam Description: AP2 domain
  misc_feature: Functional Homolog Of SEQ ID NO. 644
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTDHGLDMEETMVEAIYTPEQSEGAFYLDEETMFGMPTLLDNMAEGMLLPPPSVQWNHNYDGEGDGDVSLWSY

SEQ ID NO: 2204 - protein, 216 aa, Arabidopsis thaliana
  misc_feature: Public GI ID no. 157273022
  misc_feature (1)..(216): Bit score of 425.8 for HMM based on sequences of FIGURE 8.
  misc_feature (49)..(100): Pfam Name: AP2 Pfam Description: AP2 domain
  misc_feature: Functional Homolog Of SEQ ID NO. 644
MNSFSAFSEMFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHTTTDDHGLDMEETLVEAIYTPEQSQDAFYMDEEAMLGMSSLLDIMAEGMLLPSPSVQWNYNFDVEGDDDVSLGSY

SEQ ID NO: 2205 - protein, 216 aa, Arabidopsis thaliana
  misc_feature: Public GI ID no. 157273043
  misc_feature (1)..(216): Bit score of 432.2 for HMM based on sequences of FIGURE 8.
  misc_feature (49)..(100): Pfam Name: AP2 Pfam Description: AP2 domain
  misc_feature: Functional Homolog Of SEQ ID NO. 644
MNSCSAFSEMFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYTFDVEGDDDVSLWSY

SEQ ID NO: 2206 - protein, 216 aa, Arabidopsis thaliana
  misc_feature: Public GI ID no. 157273055
  misc_feature (1)..(216): Bit score of 430.7 for HMM based on sequences of FIGURE 8.
  misc_feature (49)..(100): Pfam Name: AP2 Pfam Description: AP2 domain
  misc_feature: Functional Homolog Of SEQ ID NO. 644
MNSFSAFSEMFGSDYESPVSSGGDYSPKLATSCPKKPAGRKKFRETRHPIYRGVRQRNSGKWVCELKEPNKKTRIWLGTFQTAEMAARAHDVAAIALRGRSACLNFADSAWRLRIPESTCGKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 2207 - protein, 216 aa, Arabidopsis thaliana
  misc_feature: Public GI ID no. 157273079
  misc_feature (1)..(216): Bit score of 433.8 for HMM based on sequences of FIGURE 8.
  misc_feature (49)..(100): Pfam Name: AP2 Pfam Description: AP2 domain
  misc_feature: Functional Homolog Of SEQ ID NO. 644
MNSCSAFSEMFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAASNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 2208 - protein, 216 aa, Arabidopsis thaliana
  misc_feature: Public GI ID no. 157273087
  misc_feature (1)..(216): Bit score of 437.7 for HMM based on sequences of FIGURE 8.
  misc_feature (49)..(100): Pfam Name: AP2 Pfam Description: AP2 domain
  misc_feature: Functional Homolog Of SEQ ID NO. 644
MSSFSAFSEMFGSDYESSVSSGGDYIPTLASSCPKKPAGRKKFRETRHPVYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMASLLANMAEGMLLPLPSVQWNHNHEVDGDDDDVSLWSY

SEQ ID NO: 2209 - protein, 216 aa, Arabidopsis thaliana
  misc_feature: Public GI ID no. 157273097
  misc_feature (1)..(216): Bit score of 432.9 for HMM based on sequences of FIGURE 8.
  misc_feature (49)..(100): Pfam Name: AP2 Pfam Description: AP2 domain
  misc_feature: Functional Homolog Of SEQ ID NO. 644
MSSFSAFSEMFGSDYQSSVSSGGDYIPTLASSCPKKPAGRKKFRETRHPIYRRVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDEVSLWSY

SEQ ID NO: 2210 - protein, 216 aa, Arabidopsis thaliana
  misc_feature: Public GI ID no. 157273101
  misc_feature (1)..(216): Bit score of 440.5 for HMM based on sequences of FIGURE 8.
  misc_feature (49)..(100): Pfam Name: AP2 Pfam Description: AP2 domain
  misc_feature: Functional Homolog Of SEQ ID NO. 644
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMAETLVEAIYTAEQSENAFYMHDEAMFEMPSLLANMAEGMLLPLPSVQWNHNHEVDGDDDDVSLWSY

SEQ ID NO: 2211 - protein, 216 aa, Arabidopsis thaliana
  misc_feature: Public GI ID no. 157273107
  misc_feature (1)..(216): Bit score of 437.9 for HMM based on sequences of FIGURE 8.
  misc_feature (49)..(100): Pfam Name: AP2 Pfam Description: AP2 domain
  misc_feature: Functional Homolog Of SEQ ID NO. 644
MSSFSAFSEMFGSDYESSVSSGGDYILTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHSHEVDGDDDDVSLWSY

SEQ ID NO: 2212 - protein, 216 aa, Arabidopsis thaliana
  misc_feature: Public GI ID no. 157273119
  misc_feature (1)..(216): Bit score of 439.2 for HMM based on sequences of FIGURE 8.
  misc_feature (49)..(100): Pfam Name: AP2 Pfam Description: AP2 domain
  misc_feature: Functional Homolog Of SEQ ID NO. 644
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAVAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 2213 - protein, 216 aa, Arabidopsis thaliana
  misc_feature: Public GI ID no. 157273121
  misc_feature (1)..(216): Bit score of 434.8 for HMM based on sequences of FIGURE 8.
  misc_feature (49)..(100): Pfam Name: AP2 Pfam Description: AP2 domain
  misc_feature: Functional Homolog Of SEQ ID NO. 644
MSSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLLSVQWNHNHEVDGDDDDVSLWSY

SEQ ID NO: 2214 - protein, 216 aa, Arabidopsis thaliana
  misc_feature: Public GI ID no. 157273131
  misc_feature (1)..(216): Bit score of 439.4 for HMM based on sequences of FIGURE 8.
  misc_feature (49)..(100): Pfam Name: AP2 Pfam Description: AP2 domain
  misc_feature: Functional Homolog Of SEQ ID NO. 644
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEICDATTDHGFDMAETLVEAIYTAEQSENAFYMHDEAMFEMPSLLANMAEGMLLPLPSVQWNHNHEVDGDDDDVSLWSY

SEQ ID NO: 2215 - protein, 216 aa, Arabidopsis thaliana
  misc_feature: Public GI ID no. 157273137
  misc_feature (1)..(216): Bit score of 439.9 for HMM based on sequences of FIGURE 8.
  misc_feature (49)..(100): Pfam Name: AP2 Pfam Description: AP2 domain
  misc_feature: Functional Homolog Of SEQ ID NO. 644
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEEMLLPLPSVQWNHNHEVDGDDDDVSLWSY

SEQ ID NO: 2216 - protein, 216 aa, Arabidopsis thaliana
  misc_feature: Public GI ID no. 157273141
  misc_feature (1)..(216): Bit score of 444.9 for HMM based on sequences of FIGURE 8.
  misc_feature (49)..(100): Pfam Name: AP2 Pfam Description: AP2 domain
  misc_feature: Functional Homolog Of SEQ ID NO. 644
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPPPSVQWNHNHEVDGDDDDVSLWSY

SEQ ID NO: 2217 - protein, 216 aa, Arabidopsis thaliana
  misc_feature: Public GI ID no. 157273151
  misc_feature (1)..(216): Bit score of 440.8 for HMM based on sequences of FIGURE 8.
  misc_feature (49)..(100): Pfam Name: AP2 Pfam Description: AP2 domain
  misc_feature: Functional Homolog Of SEQ ID NO. 644
MSSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 2218 - protein, 224 aa, Arabidopsis thaliana
  misc_feature: Public GI ID no. 157273219
  misc_feature (1)..(224): Bit score of 384.2 for HMM based on sequences of FIGURE 8.
  misc_feature (52)..(103): Pfam Name: AP2 Pfam Description: AP2 domain
  misc_feature: Functional Homolog Of SEQ ID NO. 644
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGVREGERRAEEQNGGVFYMDDEALLGMPNFFENMAEGMLLPPPEVVWNHNDFDGVGDVSLWSFDE

SEQ ID NO: 2219 - protein, 224 aa, Arabidopsis thaliana
  misc_feature: Public GI ID no. 157273223
  misc_feature (1)..(224): Bit score of 382.1 for HMM based on sequences of FIGURE 8.
  misc_feature (52)..(103): Pfam Name: AP2 Pfam Description: AP2 domain
  misc_feature: Functional Homolog Of SEQ ID NO. 644
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGEREGERRAEEQNGGVFYMDDEALLGMPNFFENMAEGMLLPPPEVGWNHNDFDGVGDVSLWSFDE

SEQ ID NO: 2220 - protein, 207 aa, Vitis vinifera
  misc_feature: Public GI ID no. 157327118
  misc_feature (1)..(207): Bit score of 121.4 for HMM based on sequences of FIGURE 8.
  misc_feature (44)..(95): Pfam Name: AP2 Pfam Description: AP2 domain
  misc_feature: Functional Homolog Of SEQ ID NO. 644
MEQEQELQLQLQPPCTEDDQATSFGAVGETRRNPDAERGGTRHPVYRGVRKRRWGKWVSEIREPRKKSRIWLGSFPVPEMAARAYDVAAYHLKGRKAQLNFPDEVELLPRPSSCTARDIQAAAAEAANAVISTKKSGTDGSDGDCNGDDFWGEIELPELMDGGKELWTDTVTEFSPESCYSNDCAWEFSGDATWTDGDSHQQYMVSL

SEQ ID NO: 2221 - protein, 230 aa, Vitis vinifera
  misc_feature: Public GI ID no. 157339481
  misc_feature (1)..(230): Bit score of 146.3 for HMM based on sequences of FIGURE 8.
  misc_feature (55)..(106): Pfam Name: AP2 Pfam Description: AP2 domain
  misc_feature: Functional Homolog Of SEQ ID NO. 644
MAEPLNSETESSSNSGSSSSSSPSSPGSTQSRPNSSKPEPESKKMKRIRDSSKHPVYRGVRMRNWGKWVSEIREPRKKSRIWLGTFPTPEMAARAHDVAALSIKGNSAILNFPQLAASLPRPVSLAPRDVQAAAAKAAAMDKFDSPSSSSSSSSLSSLVSSIDLSTASDELSEIVELPNLDPSFDSPESKTDFVFDDSADGWLYPPPWLQSVEDCGKDPQSKSPFSNKIG

SEQ ID NO: 2222 - protein, 248 aa, Vitis vinifera
  misc_feature: Public GI ID no. 157340175
  misc_feature (1)..(248): Bit score of 148.2 for HMM based on sequences of FIGURE 8.
  misc_feature (61)..(112): Pfam Name: AP2 Pfam Description: AP2 domain
  misc_feature: Functional Homolog Of SEQ ID NO. 644
MGERPSSEAESTSNSTASASPSSPSSSGSSQSVPNSVSDTSKQVKAQNPATKRGRDCNRHPVYRGVRMRSWGKWVSEIREPRKKSRIWLGTFPNPEMAARAHDSAALSIKGDSAILNFPDLAHLLPRPVTLSPRDVQAAAAKAAAMETLNSTTTTTTTTSSSLSSSSEESTSDELSQIVELPNIEGELDSDESRNEFILADSVEGWLYPPPATAEENFCAYFERANCILPTVNNYKKVICFNGLLRSS

SEQ ID NO: 2223 - protein, 199 aa, Vitis vinifera
  misc_feature: Public GI ID no. 157346260
  misc_feature (1)..(199): Bit score of 185.7 for HMM based on sequences of FIGURE 8.
  misc_feature (38)..(89): Pfam Name: AP2 Pfam Description: AP2 domain
  misc_feature: Functional Homolog Of SEQ ID NO. 644
MHYSKYATNSNSSGSGASGSNASVNGGGAASSGTGRHPVYRGVRRRSSGKWVSEIREPKKPNRIWLGTFPTPEMAAVAYDVAALALKGQDAELNFPNSASSLPVPASTSPRDIQVAAASAAAAAGAAVDALSGGGSTISPIALGRSMANEFVDEDLIFDMPNLLVNMAEGMLLSPPRLDLAGEDATADFTGDHSLWNYP

SEQ ID NO: 2224 - protein, 220 aa, Vitis vinifera
  misc_feature: Public GI ID no. 157346611
  misc_feature (1)..(220): Bit score of 252.7 for HMM based on sequences of FIGURE 8.
  misc_feature (52)..(103): Pfam Name: AP2 Pfam Description: AP2 domain
  misc_feature: Functional Homolog Of SEQ ID NO. 644
MDLDRESSASSSSPTSSPSRANPVSSDSRCPSRCIPHKRKTGRKKFRKTRHPIYRGVRQRNENKWVSEVREPSKKSRIWLGTFPTPEMAARAHDAAALALRGHFASLNFPDSAWRLPRARSSSAGDVQFAAIQAAKAFQQPPSSSSSTPFVMDNMSAGEKAGDGFRTAFVDEEAMFNMPGLIDSMAEGLLLTPPAMCEGFSWDDAVSHIDLSLWNHDFLS

SEQ ID NO: 2225 - protein, 225 aa, Vitis vinifera
  misc_feature: Public GI ID no. 157357169
  misc_feature (1)..(225): Bit score of 305.3 for HMM based on sequences of FIGURE 8.
  misc_feature (65)..(116): Pfam Name: AP2 Pfam Description: AP2 domain
  misc_feature: Functional Homolog Of SEQ ID NO. 644
MDFFNQFCNSYPFPSDSHSVSTPESSSASDWQTRRTIQSDEEVLLASDRPKKRAGRRKFKETRHPVYRGVRRRNGNKWVCELREPNKKSRIWLGTYPTAEMAARAHDVAALAFRGRKACLNFADSAWSLPVPVSKDSMEIRRAAAAAAEAFRPQEKESVEAAESSIKTSAQNLLLTREELIFDTAGLLITMAEEPLHSPPPCLGDGFMWEDVELDADMSLWSYSI

SEQ ID NO: 2226 - protein, 176 aa, Vitis vinifera
  misc_feature: Public GI ID no. 157357170
  misc_feature (1)..(176): Bit score of 147.5 for HMM based on sequences of FIGURE 8.
  misc_feature (19)..(69): Pfam Name: AP2 Pfam Description: AP2 domain
  misc_feature: Functional Homolog Of SEQ ID NO. 644
MASASAGGSAKQPSPGRHPMYRGIRSRSGKWVSEIREPRKTTRIWLGTFPTAEMAAAAYDVAALALKGTEAVLNFPDFVHSYPVPASGSPSDIRSAAAAAAALKKAQTDDGSAAHSRREDDGRFDGEFVDEEALFDMPNLLVDMAEGMLVTPPRINVPSSPYTPENYDGDSLWSYF

SEQ ID NO: 2227 - protein, 226 aa, Vitis vinifera
  misc_feature: Public GI ID no. 157360805
  misc_feature (1)..(226): Bit score of 155.1 for HMM based on sequences of FIGURE 8.
  misc_feature (71)..(121): Pfam Name: AP2 Pfam Description: AP2 domain
  misc_feature: Functional Homolog Of SEQ ID NO. 644
MEEPRANVRPSDQPPPTPKIEVPDSSLSIVPPQDLSSPPSHSSSTPTSAHPSPKNLPSPTPFSGQTAGRHPFYRGIRCRGNKWVSEIREPRKTTRIWLGTYPTPEMAATAYDVAALALKGTDATLNFPNSVLDIRAAAARAAEAQQAKPESSESPNTTQPKKEETTESSSLAAGEDQFIDEEELLNMPNLLVDMAEGMLVSPPRLKSQPSDDSPENSDSDSLWSYT

SEQ ID NO: 2228 - protein, 207 aa, Vitis vinifera
  misc_feature: Public GI ID no. 157360806
  misc_feature (1)..(207): Bit score of 381.8 for HMM based on sequences of FIGURE 8.
  misc_feature (55)..(106): Pfam Name: AP2 Pfam Description: AP2 domain
  misc_feature: Functional Homolog Of SEQ ID NO. 644
MNTTSPPYSDPHPLVCNWDSLNLPDSDGGSEELMLASTHPKKRAGRKKFRETRHPVYRGVRRRNSGKWVCEVREPNKTSRIWLGTFPTAEMAARAHDVAALALRGRGACLNFADSAWRLHVPSSRDAKDIQKAAAEAAEAFRPMENDGVRTPDNVFVMDEEDVFGMPGLLVNMAEGLLMPPPHSVADGYGGDDMAADADMSLWSYSI

SEQ ID NO: 2229 - protein, 214 aa, Thlaspi arvense
  misc_feature: Public GI ID no. 157838809
  misc_feature (1)..(214): Bit score of 445.1 for HMM based on sequences of FIGURE 8.
  misc_feature (49)..(100): Pfam Name: AP2 Pfam Description: AP2 domain
  misc_feature: Functional Homolog Of SEQ ID NO. 644
MNSFSAFAEMFGSEYESPDTIGADYCPTLATSCPKKPAGRKKFRETRHPIYRGVRRRNSGKWVCEVREPNKKSRIWLGTFPTAEMAARAHDVAAIALRGRSACLNFADSAWRLRIPESTCAKDIQKAAAEAAVAFQAEMSDTTTDHGLDMEETIVEAIVNEEQSGGFYMDEEAMFGMPRLLANMAEGMLLPPPSVQWGQNYDCDGDADVSLWSY

SEQ ID NO: 2230 - protein, 247 aa, Triticum monococcum
  misc_feature: Public GI ID no. 158999374
  misc_feature (1)..(247): Bit score of 149.2 for HMM based on sequences of FIGURE 8.
  misc_feature (47)..(100): Pfam Name: AP2 Pfam Description: AP2 domain
  misc_feature: Functional Homolog Of SEQ ID NO. 644
MDTGPERNWNSPASPPSSLEQGMPTSPASPTPKRPAGRTKFKETRHPVFHGVRRRGSNGRWVCEVRVPGKRGERLWLGTHVTAEAAARAHDAAMLALYGRTPAARLNYPDSAWLLAVPSSLSDLADVRRAAIGAVVDFLRRQEAGASAGAVAEEAHVDGIASAASVPDNASSSAAASHSHSQPPCANAGYEVPDALCHDMFELHTSGEMDAGTYYADLAQGLLLEPPPPPSSGASSERGDDAALWNH

SEQ ID NO: 2231 - protein, 214 aa, Brassica juncea
  misc_feature: Public GI ID no. 159796337
  misc_feature (1)..(214): Bit score of 419.0 for HMM based on sequences of FIGURE 8.
  misc_feature (49)..(100): Pfam Name: AP2 Pfam Description: AP2 domain
  misc_feature: Functional Homolog Of SEQ ID NO. 644
MTSFSTFSEMLGSEYESPVTLGGEYCPTLAASCPKKPAGRKKFRETRHPIYRGVRLRNSGKWVCEVREPNKKSRIWLGTFLTAEIAARAHDVAAIALRGKSACLNFADSAWRLRIPETTCPKEIQKAAAEAALAFQAEINNTTTDHGLDMEETIVEAIFTEENNDVFYMDEESMLEMPALLASMAEGMLLPPPSVHFGHNYDFDGDADVSLWSY

SEQ ID NO: 2232 - protein, 205 aa, Medicago truncatula
  misc_feature: Public GI ID no. 161897785
  misc_feature (1)..(205): Bit score of 207.7 for HMM based on sequences of FIGURE 8.
  misc_feature (47)..(104): Pfam Name: AP2 Pfam Description: AP2 domain
  misc_feature: Functional Homolog Of SEQ ID NO. 644
MNIFLSSFGDYSDSSSSSETSSSEVILASARPKMRAGRRVFKETRHPVYRGVRRRNNNKWVCEMRVPNINVNKNNKSRIWLGTYPTPEMAAHAHDVAALTLKGKSACLNFADSAWRLTLPESNDAVEIRRAAMEAAKVFAIEENHNQRSDRDAVDMNMENSKKNVLEVQVPVLSSEFEDMHHNLLLSIANEPLRSNPPSPTNILW

SEQ ID NO: 2233 - protein, 230 aa, Medicago truncatula
  misc_feature: Public GI ID no. 161897787
  misc_feature (1)..(230): Bit score of 296.9 for HMM based on sequences of FIGURE 8.
  misc_feature (61)..(112): Pfam Name: AP2 Pfam Description: AP2 domain
  misc_feature: Functional Homolog Of SEQ ID NO. 644
MDMFTNNNSYSHPFSPTCSESSFPNSEGSQGMSISNEEVRLAATTPKKRAGRKKFKETRHPVYRGVRKRNLDKWVCEMREPNKKTKIWLGTFPTAEMAARAHDVAAMALRGRYACLNFADSAWRLPIPATTQAKDIQKAAAQAAEAFRPDKTSITNDIDTAISTSATAEQSRTFMEEEEEGVMNMPELLRNMALMSPTHSSGYNEYENIHVQDFQDLQDFQDEEVSLWNF

SEQ ID NO: 2234 - protein, 216 aa, Medicago sativa
  misc_feature: Public GI ID no. 166030336
  misc_feature (1)..(216): Bit score of 274.1 for HMM based on sequences of FIGURE 8.
  misc_feature (52)..(103): Pfam Name: AP2 Pfam Description: AP2 domain
  misc_feature: Functional Homolog Of SEQ ID NO. 644
MINTNNSSYSHSIYSKDFSPFDASSPDSEVRLAASNPKKRAGRKIFKETRHPVYRGVRKRNLDKWVCEMREPNTKTRIWLGTFPTPEMAARAHDVAAMALRGRYACLNFADSMWRLPIPASSSIKDIQKAATKAAEAFRPDNTLMTNDIDTVVATVATKELNMFCVEVEEEQEMLNMPELWRNMALMSPTHSFEYHEYEDIHVQDFQDDEVSLWNF

SEQ ID NO: 2235 - protein, 259 aa, Camellia sinensis
  misc_feature: Public GI ID no. 170522966
  misc_feature (1)..(259): Bit score of 334.2 for HMM based on sequences of FIGURE 8.
  misc_feature (73)..(124): Pfam Name: AP2 Pfam Description: AP2 domain
  misc_feature: Functional Homolog Of SEQ ID NO. 644
MDSSKKNVFSHYSDSLPSGSGFSSKEVAECSSASDRGTGAHPAAICSDDELLLASRNPKKRGGRKKVKETRHPVYRGVRWRNAHTWVCEVREPNKKSRIWLGTFPTAEMAARAHDVAAIALRNRMACVNFADSVWRLPVPASLDPKDIQKAAAEAAEMFRPPLLEEKKDVPGDVAQPEEDATLITTATTTATETATETTMPENLLFMDDEAIFGMPGLLANMAEGLMLPPPPPHSEGGDWYEGDDAELGDDVSLWSFSI

SEQ ID NO: 2236 - protein, 205 aa, Glycine max
  misc_feature: Public GI ID no. 171191038
  misc_feature (1)..(205): Bit score of 297.3 for HMM based on sequences of FIGURE 8.
  misc_feature (55)..(106): Pfam Name: AP2 Pfam Description: AP2 domain
  misc_feature: Functional Homolog Of SEQ ID NO. 644
MFSINHFSAPDANSPGSGSGTSRPVPALSDEDYFLAASNPKKRAGRKKFRETRHPVYRGVRRRDSGKWVCEVREPNKKSRIWLGTFPTAEMAARAHDVAALALRGRSACLNFADSASRLPVPATAEARDIQKAAAEAAEAFRPGKDDGAVVATATEREEEEEKVVPEYLRNMVLMSPTHCFGSDEYGSADVEFDDAEVRLWSYSI

SEQ ID NO: 2237 - protein, 203 aa, Lycopersicon hirsutum
  misc_feature: Public GI ID no. 171191040
  misc_feature (1)..(203): Bit score of 388.2 for HMM based on sequences of FIGURE 8.
  misc_feature (47)..(98): Pfam Name: AP2 Pfam Description: AP2 domain
  misc_feature: Functional Homolog Of SEQ ID NO. 644
MFYSDPRIESSSSDSFRANHSDEEVILASNNPKKPAGRKKFRETRHPVYRGVRKRNSGKWVCEVREPNKKSRIWLGTFPTAEMAARAHDVAAIALRGRSACLNFADSAWRLPTPASSDTKDIQKAAAEAAESFRPLKSEEEESVVKDQSTTPDDMFFMDEEALFCMPGLLTNMAEGLMVPPPQCTEMGDHVEADDMPLWSYSI

SEQ ID NO: 2238 - protein, 222 aa, Lycopersicon hirsutum
  misc_feature: Public GI ID no. 171191041
  misc_feature (1)..(222): Bit score of 414.7 for HMM based on sequences of FIGURE 8.
  misc_feature (56)..(107): Pfam Name: AP2 Pfam Description: AP2 domain
  misc_feature: Functional Homolog Of SEQ ID NO. 644
MNIFETYNSDSLISTESSSSSSSSLSSSFSEEEIILASNNPKRPAGRKKFRETRHPIYRGIRKRNSGKWVCEVREPNKKTRIWLGTFPTAEMAARAHDVAALALRGRSACLNFSDSAWRLPIPASSNSKDIQKAAAEAAEIFRPLKESEEVSGESDNSTSPETSENVQESSDFVDEEAIFFMPGLLANMAEGLMLPPPQCAEMGDHYVETDAYMITLWNYSI

SEQ ID NO: 2239 - protein, 223 aa, Lycopersicon hirsutum
  misc_feature: Public GI ID no. 171191042
  misc_feature (1)..(223): Bit score of 385.4 for HMM based on sequences of FIGURE 8.
  misc_feature (60)..(111): Pfam Name: AP2 Pfam Description: AP2 domain
  misc_feature: Functional Homolog Of SEQ ID NO. 644
MDIFESYYSNLLVESSLLSSSSMSDTNNINHYSPNEEIILASNNPKKPAGRKKFRETRHPVYRGVRKRNSGKWVCEVREPNKKSRIWLGTFPTVEMAARAHDVTALALRGRSACLNFADSAWRLPIPASSNSKDIQKAAAEAAEIFRPLKESEEVSGESPETSENVQESSYFVDEEALFFMPGLLANMAEGLMLPPPQCLEIGDHYVELADVHTYMPLWDYSI

SEQ ID NO: 2240 - protein, 189 aa, Solanum tuberosum
  misc_feature: Public GI ID no. 171191045
  misc_feature (1)..(189): Bit score of 356.3 for HMM based on sequences of FIGURE 8.
  misc_feature (32)..(83): Pfam Name: AP2 Pfam Description: AP2 domain
  misc_feature: Functional Homolog Of SEQ ID NO. 644
MDQLNKNSSLILASNNPKKPAGRKKFRETRHPVYRGVRMRNSGKWVCEVREPNKKSRIWLGTYPTAEMAARAHDVAAIALRGGSACLNFADSAWRLPTPASSDTKDIQKAAAEAAESFRPLKSEEESVVSTGDQSSTPDNMFFMDEEALFCMPGLLTNMAEGLMVPPPQCTEMGDHVEADDMPLWSYSI

SEQ ID NO: 2241 - protein, 197 aa, Solanum tuberosum
  misc_feature: Public GI ID no. 171191046
  misc_feature (1)..(197): Bit score of 355.5 for HMM based on sequences of FIGURE 8.
  misc_feature (32)..(83): Pfam Name: AP2 Pfam Description: AP2 domain
  misc_feature: Functional Homolog Of SEQ ID NO. 644
MDQLNKNSSLILASNNPKKPAGRKKFRETRHPVYRGVRMRNSGKWVCEVREPNKKSRIWLGTFPTAEMAARAHDVAALALRGRSACLNFADSAWRLPIPASSNSKDIQKAAAEAAEIFRPSEESERVASSEMHESIFFMNDEGRESSFFMDEEALFDMPGLIANMAEGLMLPPPQCAEVEDHYYMEADDAYMPLWNY

SEQ ID NO: 2242 - protein, 193 aa, Solanum commersonii
  misc_feature: Public GI ID no. 171191048
  misc_feature (1)..(193): Bit score of 343.3 for HMM based on sequences of FIGURE 8.
  misc_feature (32)..(83): Pfam Name: AP2 Pfam Description: AP2 domain
  misc_feature: Functional Homolog Of SEQ ID NO. 644
MDQLNKNSSLILASNNPKKPAGRKKFRETRHPVYRGVRMKNSGKWVCEVREPNKKTRIWLGTFPTAEMAARAHDVAAIALRGRSACLNFADSAWRLPIPASSNSKDIQKAAAEAAEIFRPLSSESEGVSGECVVSTPEMRENSFFMDEEELLYMPGLIANMAEGLMLPPPQCAEVEDHYYMEADDAYMPLWNY

SEQ ID NO: 2243 - protein, 203 aa, Lycopersicon hirsutum
  misc_feature: Public GI ID no. 171191051
  misc_feature (1)..(203): Bit score of 386.5 for HMM based on sequences of FIGURE 8.
  misc_feature (47)..(98): Pfam Name: AP2 Pfam Description: AP2 domain
  misc_feature: Functional Homolog Of SEQ ID NO. 644
MFYSDPRIESSSSDSIRANHSDEEVILASNNPKKPAGRKKFRETRHPVYRGVRKRNSGKWVCEVREPNKKTRIWLGTFPTAEMAARAHDVAAIALRGRSACLNFADSAWRLPTPASSDTKDIQKAAAEAAESFRPLKSEEEESVVKDQSTTPDDMFFMDEEALFCMPGLLTNMAEGLMVPPPQCTEMGDLVEADDMPLWSYSI

SEQ ID NO: 2244 - protein, 219 aa, Lycopersicon hirsutum
  misc_feature: Public GI ID no. 171191052
  misc_feature (1)..(219): Bit score of 414.2 for HMM based on sequences of FIGURE 8.
  misc_feature (53)..(104): Pfam Name: AP2 Pfam Description: AP2 domain
  misc_feature: Functional Homolog Of SEQ ID NO. 644
MNIFETYNSDSLISTESSSSSSSSLFSEEEIILASNNPKRPAGRKKFRETRHPIYRGIRKRNSGKWVCEVREPNKKTRIWLGTFPTAEMAARAHDVAALALRGRSACLNFSDSAWRLPIPASSNSKDIQKAAAEAAEIFRPLKESEQVSGESDNSTSPETSENVQESSDFVDEEAIFFMPGLLANMAEGLMLPPPQCAEMGDHYVETDAYMITLWNYSI

SEQ ID NO: 2245 - protein, 223 aa, Lycopersicon hirsutum
  misc_feature: Public GI ID no. 171191053
  misc_feature (1)..(223): Bit score of 387.4 for HMM based on sequences of FIGURE 8.
  misc_feature (60)..(111): Pfam Name: AP2 Pfam Description: AP2 domain
  misc_feature: Functional Homolog Of SEQ ID NO. 644
MDIFESYYSNLLVESSLLSSLSMSDTNNINHYSPNEEIILASNYPKKPAGRKKFRETRHPVYRGVRKRNSGKWVCEVREPNKKSRIWLGTFPTVEMAARAHDVAALALRGRSACLNFADSAWRLPIPASSNSKDIQKAAAEAAEIFRPLKESEEVSGESPETSENVQESSYFVDEEALFFMPGLLANMAEGLMLPPPQCLEIGDHYVELADVHAYMPLWDYSI

SEQ ID NO: 2246 - protein, 216 aa, Lycopersicon pimpinellifolium
  misc_feature: Public GI ID no. 171191057
  misc_feature (1)..(216): Bit score of 400.3 for HMM based on sequences of FIGURE 8.
  misc_feature (53)..(104): Pfam Name: AP2 Pfam Description: AP2 domain
  misc_feature: Functional Homolog Of SEQ ID NO. 644
MNIFETYYSDSLILTESSSSSSSSSFSEEEVILASNNPKKPAGRKKFRETRHPIYRGIRKRNSGKWVCEVREPNKKTRIWLGTFPTAEMAARAHDVAALALRGRSACLNFSDSAWRLPIPASSNSKDIQKAAAEAAEIFRPLKESEEVSGESPETSENVQESSDFVDEEALFSMPGLLANMAEGLMLPPPQCLEIGDHYVELADVHAYMPLWNYSI

SEQ ID NO: 2247 - protein, 217 aa, Solanum commersonii
  misc_feature: Public GI ID no. 171191059
  misc_feature (1)..(217): Bit score of 400.3 for HMM based on sequences of FIGURE 8.
  misc_feature (60)..(111): Pfam Name: AP2 Pfam Description: AP2 domain
  misc_feature: Functional Homolog Of SEQ ID NO. 644
MDIFRSYYSDPQLESSSSFSDTTTYNSPNRANHSDEEVILASNNPKKPAGRKKFRETRHPVYRGVRMRNSGKWVCEVREPNKKTRIWLGTFPTAEMAARAHDVAAIALRGRSACLNFADSAWRLPTPASSDTKDIQKAAAEAAKSFRPLKSEEESVVTTGDQTSTPDDMFFMDEEALFCMPGLLTNMAEGLMVPPPQCTEMGDHVEADDMPLWSYSI

SEQ ID NO: 2248 - protein, 224 aa, Solanum commersonii
  misc_feature: Public GI ID no. 171191060
  misc_feature (1)..(224): Bit score of 403.2 for HMM based on sequences of FIGURE 8.
  misc_feature (52)..(103): Pfam Name: AP2 Pfam Description: AP2 domain
  misc_feature: Functional Homolog Of SEQ ID NO. 644
MSIFETYYSDPLILTESSSSSSSSSSDHEIILASNNPKRPAGRKKFRETRHPIYRGIRMRNSGKWVCEVREPNKKSRIWLGTFPTAEMAARAHDVAALALRGRSACLNFADSTWRLPIPASSNSNDIQKAAAEAAEIFRSSSEESEEVSGESDNSTPETPENAFFMNDEVQESSFFMDEEALFFMPGLIANMAEGLMLPPPQCAEMGDHYVEADAYMALWNYSI

SEQ ID NO: 2249 - protein, 235 aa, Solanum commersonii
  misc_feature: Public GI ID no. 171191061
  misc_feature (1)..(235): Bit score of 384.7 for HMM based on sequences of FIGURE 8.
  misc_feature (60)..(111): Pfam Name: AP2 Pfam Description: AP2 domain
  misc_feature: Functional Homolog Of SEQ ID NO. 644
MFPSYYSEPLAQLSSSSSISDNSNHYSPNNNFSDEEVINLASNNPKKPAGRKKFRETRHPVFRGIRMRNSGKWVCEVREPNKKSRIWLGTFPTAEMAARAHDVAALALRGRSACLNFADSVWRLPIPASSNSKDIQKAAAEAAEIFRPSSLEEESEEVSGECSNTTTPETPEKALSMNEEAQVNSFFMDEEALFYMPGLIANMAEGLMLPLPQCLEIGDYVEADHAYISLWNYSI

SEQ ID NO: 2250 - protein, 217 aa, Solanum tuberosum
  misc_feature: Public GI ID no. 171191063
  misc_feature (1)..(217): Bit score of 401.7 for HMM based on sequences of FIGURE 8.
  misc_feature (60)..(111): Pfam Name: AP2 Pfam Description: AP2 domain
  misc_feature: Functional Homolog Of SEQ ID NO. 644
MDIFRSYYSDPQIESSSSFSDTTTYNSPNRANHSDEEVILASNNPKKPAGRKKFRETRHPVYRGVRMRNSGKWVCEVREPNKKTRIWLGTFPTAEMAARAHDVAAIALRGRSACLNFADSAWRLPTPASSDTKDIQKAAAEAAESFRPLKSEEESVVITGDQSSTPDDMFFMDEEALFCMPGLLTNMAEGLMVPPPQCTEMGDHVEADDMPLWSYSI

SEQ ID NO: 2251 - protein, 234 aa, Solanum tuberosum
  misc_feature: Public GI ID no. 171191065
  misc_feature (1)..(234): Bit score of 380.1 for HMM based on sequences of FIGURE 8.
  misc_feature (63)..(114): Pfam Name: AP2 Pfam Description: AP2 domain
  misc_feature: Functional Homolog Of SEQ ID NO. 644
MFPSYYSEPLAELSPSSSSSSISDNSNHYYPNNNFSDEEVINLASNNPKKPAGRKKFRETRHPVFRGIRMRNSGKWVCEVREPNKKSRIWLGTFPTAEMAARAHDVAALALRGRSACLNFADSVWRLPIPASSNSKDIQKAAAEAAEIFRPSESEEVSGECSNITTPETPEKALSMNEEAQVNSFFMDEEALFYMPGLIANMAEGLMLPLPQCLEIGDYVEADHAYISLWNYSI

SEQ ID NO: 2252 - protein, 226 aa, Solanum tuberosum
  misc_feature: Public GI ID no. 171191066
  misc_feature (1)..(226): Bit score of 372.9 for HMM based on sequences of FIGURE 8.
  misc_feature (55)..(106): Pfam Name: AP2 Pfam Description: AP2 domain
  misc_feature: Functional Homolog Of SEQ ID NO. 644
MDIYYSDPLAESSISDTNNNHYSPNNFSDEEVINLASNNPKKPAGRKKFRETRHPVYRGVRMRNSGKWVCEVREPNKKSRIWLGTFPTVEMAARAHDVAALALRGRRSACLNFADSAWRLPIPASSNSKDIQKAAAEAAEIFRPESEEVSGECSSSTTPETLENTFFMKEESSLFMDEEALFYMPGLIVNMAEGLMLPPPQCLEIGDHYVELVDMHAYMPLWNYSI

SEQ ID NO: 2253 - protein, 242 aa, Oryza sativa subsp. indica
  misc_feature: Public GI ID no. 172044098
  misc_feature (1)..(242): Bit score of 151.7 for HMM based on sequences of FIGURE 8.
  misc_feature (49)..(102): Pfam Name: AP2 Pfam Description: AP2 domain
  misc_feature: Functional Homolog Of SEQ ID NO. 644
MDVARDMEKNTTAMGQLMSSSATTAATATGPASPKRPAGRTKFQETRHPVFRGVRRRGRAGRWVCEVRVPGSRGDRLWVGTFDTAEEAARAHDAAMLAMCGASASLNFTDSAWLLHVPRAPVASGHDQLPDVQRAASEAVAEFQRRGSTAATATATSGDAASTAPPSSSPVLSPNDDNASSASTPAVAAALDHGDMFGGMRADLYYASLAQGLLIEPPPPPTTTEGFCDDEGCGGAEMELWS

SEQ ID NO: 2254 - protein, 215 aa, Nicotiana tabacum
  misc_feature: Public GI ID no. 190333400
  misc_feature (1)..(215): Bit score of 398.4 for HMM based on sequences of FIGURE 8.
  misc_feature (49)..(100): Pfam Name: AP2 Pfam Description: AP2 domain
  misc_feature: Functional Homolog Of SEQ ID NO. 644
MTSFSAFSELLGSEHESPVTLGEEYCPKLAAGCPKKPAGRKKFRETRHPVYRGVRLRNSGKWVCEVREPNKKSRIWLGTFLTAEIAARAHDVAAIALRGKSACLNFADSAWRLRIPETTCPKDIQKAAAEAAVAFQAEINDTTTDHDFDVEETIVEAIFTEENNDGFYMDEEESMFGMPSLVASMAEGMLLPPPSVRFEHNYDFDGDADASLWSY

SEQ ID NO: 2255 - protein, 215 aa, Nicotiana tabacum
  misc_feature: Public GI ID no. 190333402
  misc_feature (1)..(215): Bit score of 363.2 for HMM based on sequences of FIGURE 8.
  misc_feature (58)..(109): Pfam Name: AP2 Pfam Description: AP2 domain
  misc_feature: Functional Homolog Of SEQ ID NO. 644
MDIFRSYYSDTLTESSSLSENSSSSRNRANLSDEEVMLASNNPKKRAGRKKFRETRHATYRGVRKRNSDRWVCEIRQPNKKSRIWLGTYPTAEMAARAHDVAAIALRGRSACLNFADSVWKLHIPASADAKDIQRAAAEAAEAFGRPSESEEADSGTTPETPESSKLFMDEEALFCMPGLLANMAEGLMLPPPHYVEVGDYVEAAADMPQWSYTM

SEQ ID NO: 2256 - protein, 217 aa, Nicotiana tabacum
  misc_feature: Public GI ID no. 190333404
  misc_feature (1)..(217): Bit score of 408.2 for HMM based on sequences of FIGURE 8.
  misc_feature (57)..(108): Pfam Name: AP2 Pfam Description: AP2 domain
  misc_feature: Functional Homolog Of SEQ ID NO. 644
MEMCRSYYSDPLADSSSLSDSSSSCNRAIRSNEEVMLASNNPKKRAGRKKFRETRHPVYRGVRKRNSGKWVSEVREPNKKSRIWLGTFPSAEMAARAHDVAAIALRGRSACLNFADSAWKLPVPASSDAKNIQKAAAEAAEAFRSSEAENMPEYTGEDSKEVNTTPENMFYMDEEALFCMPGLLANMAEGLMLPPPQCSQIGDDHMEADMPLWSYSI

SEQ ID NO: 2257 - protein, 232 aa, Nicotiana tabacum
  misc_feature: Public GI ID no. 190333406
  misc_feature (1)..(232): Bit score of 377.0 for HMM based on sequences of FIGURE 8.
  misc_feature (68)..(119): Pfam Name: AP2 Pfam Description: AP2 domain
  misc_feature: Functional Homolog Of SEQ ID NO. 644
MNIFGDHNFDPLIPTLSTSLLPAAESSTSSDSGSSGSTPNYSDEEVMLASNYPKKRAGRKKFRETRHPVYRGIRRRNSNKWVCEVREPNKKSRIWLGTFPTAEMAARAHDVAAIALRGRSACLNFADSAWRLPIPTSAAAKDIQKATVEAAETFRPVESHRENFKEIIVDQVIQELVAELPDNVLFMDEEALFCMPRLLVNMAEGLMLPPPQCIIDGYEMEADHADMSLWSY

SEQ ID NO: 2258 - protein, 229 aa, Eucalyptus gunnii
  misc_feature: Public GI ID no. 193161361
  misc_feature (1)..(229): Bit score of 336.0 for HMM based on sequences of FIGURE 8.
  misc_feature (67)..(118): Pfam Name: AP2 Pfam Description: AP2 domain
  misc_feature: Functional Homolog Of SEQ ID NO. 644
MNHFFSSYSDPSSCILDFAEASSSSSPLSDGRSAMAPGNFSDEEVLLASHLPKKRAGRKKFQETRHPVYRGVRRRSSGKWVCEVREPDKKSGIWLDTFPTAEMAARAHNVAALALWGRSACLNFADSAWRLPAPASADAKDIQQAAAQAAEAFRPAESEAEDVMSGYERKPPSEEGMLYDDEDVFGMPGLLTNMAEGMLLLPPQCGGDGYGGEDDGNLDAYVSLWSYSM

SEQ ID NO: 2259 - protein, 205 aa, Arachis hypogaea
  misc_feature: Public GI ID no. 194466099
  misc_feature (1)..(205): Bit score of 132.7 for HMM based on sequences of FIGURE 8.
  misc_feature (30)..(81): Pfam Name: AP2 Pfam Description: AP2 domain
  misc_feature: Functional Homolog Of SEQ ID NO. 644
MAEASTTSSTTRSPKKQSKPKKPRDCSKHPVYHGVRMRNWGKWVSEIREPRKKSRIWLGTFATPEMAARAHDVAALCIKGKAAILNFPKIAKLLPRPVTPTPRDIQAAAAEAAAMVDFDSVSSDSEEGTEETESSELSEIVELPNIEEKSFDSVDSGTEFMLLDSVDSWVFPPMAASTLSEMMMMFEAEDLSASECVGSNFGVSV

SEQ ID NO: 2260 - protein, 246 aa, Zea mays
  misc_feature: Public GI ID no. 194699552
  misc_feature (1)..(246): Bit score of 160.8 for HMM based on sequences of FIGURE 8.
  misc_feature (52)..(105): Pfam Name: AP2 Pfam Description: AP2 domain
  misc_feature: Functional Homolog Of SEQ ID NO. 644
MDMGRHQLQLQHAASSSSTSASSSSEQDKPLCCSGPKKRPAGRTKFRETRHPVFRGVRRRGAAGRWVCEVRVPGRRGARLWLGTYLGAEAAARAHDAAMLALGRGAACLNFPDSAWLLAVPPPPALSGGLDGARRAALEAVAEFQRRRFGAAAADEATSGTSPPSSSSSATKPAPAIERVPVEASETVALDGAVFEPDWFGDMDLDLYYASLAEGLLVEPPPPPPPAAWDHGDCCDSGADVALWSY

SEQ ID NO: 2261 - protein, 240 aa, Prunus canescens x Prunus cerasus
  misc_feature: Public GI ID no. 194740426
  misc_feature (1)..(240): Bit score of 316.6 for HMM based on sequences of FIGURE 8.
  misc_feature (59)..(111): Pfam Name: AP2 Pfam Description: AP2 domain
  misc_feature: Functional Homolog Of SEQ ID NO. 644
MDMFFSQLSDSVDQPESSSLSDASITTRGASCSNGDVILASSRPKKRAGRRVFKETRHPVYRGVRRRNNDKWVCEMREPNNKKSRIWLGTYPTAEMAARAHDVAALAFRGKLACLNFADSTWRLPLPASMDTMDIRRAAAEAAEGFRPAEFGGVCSGSSDEKERMVVQVEEKNKKGSVNLERSRSLSLSYWDEDEVFDMPRLLHDMAEGLLLSPSQCLGGYMNLDDMGTDADVKLWSFSI

SEQ ID NO: 2262 - protein, 207 aa, Chrysanthemum x morifolium
  misc_feature: Public GI ID no. 90109878
  misc_feature (1)..(207): Bit score of 241.5 for HMM based on sequences of FIGURE 8.
  misc_feature (60)..(112): Pfam Name: AP2 Pfam Description: AP2 domain
  misc_feature: Functional Homolog Of SEQ ID NO. 644
MDMNAPYNSFPSSSLSSSSSTETPLMCSFSSSEPDQVVMLASENPKKRAGRKKFTETRHPVYRGVRSRDKGRKWVCEVRHPITQSRVWLGTHPNAEMAARAHDVAVLAMRGPKYACLNFADSVWRLPVPESNHVADIQKAAAEAAEAFRHTKPEVAMDYYMNEDELPGFLDSMAEALMLPPPQSFVGYGSNIFDDVESCADMSLWNF

SEQ ID NO: 2263 - protein, 203 aa, Chrysanthemum x morifolium
  misc_feature: Public GI ID no. 90109880
  misc_feature (1)..(203): Bit score of 323.8 for HMM based on sequences of FIGURE 8.
  misc_feature (46)..(97): Pfam Name: AP2 Pfam Description: AP2 domain
  misc_feature: Functional Homolog Of SEQ ID NO. 644
MATFIQFNAGNIPTESCSTSDEDVHLASQNPKKRAGRKKFKETRHPVYRGVRKRDSGKWVCEVREPNKKKSVWLGTYPTADMAARAHDVAVLAMRGRSVCLNFADSLWRLPVPKSSNVKDIQKAAVKAAEAFRPVNDDVALAEESNQVKENHVIYMDDDVVFEMQGFFADMAEGMMLPPPKSIGYDNCVDDVEFSVDVSLWSF

SEQ ID NO: 2264 - protein, 455 aa, Vitis vinifera
  misc_feature: Public GI ID no. 157346776
  misc_feature (1)..(455): Bit score of 600.3 for HMM based on sequences of FIGURE 4.
  misc_feature (45)..(101): Pfam Name: Homeobox Pfam Description: Homeobox domain
  misc_feature: Functional Homolog Of SEQ ID NO. 317
MFPGRFFFFPIVIFSTNIMYFFSAFNVSESSEVHSEENKICEEKNKKRRLKTPSQVQALEKFYNEHKYPTESMKSELAEEIGLTEKQISGWFCHRRLKDKKLLEDEAGANGRQDRSSGVIQDRGSGYRQDSCGSTKHGDYRHIDPREVESRSHYTGNFSGRGDTSSESSSDLQDRFFPQNEDPFDVETSKLPTRSGIVMPINTKGTQNRGFVRPSGYLKVKGEIENVAITAVKRQLGRHYREDGPPLGVEFQPLPPGAFESSIRDQDDEPYYVGNSIMSQSPDNPGVPKPPSLSTRYEVCSSKLASQNSCMEEANFGTMHGFDSRDNYSNRQLKQKGSFPNYSNLSPGWNFSKDMHEDAAGETSFVNSNKNYEMRSNPGIEGMRLSSVSNRRLHPYGGKVTSEQTDSWLHEYDDIRPKIVQQKEYLKSKPSNLILQQSGSCDDEGRGQLRNMAKV

SEQ ID NO: 2265 - DNA, 1863 bp, Solanum lycopersicum
  misc_feature: Ceres Annot ID no. 8459276
  misc_feature: Encodes the peptide sequence at SEQ ID NO. 2266
atgaattctctagatttaagcgaagtgcattctaaggatgataaaggtcagaccgagaaaaatcccaaaagaataatcaagacgcgtgctcagattgaagctctagagaaactttatgaagaacacaagtaccctaccgacgagctgaaagctgatctggcagagtcatcagggttaacagaaaaacaaatttctggatggttttgtcacaggcggttgaaagacaagaggctgtcgaatggggaaatatatataaatggaagacaagatcgttcgagtggtgtcattcaagatcatggtagcggatttaggcaggattcttgtggtagcaccaagcaagcagacgataagaaatttgatcatcgggaagttgagagtagaagattaactggcgcggaattctcaactgcagatgtggcatatgagggtggaactcattttagaggaaaatctaattgcatggatgatgactcttcaagaagcagttcttcattacggaatgaatgtttttcgcaaaatgcagaaccatatgataaagcaacttcaagatacatatcacagactttagctactgattttaagggagtaagaccaaagaatggtccatctgggtacttgaaagtaaagggtcaggtagagaatgctgcaattactgctgtgaagaggcaattggggaggcactaccgactggatggtccaccacttggtattgaattcgatcctcttcctcctggtgcctttgaatcatcagcgccaaatcttgtcaatggtgagaaagggacagtgctccaggtctttgtacatatgctattcatattttcaccctgccaactgagtagtaaacttttcatctcatatggcatatccactgtagccctaaaatcttcaaaaacattgtctagatcttccagaaaaaacaaaaggcttcacctttatcgccatggcttcacctttgaagatcacctcgccacaaagctaatagactcttattactctccagaacctgttccagcttgctcaccagatatgtccaacgtctacaggcggtcaaatggattcggacccaatttcaagtccaactctcatgactctgatctggatggtttgagcttcaaaagaaaatctaattctactcatcctgaatatcgcttcaacccaaagcctaagctgaagtcctccgagtataatgaatatcctgaatggaactcatcattagacatgtttgaaggttctgctagaaaaatgacagttgatagcagagacagctgtaagcttatggcaaaacatggacgtggagagattagaactagtactggttcaggcaatgatcttcgaagtccctatgttggaaaagttgatcgggagcaagtgaaaccacggtttagtagccgtagtgaagtgagtcttacggctttggagaaggaacatttagatcgcaagccttctgattttaacggaagcgggtatcctaatttcagggagagagagcttcacaaaattgttgaaaaggaccacatcagtggaaagaggccagtagttgatgagaactctaatctagttcgtgtgaaggttcaggttccccggcacaatgagataacaattgttcaacgagcaccagttgaagttcctgaccatcaagcgtacttgaggagagcatctatgataggaatgccaccgcagacaaatcatcagataagtactgctgccgagaagccacctagctttagtgaagatgaagaaacagaagacaccagttcgttcgaggagaagatgcccttttcgcaatatgagcatgggggtcatgctgatccactcggtaccatgccaaagggacatataccgaagagcagagttatcatatga

SEQ ID NO: 2266 - protein, 620 aa, Solanum lycopersicum
  misc_feature: Ceres Annot ID no. 8459276
  misc_feature (1)..(620): Bit score of 299.8 for HMM based on sequences of FIGURE 4.
  misc_feature (21)..(77): Pfam Name: Homeobox Pfam Description: Homeobox domain
  misc_feature: Functional Homolog Of SEQ ID NO. 317
MNSLDLSEVHSKDDKGQTEKNPKRIIKTRAQIEALEKLYEEHKYPTDELKADLAESSGLTEKQISGWFCHRRLKDKRLSNGEIYINGRQDRSSGVIQDHGSGFRQDSCGSTKQADDKKFDHREVESRRLTGAEFSTADVAYEGGTHFRGKSNCMDDDSSRSSSSLRNECFSQNAEPYDKATSRYISQTLATDFKGVRPKNGPSGYLKVKGQVENAAITAVKRQLGRHYRLDGPPLGIEFDPLPPGAFESSAPNLVNGEKGTVLQVFVHMLFIFSPCQLSSKLFISYGISTVALKSSKTLSRSSRKNKRLHLYRHGFTFEDHLATKLIDSYYSPEPVPACSPDMSNVYRRSNGFGPNFKSNSHDSDLDGLSFKRKSNSTHPEYRFNPKPKLKSSEYNEYPEWNSSLDMFEGSARKMTVDSRDSCKLMAKHGRGEIRTSTGSGNDLRSPYVGKVDREQVKPRFSSRSEVSLTALEKEHLDRKPSDFNGSGYPNFRERELHKIVEKDHISGKRPVVDENSNLVRVKVQVPRHNEITIVQRAPVEVPDHQAYLRRASMIGMPPQTNHQISTAAEKPPSFSEDEETEDTSSFEEKMPFSQYEHGGHADPLGTMPKGHIPKSRVII

SEQ ID NO: 2267 - DNA, 2691 bp, Gossypium hirsutum
  misc_feature: Ceres Clone ID no. 1927381
  misc_feature: Encodes the peptide sequence at SEQ ID NO. 2268
gccattttctgtggagaagttgcagagattttgagtctctctctttttatattgtgaagctgggaattcattaaaagaaaaacccataaattccatagatagaccatattcagaatctctttctcatcaattatggtattttaactataattatatcacctttactttccctttagttgattcgcagtgatgaagatgatcataaagcacgtgcacactcgtattaacatcaaaccaggatccacttgatcatcccaatatcatcatttaattagttcccgttgcagctataatttatcagacaagcaagttcttaaatgggttgattcaaagtttgatgattgattgtgaagaataagtgaagtgaaagcacagaaaataacagcaaacacaacagaaacagcatccgatggcgacgtactttcatgggaaccctgaaatccaagcacctgatggtcttcaaaccctcgtactcatgaaccctgcttatgttcagtactccgacaccactccgccgccgcagccaaacaacctcgtttttcacgctccaccacctccccaaactcaacaatttgtcggtgtcccacttacggctacttccaccgccaaccaagaccctccttcccacgaaatctcccccttgcatggcctcgttcaacgcgtccattacaacttgtacaaccctattgacccttccggagcagcgcgtgaaactccacgcgctcagcaaggactctctttgagcctttcttcccaacaacaacaacatcatcatggttacggatcacatgcacaagcggtttcaggtgaggatatgagggtttccggtgggtcgggttcgtcgggttcaggtgtgactaatggagtttcgggtgtacaaagtatgctgttgagctctaaattcttgaaggctgctcaagagcttctcgatgaggttgttaatgttaacaataccgggattaccaagaacgaattggctaaaaagggtagaggaggaggagacaatagcaatagcagtaaggttgtcggagaatccgcggcggcagccggagatgcagatgggaagcaaggacccgaactgactacggcggagagacaggaaattcagatgaagaaggcaaagctaattagcatgcttgatgaggtggatcaaaggtacaggcaataccatcaccagatgcagatagtgatatcatcatttgaacaagcagctggaatcggctctgctaaaacatacacatctcttgccttaaaaaccatctcaaagcagtttcgatgtttgaaagatgcaataacaggtcaaatccgggcagccaacaagagcttgggtgatgaagattgtctaggaggtagcaaaatagaagggtcaaggcttaagttggtggatcatcatcttcgacaacagcgagcacttcagcagttaggaatgatccaacacaatgcttggagaccccaaagaggattacctgaaagatcagtctcagttcttcgtgcttggctctttgaacactttcttcatccgtaccctaaagattcagacaaggtcatgcttgctaaacaaacagggcttactaggagtcaggtgtctaattggttcataaatgctcgagttcggctttggaaaccaatggtggaagagatgtatttggaagaaatcaaggaacaagaacagaatggttcagaggagaaaacaagtaaaagccataacaatgaagattcaacatccaaatccactgcaccagacaaaactagtacagaaaacaaacaggacaataatatcccaaatcagaatggttgttcctcaatgtcggtttcaatgggttcagcgtctccccttatcggtaaccagtcaggattttccttcattggatcatctgaattggaagggatcacacaaggaagtccaaagaaaccgagaaccaataatgaagttacaatgaagtttgacaaagatgggtacacattcatgggaggaacaactaataatgatttcatgggtggttttggacaataccccattggagaaataacaaggtttgatacagaacagttcactccaaggttttcaggcaatggtgtttcactcactttgggacttccccattgtgaaaacctgtctttatcaggcacccctcatcaaacttttctccctaaccaagccatgcaaatggggagaagggtcgacattggtgaacccaatgagtttgggtctataaacccttccacaccacactcttcagctgcatatgacaacatcaacattcagaacaggaaaaggtttgcagcacaattgttacccgactttgttgcctgactaaacttacaggggctgcttcacattttccaggaaaatgaatggtagtgtaaagataaaagaagaaaacgaatttcagcctagtataggtttttatactttttgccaagtacaatttgagtcctttagacagtttaggattctcagcatatatttgaggattgtatattaattttgtaatgggggattgggatagatggattgatatcatcaaattagttacttggggtatacttggtataatcaaattctagtccatttggggtatgaatttattagtatttctttagcaaatttataaatttagttcttttttctgatgtttaatcagttgataagaacataaataagatggtgtcaccattttattactgctt

SEQ ID NO: 2268 - protein, 634 aa, Gossypium hirsutum
  misc_feature: Ceres Clone ID no. 1927381
  misc_feature (1)..(634): Bit score of 1317.4 for HMM based on sequences of FIGURE 21.
  misc_feature (158)..(297): Pfam Name: POX Pfam Description: Associated with HOX
  misc_feature (370)..(405): Pfam Name: Homeobox Pfam Description: Homeobox domain
  misc_feature: Functional Homolog Of SEQ ID NO. 1540
MATYFHGNPEIQAPDGLQTLVLMNPAYVQYSDTTPPPQPNNLVFHAPPPPQTQQFVGVPLTATSTANQDPPSHEISPLHGLVQRVHYNLYNPIDPSGAARETPRAQQGLSLSLSSQQQQHHHGYGSHAQAVSGEDMRVSGGSGSSGSGVTNGVSGVQSMLLSSKFLKAAQELLDEVVNVNNTGITKNELAKKGRGGGDNSNSSKVVGESAAAAGDADGKQGPELTTAERQEIQMKKAKLISMLDEVDQRYRQYHHQMQIVISSFEQAAGIGSAKTYTSLALKTISKQFRCLKDAITGQIRAANKSLGDEDCLGGSKIEGSRLKLVDHHLRQQRALQQLGMIQHNAWRPQRGLPERSVSVLRAWLFEHFLHPYPKDSDKVMLAKQTGLTRSQVSNWFINARVRLWKPMVEEMYLEEIKEQEQNGSEEKTSKSHNNEDSTSKSTAPDKTSTENKQDNNIPNQNGCSSMSVSMGSASPLIGNQSGFSFIGSSELEGITQGSPKKPRTNNEVTMKFDKDGYTFMGGTTNNDFMGGFGQYPIGEITRFDTEQFTPRFSGNGVSLTLGLPHCENLSLSGTPHQTFLPNQAMQMGRRVDIGEPNEFGSINPSTPHSSAAYDNINIQNRKRFAAQLLPDFVA

SEQ ID NO: 2269 - protein, 683 aa, Vitis vinifera
  misc_feature: Public GI ID no. 157335262
  misc_feature (1)..(683): Bit score of 423.9 for HMM based on sequences of FIGURE 21.
  misc_feature (231)..(367): Pfam Name: POX Pfam Description: Associated with HOX
  misc_feature (440)..(475): Pfam Name: Homeobox Pfam Description: Homeobox domain
  misc_feature: Functional Homolog Of SEQ ID NO. 1540
MSNSRREVLPTLNLPDLKLASYPEQPLLPGNVMMYPNQTSSAGSYSGIFIGSSPSYHNHVEVPSAGVRNEVVYIPPTGDVSMQSVGLQLKNATGAPTGNFVTGNPQIVPRTQLGILDAEQNFLPQRLSLSLSTQIPSTVPLASFQYQYVNPGLSSRFGSYVSSSAERTISCEGDESSQAKEFRNDEYLPSSFPGTDQSSVKTEALCNPRYSEIPKVTGADQCLYESFGPANTVLNSKFLKSVQQLLDEVVNVRKTLKQQEFDKHHKSNNRTILSSPIGNSSDPNGLVTNSSCKLSSTERQDLEHKKAKLLSMLDEVDKRYKQYYDQTQIVGSFFDMLAGFGAAKTYMALALQRISCHFRCLRDAISGQIRITCRNLGEQDTSPNGLGGGMSRLGYVDQQLRQQRALQQFGGMRHAWRPQRGLPESSVSILRTWLFEHFLHPYPKDSEKIMLARQTGLTRSQVANWFINARVRLWKPMVEEIYKEEIGDSETKSKSSPESPPKEPRDDSWASEDKGEELQETMTSTAAAGGHLGQSHNMTSDFMRDVEMNGPTARMSFQKGAHGDVDTDCGIMKLQGDQSSNMDDHSLYLDEFVPTNQNGDGSLMAATYHISELSDLGVGSQVSLALGLRHCESDVPSISGGPLIRGGDIAASVGPDTAEYNCMDSGNQRHRFGKPHLIHDFVV

SEQ ID NO: 2270 - protein, 633 aa, Vitis vinifera
  misc_feature: Public GI ID no. 157340404
  misc_feature (1)..(633): Bit score of 688.0 for HMM based on sequences of FIGURE 21.
  misc_feature (173)..(304): Pfam Name: POX Pfam Description: Associated with HOX
  misc_feature: Functional Homolog Of SEQ ID NO. 1540
MATYYPSSNNQRDAAPMHYLREPLPTSYSEVPVLPTNMMYMSYPSSSGSYSDTLAGNAQQHNHNCIEIPSVAASDSTQPQHEILSSLSGSHIVEHDFSAWRDGKNEMLVMNSLGGPASLLHTGQHLQAQGLSLSLGTQIPSGIQIPSIQYRNPNQGFTSFLSGGRNGSSRDEQTIPHSKYLKAAQQLLDEVVNVRKALKQPDSEKNQNIHELWKGSKEADVEPVSNSSSELSPAERQDLQNKLTKLLAMLDEVDRRYKQYYHQMQIVVSSFDVIAGSGAAKPYTALALQTISRHFRCLRDAITGQIRATRRSLGEQDTSGNGKGVGISRLRYVDQQLRQQRALQQLGMMQQHAWRPQRGLPESSVSILRAWLFEHFLHPYPKDSDKIMLARQTGLTRSQVSNWFINARVRLWKPMVEEMYKEEIGDADMDSNSSSENAPKATKSDIRASEERGDDFQPSTTSTVTERCSTGRFLDSKSSNAPDVEMGGPTAGASFRNGERGETQTEYGIVKLSGDQRPSVEECSSLFPDGIVQSDGGSDRFMAAAAAAYHMSELGRFGSGTGVSLTLGLQHCEGGSLPISNGGHHSFVGMRGADMYNPAASSVGTDTADFDCMDPGNRQHRFSSSHLLHDFVA

SEQ ID NO: 2271 - protein, 728 aa, Vitis vinifera
  misc_feature: Public GI ID no. 157343410
  misc_feature (1)..(728): Bit score of 1201.8 for HMM based on sequences of FIGURE 21.
  misc_feature (215)..(353): Pfam Name: POX Pfam Description: Associated with HOX
  misc_feature (425)..(460): Pfam Name: Homeobox Pfam Description: Homeobox domain
  misc_feature: Functional Homolog Of SEQ ID NO. 1540
MATYFHGSSEIQADGLQTLYLMNPNYIGYSDTQQPSAANMLFLNATPNSLNPTNLPNMSLQNQHFVGIPLPNMGSANSDDQNRSSLHAQPEMSSLQGIVPRFHYNLWGSTDQNPTGNQPQIPTAVAAASSGGAADVTSQLGLRRQVVSPTQQGLSLSLSPHQPTYRSVPGEHDIQVQQQPPVQAISPTSGDDMRVSGGSSSTASAVSNGISGMQSVLLGSKYLKAAQQLLDEVANVGKGIKTDSGEETKEREKVNTISVAASTGEALSGGESSAKRGAELSTAQRQELQMKKAKLVNMLDEVEQRYRQYHQQMQIVVSSFEQAAGQGSAKSYTALALQTISKQFRCLKDAISAQIKATSSSLGEEDCSGGKVEGSRLRFVDHQLRQQRALQQLGMIQHNAWRPQRGLPERAVSVLRAWLFEHFLHPYPKDSDKHMLAKQTGLTRSQVSNWFINARVRLWKPMVEEMYLEEIKDQEHNGSQDNASKSEANKELGSKSTAAQESGATRVDQTNDFQSKQEKSTTQNASPAELSNSTMSTSPMGGSLQVQAGFNLIGSSEIEGMVQRSPKKPRSYDIQSSPSSILSMDMEMKPGGTSREISMKFGSERQAKDGYPLITGAINNGGGFGAYSPIGDIGRFNPEQLAPRFHGNSVSLTLGLPHCENLSLSGSQQSYLSNPNVQLGRRLEMGNGEPDYCGINAAQPSHSNAAYDSINIQNRKRFAAQLLPDFVA

SEQ ID NO: 2272 - protein, 696 aa, Vitis vinifera
  misc_feature: Public GI ID no. 157356227
  misc_feature (1)..(696): Bit score of 1303.5 for HMM based on sequences of FIGURE 21.
  misc_feature (187)..(319): Pfam Name: POX Pfam Description: Associated with HOX
  misc_feature (391)..(426): Pfam Name: Homeobox Pfam Description: Homeobox domain
  misc_feature: Functional Homolog Of SEQ ID NO. 1540
MATYFHGNSEIQADGLQTLILMNPAYVGYSDAPPPPPLHPNFVFLNSAAASLAPSNLSHAPPPQTQQFVSIPLSATAPSASSDPSPPSVHAHHEIPGLPGFIQRPHYNLWSSIDTTAAARDTPRSQQGLSLSLSSQQPPAYGSYGNEREVPPQHATAISPVSDDMRISGASSSSASGISNGVSGMHGVILSSKYLKAAQQLLDEVVNVGNGIKTETPSKKSSSEATKTLGEGLIGGETSTKRSADLSTAERQEIQMKKAKLLNMLDEVEQRYRQYHHQMQIVISSFEQAAGIGSAKTYTALALQTISKQFRCLKDAISGQIRAANKSLGEEDGTGGKIEGSRLKFVDHQLRQQRALQQLGMIQQNVWRPQRGLPERSVSVLRAWLFEHFLHPYPKDSDKHMLAKQTGLTRSQVSNWFINARVRLWKPMVEEMYMEEVKDHEENGSGEKTSKSEDNNLEDSALKSSGQQEKSPGSENQARSFKSKPDNPTNKSAPPVISMATAATSPIGGGNARNQPRFTLMGPSEMEGMAQGSPKKPRSTDVLHSPSSVPSMDMDVKPGEANHHHISMKFSNERQGRDGYPLMAGPTNFIGGFESYSLGEIGRFDAEQFTPRFSGNGVSLTLGLPHCENLSLSGTHQTFLPNQNIQLGRRVDMGEPNEYGTINTTTPHSTAAYENINMQNGKRFAAQLLPDCGLIS

SEQ ID NO: 2273 - protein, 641 aa, Bryophyllum daigremontianum x Bryophyllum delagoense
  misc_feature: Public GI ID no. 184216043
  misc_feature (1)..(641): Bit score of 879.9 for HMM based on sequences of FIGURE 21.
  misc_feature (151)..(295): Pfam Name: POX Pfam Description: Associated with HOX
  misc_feature (344)..(402): Pfam Name: Homeobox Pfam Description: Homeobox domain
  misc_feature: Functional Homolog Of SEQ ID NO. 1540
MAAYFDGGNSQIQAADGLQTLIFMNPSYVNNHHHQNPNNFVFANPSMSPATDQSQQLVGVPLQQTQHPEPISALHGLVPRPHYNLWTPIVRDNPRPQKGLSLSLSNSQQQVGFAGTPPSAISPSSGSKDDGIGTPSPASVISNGPASGLRSVLLCSKYLKATQQLLEEVVNVGSAMDSAKKKDTATGSSSKAANEASSPEAAAAAAVAVGDGENGGKKAAELSTAERHEIQMKKGKLVCMLDGVELRYRQYQQQMQIVIASFEQAAGQGSARTYTALALRTISRQFRCLKDAIVVQMRAMSKSLGEEEDMGIKEGVSRLKFVDHHLRQQRALQQLGMIQHNAWRPQRGLPERSVLVLRAWLFEHFLHPYPKDSDKQMLAKQAGLTRSQVSNWFINARVRLWKPMVEEMYNEEVKEQDNHESTDKTGISGNNNAKAYASKVPTHDNISFKNVSPEDTGATAAAKSDSVSPGRLRNQNTGFSLVGSSELEGISEMSPKRQRTNHLMINPTDSFQSNMEMKSIHASNEHVLMQFGIERQTRDDYSLMAAGPFGSCPLEEINQFDSSHQYQPRFSGKGGVSLTLGLTDTLFPNQNMRRMDTGEASEFGTINNNPNPARTTSTAYESINIQNPKRFPVQLLPDFVA

SEQ ID NO: 2274 - protein, 645 aa, Solanum etuberosum
  misc_feature: Public GI ID no. 187940724
  misc_feature (1)..(645): Bit score of 573.0 for HMM based on sequences of FIGURE 21.
  misc_feature (199)..(342): Pfam Name: POX Pfam Description: Associated with HOX
  misc_feature (416)..(451): Pfam Name: Homeobox Pfam Description: Homeobox domain
  misc_feature: Functional Homolog Of SEQ ID NO. 1540
MATYFPSPSNQRDADQTFQYFRQSLPESYSEASNAPENMMVFMNYSSSGAYSDMLTGTSQQQHSCIDIPSIGITSSNTSQQEILSNFGGSRMGIQDFSSWRDSRNEMLADNVFQVAQNVQGQGLSLSLGSNIPSGIGISHVQSQNPNQGGGFNMSFGDGDNSQPKEQRNADYLPPDYPGRNLDAMKGYNSPYGTSSIARTIPSSKYLKAAQYLLDEVVSVRKAIKEQNSKKELTKDSRESDVDSKNISSDTPANGGSNPHESKNNQSELSATEKQEVQNKLTKLLSMLDEIDRRYRQYYHQMQIVVSSFDVVAGDGAAKPYTALALQTISRHFRCLRDAICDQIRASRRSLGEQDASENSKAIGISRLRFVDQHIRQQRALQQLGMMQQQAWRPQRGLPESSVSVLRAWLFEHFLHPYPKDSDKIMLARQTGLTRSQVSNWFINARVRLWKPMVEEMYKEEAGDVKIDSNSSSEFAPRLATKDSKVEERGELHQNAASEFEQYNSGQILESKSNHEADVEMEGASNAEAQSQSGMENQTDEPLPGMDNCTLFQDAFVQSNDRFSEFGTFGSGNVLPNGVSLTLGLQQGEGSNLPMSIETHVSYVPLRADDMYSTASTTMVPETAEFNCLDSGNRQQPFWLLPSAT

SEQ ID NO: 2275 - protein, 698 aa, Solanum brevidens
  misc_feature: Public GI ID no. 187940726
  misc_feature (1)..(698): Bit score of 1354.4 for HMM based on sequences of FIGURE 21.
  misc_feature (210)..(354): Pfam Name: POX Pfam Description: Associated with HOX
  misc_feature (426)..(461): Pfam Name: Homeobox Pfam Description: Homeobox domain
  misc_feature: Functional Homolog Of SEQ ID NO. 1540
MYYQGTSDNNIQADHQRHHNHGNSNNNIQTLYLMNPNSYMQGYTTTDTQQHQNQNQHQQQLLFLNSSPAGSNALGHANIPHAPLQQQHFVGVPLPAVSLHDQINHHGLLQRMWNNQDQSQQVIVPSSTVVSATSCGGTTTDLASQLAFQRPIVVSPTPQHRQQQQQQGGLSLSLSPQQQQQISFNNNISSSSPRTNNVTIRGTLDGSSSNMVLGSKYLKAAQELLDEVVNIVGKSIKGDDQKKENSMNKESMPLASDVNTNSSGGGGESSSRQKNEVAVELTTAQRQELQMKKAKLLAMLEEVEQRYRQYHHQMQIIVSSFEQVAGIGSAKSYAQLALHAISKQFRCLKDAIAEQVKATSKSLGEEEGLGGKIEGSRLKFVDNHLRQQRALQQLGMMQPNAWRPQRGLPERAVSVLRAWLFEHFLHPYPKDSDKIMLAKQTGLTRSQVSNWFINARVRLWKPMVEEMYLEEVKNQEQNSTTSGDNKNKETNISAPNEEKQPIITSSLLQDGTTTTQAEISTSTISTSPTAGASLHHAHNFSFLGSFNMKNTTTTNTVDHIENNAKKPRNDMQKFSPSSILSLVDMEAKARESSNKGFTNPLMAAYAMGDFGRFDPHDQQMTANFHGNNGVSLTLGLPPSENLAMPVNQQNYLSNELGSRPEMGSHYNRMGYENIEFQSGNKRFPTQLLPDFVTGNLGT

SEQ ID NO: 2276 - protein, 645 aa, Solanum brevidens
  misc_feature: Public GI ID no. 187940732
  misc_feature (1)..(645): Bit score of 574.5 for HMM based on sequences of FIGURE 21.
  misc_feature (199)..(342): Pfam Name: POX Pfam Description: Associated with HOX
  misc_feature (416)..(451): Pfam Name: Homeobox Pfam Description: Homeobox domain
  misc_feature: Functional Homolog Of SEQ ID NO. 1540
MATYFPSPSNQRDADQTFQYFRQSLPESYSEASNAPENMMVFMNYSSSGAYSDMLTGTSQQQHSCIDIPSIGTTSSNTSQQEILSNFGGSRMGIQDFSSCRDSRNEMLADNVFQVAQNVQGQGLSLSLGSNIPSGIGISHVQSQNPNQGGGFNMSFGDGDNSQPKEQRNADYLPPDYPGRNLDAMKGYNSPYGTSSIARTIPSSKYLKAAQYLLDEVVSVRKAIKEQNSKKELTKDSRESDVDSKNISSDTPANGGSNPHESKNNQSELSATEKQEVQNKLTKLLSMLDEIDRRYRQYYHQMQIVVSSFDVVAGDGAAKPYTALALQTISRHFRCLRDAICDQIRASRRSLGEQDASENSKAIGISRLRFVDQHIRQQRALQQLGMMQQQAWRPQRGLPESSVSVLRAWLFEHFLHPYPKDSDKIMLARQTGLTRSQVSNWFINARVRLWKPMVEEMYKEEAGDVKIDSNSSSEVAPRLATKDSKVEERGELHQNAASEFEQYNSGQILESKSNHEADVEMEGASNAETQSQSGMENQTDEPLPGMDNCTLFQDAFVQSNDRFSEFGTFGSGNVLPNGVSLTLGLQQGEGSNLPMSIETHVSYVPLRADDMYSTASTTMVPETAEFNCLDSGNRQQPFWLLPSAT

SEQ ID NO: 2277 - protein, 698 aa, Solanum etuberosum
  misc_feature: Public GI ID no. 187940734
  misc_feature (1)..(698): Bit score of 1354.1 for HMM based on sequences of FIGURE 21.
  misc_feature (210)..(354): Pfam Name: POX Pfam Description: Associated with HOX
  misc_feature (426)..(461): Pfam Name: Homeobox Pfam Description: Homeobox domain
  misc_feature: Functional Homolog Of SEQ ID NO. 1540
MYYQGTSDNNIQADHQQHHNHGNSNNNIQTLYLMNPNSYMQGYTTTDTQQHQNQNQHQQQLLFLNSSPAGSNALGHANIPHAPLQQQHFVGVPLPAVSLHDQINHHGLLQRMWNNQDQSQQVIVPSSTVVSATSCGGTTTDLASQLAFQRPIVVSPTPQHRQQQQQQGGLSLSLSPQQQQQISFNNNISSSSPRTNNVTIRGTLDGSSSNMVLGSKYLKAAQELLDEVVNIVGKSIKGDDQKKENSMNKESMPLASDVNTNSSGGGGESSSRQKNEVAVELTTAQRQELQMKKAKLLAMLEEVEQRYRQYHHQMQIIVSSFEQVAGIGSAKSYTQLALHAISKQFRCLKDAIAEQVKATSKSLGEEEGLGGKIEGSRLKFVDNHLRQQRALQQLGMMQPNAWRPQRGLPERAVSVLRAWLFEHFLHPYPKDSDKIMLAKQTGLTRSQVSNWFINARVRLWKPMVEEMYLEEVKNQEQNSTTSGDNKNKETNISAPNEEKQPIITSSLLQDGTTTTQAEISTSTISTSPTAGASLHHAHNFSFLGSFNMENTTTTNTVDHIENNAKKPRNDMQKFSPSSILSLVDMEAKARESSNKGFTNPLMAAYAMGDFGRFDPHDQQMTANFHVNNGVSLTLGLPPSENLAMPVNQQNYLSNELGSRPEMGSHYNRMGYENIEFQSGNKRFPTRLLPDFVTGNLGT

SEQ ID NO: 2278 - protein, 668 aa, Zea mays
  misc_feature: Public GI ID no. 194690778
  misc_feature (1)..(668): Bit score of 1051.9 for HMM based on sequences of FIGURE 21.
  misc_feature (198)..(336): Pfam Name: POX Pfam Description: Associated with HOX
  misc_feature (409)..(444): Pfam Name: Homeobox Pfam Description: Homeobox domain
  misc_feature: Functional Homolog Of SEQ ID NO. 1540
MATYYSSQGSEREPSQNMYSRDPGNGTASYPPLPSALGNLLYLNSPASGGPYTDFGGVQQDCIEMPEPGHPSVMSHDSSAREIEPDMLGQQRRSFGLARGMKDEVLMRMMDGSGSHSSAADAIHDDAPNGIQLDFGVLGSHGPPAQGGQGSLSLSLNTHIMAPALPYWPVVKADMLSPHSYDHGCGGGSGGLGSEPSRAIRNSRYLKAAQELLDEVVNVWNSIKQKAQKEQVEAGKTEGKENEGGGPKSEGPQESGANAAPELSTAEKQELQNKMAKLMAMLDEVDRKYKHYYHQMQSVVSSFDMVAGAGAAKPYTAVALQTISRHFRCLKDAINDQISVIRKKLGEEESSSGREGRLTRLRYIDQQLRQQRAFQQYGMIPQNAWRPQRGLPENSVTILRAWLFEHFLHPYPKDSEKLMLARQTGLTRSQISNWFINARVRLWKPMIEDMYKEETGDIEQDSNSSSDNAPAGSKAKTASSRDKEDHLARSCCTPRAVCESSSQLSEPPGGASMRAMSVAAAAAGAPMGLFQNEPGHDHDHDDSFMSLMLKEQRPNDGGGGLLLHHSAVAQHQDENARFMAYHLAELGRYGNGNVSLTLGLQRSSSSLSVPHAQQSFPGVGIGVGDDDIYNATAAPLGVSVASPDYESMSQMDQRQRFEQSPLLHDFVA

SEQ ID NO: 2279 - DNA, 960 bp, Solanum lycopersicum
  misc_feature: Ceres Annot ID no. 8456660
  misc_feature: Encodes the peptide sequence at SEQ ID NO. 2280
atgtcgcaaagaacagcgccggcgccgtttctgttgaagacgtatcagttggtggatgatgcgaccactgacgatgtcatatcttggaatgaaatcggcacaacctttgtggtgtggaaaactgctgaatttgcaaaggatttgcttcccaaatacttcaagcacaataatttctccagcttcgttcgacagcttaacacctatggttttcgaaagattgtgcctgacaaatgggaattcgccaatgagaatttcaaaagaggacagaaagagctcctcacagctatacgccgtcggaagaccgtgacatcaatcccagctggtggaaagtctgtggcagccgggacttcagcatctccggacaattctggggatgacataggttcaagttctacctcgtccccagactccaagaacccgggatctgtggacactccgggaaagttgtcccagttcacggacttgtcggatgagaatgagaagctaaagaaagacaaccagatgctgagctcagagctggtgcaggcgaagaaacaatgcaatgagttggttgctttcttgagccagtacgtgaaggttgcacccgatatgatcaaccgtatcatgagccaaggaaccccatcggggtccagccttgaagagttggtcaaggaggttggtggtgttaaagatttagaagaacagggtagttataatgacaacgatgataaagaagacgatgacgaaaagggtgatactctgaaactatttggtgtgttgctgaaagaaaagaagaagaaaaggggcccggatgataatattgagacttgtggtggacgtggtaaaatgatgaaaactgtggactataatggtccttggatgaaaatgtcttcgacggccggagaaagcagcaaggttgatttcataatcgatagtaatatgctcaactgttattgtggtctcatgtaccactcatactaa

SEQ ID NO: 2280 - protein, 319 aa, Solanum lycopersicum
  misc_feature: Ceres Annot ID no. 8456660
  misc_feature (1)..(319): Bit score of 561.9 for HMM based on sequences of FIGURE 19.
  misc_feature (7)..(204): Pfam Name: HSF_DNA-bind Pfam Description: HSF-type DNA-binding
  misc_feature: Functional Homolog Of SEQ ID NO. 1587
MSQRTAPAPFLLKTYQLVDDATTDDVISWNEIGTTFVVWKTAEFAKDLLPKYFKHNNFSSFVRQLNTYGFRKIVPDKWEFANENFKRGQKELLTAIRRRKTVTSIPAGGKSVAAGTSASPDNSGDDIGSSSTSSPDSKNPGSVDTPGKLSQFTDLSDENEKLKKDNQMLSSELVQAKKQCNELVAFLSQYVKVAPDMINRIMSQGTPSGSSLEELVKEVGGVKDLEEQGSYNDNDDKEDDDEKGDTLKLFGVLLKEKKKKRGPDDNIETCGGRGKMMKTVDYNGPWMKMSSTAGESSKVDFIIDSNMLNCYCGLMYHSY

SEQ ID NO: 2281 - DNA, 1071 bp, Solanum lycopersicum
  misc_feature: Ceres Annot ID no. 8457717
  misc_feature: Encodes the peptide sequence at SEQ ID NO. 2282
atggaagaggagaaaactatgttgattgatgtgaatgagaaagagatgaatgttaatggtggagtagtagtagaggtgaaagaagaaccagttatatttattaatgatgaagatgacattattggggattcagtaccaaagcctttggatgggttgcgtgatgtaggtccacctccgtttttgaagaagacgtttgaaatggtggatgatccaaataccgactctataatctcatggagtaacagtcaaaacagctttgttgtttgggatcctcacaaattttcaattcatcttctacctaaacattttaagcacaacaacttctctagctttatccgccagctcaatacctatcgtttcaggaaaattgattcagatagatgggaatttgcaaatgagggttttcagaaagggaaaaagcatttgctgataaatatcaagagaagaaagcagtatcctcaactaggaggaggaggtggtggaggagcaaaatcttgggtaggaggttgttgcaaggatggaactgaagcagcagagatagaaaagctgaaaaaggatcacaacactttgaagatggaaattctgaagcttaaacagcaacaagagagcactgataactatttagctactatgaaggagaggttacagaatagtgagattaaacaaaagtatatggtgatcttcctggcgaaaacgttccacaaccctatgtttgttcaacatctgattgaaaaggtgaaacaggggaagacaacaacggttgagaatgggaccaagaagagaaggttgtgtagtgatgaaaatcaagaggagtacacaacaattaagtcggagatacaaacactcttctcttgtgatgaatcgtcgaatagtccagttgaggaacaaaaaggcaagggaaataacagcagcccggagatggtatctgagaactatatattgtgggagaagttgatggaggatgacatgatttgtgagaatggagcagaaacagataagtatcaaagtgagattgttcttgaactagaggatttgatctcgaacccatccgagtgcaagtgtatgccttaa

SEQ ID NO: 2282 - protein, 356 aa, Solanum lycopersicum
  misc_feature: Ceres Annot ID no. 8457717
  misc_feature (1)..(356): Bit score of 138.6 for HMM based on sequences of FIGURE 19.
  misc_feature (58)..(229): Pfam Name: HSF_DNA-bind Pfam Description: HSF-type DNA-binding
  misc_feature: Functional Homolog Of SEQ ID NO. 1587
MEEEKTMLIDVNEKEMNVNGGVVVEVKEEPVIFINDEDDIIGDSVPKPLDGLRDVGPPPFLKKTFEMVDDPNTDSIISWSNSQNSFVVWDPHKFSIHLLPKHFKHNNFSSFIRQLNTYRFRKIDSDRWEFANEGFQKGKKHLLINIKRRKQYPQLGGGGGGGAKSWVGGCCKDGTEAAEIEKLKKDHNTLKMEILKLKQQQESTDNYLATMKERLQNSEIKQKYMVIFLAKTFHNPMFVQHLIEKVKQGKTTTVENGTKKRRLCSDENQEEYTTIKSEIQTLFSCDESSNSPVEEQKGKGNNSSPEMVSENYILWEKLMEDDMICENGAETDKYQSEIVLELEDLISNPSECKCMP

SEQ ID NO: 2283 - DNA, 1167 bp, Solanum lycopersicum
  misc_feature: Ceres Annot ID no. 8458120
  misc_feature: Encodes the peptide sequence at SEQ ID NO. 2284
atggataactgtaatggaggatcaagttcttcttctccggcgccttttttgttgaaaacttatgaactggttgatgattcgtatactaatccagttgtttcatggagccataacggacgtagcttcgttgtttggaatccacctgaattcgctagagatttgcttccgaaatactttaagcataacaatttctcaagttttatcagacaacttaatacttatgggtttagaaaggttgatcctgaacaatgggagtttgcgaacgaggattttttaagaggacgtagacatttgttgaagaatatttatagacgaaagccgatccatagccactctgctgcagcaggaacagggcaatctgtagctccattgacggattctgagagacaggagtatgaagatgaaatcgagaggttgaagagagaaaacagtcttcttcagtcgtctgcggagaatcaattgaaattcaatggggagtacgaaagtggaattaagtctatggagcaacgtttacagaacgttgctcatagacaggggaaattgatttctcttttagctcaattactacaaacacctggattttcatctgatttcactcaaagcgcgagcaggaagagacgattgttgatatcaaattacttgattgacgaggaaaactcaccaaaattcgacttggaaatggttaaaaagttggattcatcaatcaatttttgggagcggtttctgtatggtgttcaaacacaagatttcgagcatacacattccccaattgttacacatacatcatctaatgattctgccaaacgaaactctcccatcgatcattcaccatcctcctccgagttagggccattgaatcctgtcatgtcatcaacttatgaaaatttagaacgtcaacttaagccatctgataatcagattgagtgtaagaccagtaaaacatctgaattagtatcaaactcgggtaatgatgtattttggcaacagttcttaacagagacgcctggttgcactgagccacaacaagttgagaacaaagggataaacgaatcaacgcgtgatattagattaggggatagccatagatattggtggaatcgcggagttaatttagaaaatcttgctgaaagaatgggacatcttagtagtccagcaacaggaagctga

SEQ ID NO: 2284 - protein, 388 aa, Solanum lycopersicum
  misc_feature: Ceres Annot ID no. 8458120
  misc_feature (1)..(388): Bit score of 277.1 for HMM based on sequences of FIGURE 19.
  misc_feature (13)..(185): Pfam Name: HSF_DNA-bind Pfam Description: HSF-type DNA-binding
  misc_feature: Functional Homolog Of SEQ ID NO. 1587
MDNCNGGSSSSSPAPFLLKTYELVDDSYTNPVVSWSHNGRSFVVWNPPEFARDLLPKYFKHNNFSSFIRQLNTYGFRKVDPEQWEFANEDFLRGRRHLLKNIYRRKPIHSHSAAAGTGQSVAPLTDSERQEYEDEIERLKRENSLLQSSAENQLKFNGEYESGIKSMEQRLQNVAHRQGKLISLLAQLLQTPGFSSDFTQSASRKRRLLISNYLIDEENSPKFDLEMVKKLDSSINFWERFLYGVQTQDFEHTHSPIVTHTSSNDSAKRNSPIDHSPSSSELGPLNPVMSSTYENLERQLKPSDNQIECKTSKTSELVSNSGNDVFWQQFLTETPGCTEPQQVENKGINESTRDIRLGDSHRYWWNRGVNLENLAERMGHLSSPATGS

SEQ ID NO: 2285 - DNA, 978 bp, Solanum lycopersicum
  misc_feature: Ceres Annot ID no. 8463888
  misc_feature: Encodes the peptide sequence at SEQ ID NO. 2286
atggtgccatcgtcggttgattgtaccggcgaatctgccaccggggagaatcagagatctcttccgacgccatttttgacgaaaacttatcagcttgtcgatgatcctgctatggatgagttgatctcgtggaatgaagatggaacgacatttattgtttggaaacctgcggagtttgctagggatttgcttcccaaatgttttaagcataataatttttccagttttgttcggcagcttaatacttacggatttagaaaagttgtacctgatcgatgggaattcgcaaatgactgtttccgtagaggtgagaaaggactacttcgtgacattcaacgccggaaaatttcaccggcaggtgctgcggttgttgcaccagcagtagtaacggtgaatgctgcacaagcggtgacggtagcggtagcaccagcggtcagggtggtttcttcatcgaattccggtgatgagcaggcgttctcatcgaactcatctggtgccgcagctggagcggcgatgttaaggaccactacgtgtacgacgacgccggagcttatagaggagaacgaacggttgagaaaggagaacgcacaactaaatcaggaattgaatcggttgagaagtttatgcagtaacgtatacaatctgatgtccaattacacggcgaatccggcggatataccggcaggtatactaggaggacgagctttggaattgcttcgtacggggcaagttgacggcggcggtgcggccatcacagcggcggagagcagcggcttcaaggcggatgaagatatgagcccacggttgtttggtgtatcaattggggtaaagcgcgtgaggagaagcagcgaagaagaatctgaggatcaggatcaagtacaaccgcatggatcagacatgaaatcagagccgttagattcaggaagtgctcaacatgatgatcagccatggattgatcgattagatttagggtgttga

SEQ ID NO: 2286 - protein, 325 aa, Solanum lycopersicum
  misc_feature: Ceres Annot ID no. 8463888
  misc_feature (1)..(325): Bit score of 502.1 for HMM based on sequences of FIGURE 19.
  misc_feature (23)..(236): Pfam Name: HSF_DNA-bind Pfam Description: HSF-type DNA-binding
  misc_feature: Functional Homolog Of SEQ ID NO. 1587
MVPSSVDCTGESATGENQRSLPTPFLTKTYQLVDDPAMDELISWNEDGTTFIVWKPAEFARDLLPKCFKHNNFSSFVRQLNTYGFRKVVPDRWEFANDCFRRGEKGLLRDIQRRKISPAGAAVVAPAVVTVNAAQAVTVAVAPAVRVVSSSNSGDEQAFSSNSSGAAAGAAMLRTTTCTTTPELIEENERLRKENAQLNQELNRLRSLCSNVYNLMSNYTANPADIPAGILGGRALELLRTGQVDGGGAAITAAESSGFKADEDMSPRLFGVSIGVKRVRRSSEEESEDQDQVQPHGSDMKSEPLDSGSAQHDDQPWIDRLDLGC

SEQ ID NO: 2287 - DNA, 1431 bp, Sorghum bicolor
  misc_feature: Ceres Annot ID no. 8733731
  misc_feature: Encodes the peptide sequence at SEQ ID NO. 2288
atggagggttgcaactcgcacggcggtggcggcggcggaggaggaggaggaggaggaggagggtcgagctcgccgccgccgttcctcatcaagacctacgagatggtggaggacccggcgacgaaccacgtggtgtcgtggggacccggcggcgccagcttcgtggtgtggaacccgccggacttctcgcgggacctgctgcccaagtacttcaagcacaacaacttctccagcttcatcaggcagctcaacacatacggtttccgaaagatcgatccagagagatgggagtttgccaacgacgacttcatacggggacacacgcaccttctgaagaacatccaccggcgcaaaccggtgcacagccactcgctgcagacgcaggtgaacgggccattagcggagtccgagaggcgcgagcttgaggacgagatcaacaggctcaagtacgagaagagcctgctgctggcagatctccagaggcagaaccagcagcggtgcgggatcagctggcagatgcagtcgctggagagcaggctggtggcgatggaggagcgccagaggcacatcgtggcgtccctgtgtgacatcctgcagagacacggggttgttccgggctcgacgacgacgacgctggagatggagacgccggcggaccacttcagcaagaagaggagggtgccgaagttcggtttcttcgtcgacgccgacgaacccaaggtggaagaacagcaggtgccgtcgttcctgcagacggtgggaggagtagtagcagagacaccaggcatgtctccgatccgccttttgaatgatgagccgtttgagaagatggagctggccttggtgtcgctggagaatttcttccagagggcaacccattcgcctgctgccaatgacattgacatgtacgctggtggtgctgctgaaccacccagccctgctctgagtctcggggagatgttctcagtctcagcaccaatggataccagtatcaatctgcagtcatcagctcgccactgccagaatccctttgcttccacctcagggcaagaccagtcgtcatctccattggcacaagcagaacctccgagctacgacgcccggagcccgatcctgccattggcacagctccatgaatatgcccctagggcagctgaagtcgatatgaactctgacaccacaactggcgacacttcacaagatgagaccaccagtgaaactgaaggttcccatttgccggccaaggcgaacgatatattctgggagcagtttctcaaagacgaagagggtaaaatagaagcaaaggaagatgtgaagactgccgtagaccgcagctgtcgtcgtctacaggacaatgttgatcagatcactgagcagatggggcagctcgattcagctgagaacggctcttatgcaccccagacttactga

SEQ ID NO: 2288 - protein, 476 aa, Sorghum bicolor
  misc_feature: Ceres Annot ID no. 8733731
  misc_feature (1)..(476): Bit score of 229.5 for HMM based on sequences of FIGURE 19.
  misc_feature (26)..(194): Pfam Name: HSF_DNA-bind Pfam Description: HSF-type DNA-binding
  misc_feature: Functional Homolog Of SEQ ID NO. 1587
MEGCNSHGGGGGGGGGGGGGGSSSPPPFLIKTYEMVEDPATNHVVSWGPGGASFVVWNPPDFSRDLLPKYFKHNNFSSFIRQLNTYGFRKIDPERWEFANDDFIRGHTHLLKNIHRRKPVHSHSLQTQVNGPLAESERRELEDEINRLKYEKSLLLADLQRQNQQRCGISWQMQSLESRLVAMEERQRHIVASLCDILQRHGVVPGSTTTTLEMETPADHFSKKRRVPKFGFFVDADEPKVEEQQVPSFLQTVGGVVAETPGMSPIRLLNDEPFEKMELALVSLENFFQRATHSPAANDIDMYAGGAAEPPSPALSLGEMFSVSAPMDTSINLQSSARHCQNPFASTSGQDQSSSPLAQAEPPSYDARSPILPLAQLHEYAPRAAEVDMNSDTTTGDTSQDETTSETEGSHLPAKANDIFWEQFLKDEEGKIEAKEDVKTAVDRSCRRLQDNVDQITEQMGQLDSAENGSYAPQTY

SEQ ID NO: 2289 - DNA, 691 bp, Gossypium hirsutum
  misc_feature: Ceres Clone ID no. 100056410
  misc_feature: Encodes the peptide sequence at SEQ ID NO. 2290
aaacaactcggaaaatggacccaactgcaccctccgcgtcggtcgtcggcggcggctgtggtggtggcggaggagggccggcacctttccttataaaaacatacgacatggtagacgactcatcgaccgacgacatcgtttcatggagttctaacaaaaagagctttgtggtttggaaccctcctgattttgctcgccttttgcttcccacttatttcaagcacaataatttctccagctttatcaggcagcttaatacctatgggttccggaaaattgatcccgaacgatgggaatttgccaatgaagattttgtgaaagatcaaaggcatcttcttaagaatattcatcgaagaaaacctattcacagccatagtaatccacagggttctttgatagatcatgaaagagctggatacgaagaagaaattgaaaagctttcacgtgagaaagctgcacttgaggctgatgttttgaggtctgaacaagagcggtcatctttgaagcatcaggtggaagagctgacacaacaagctgatcaaatggagcgtaggcaagagactttgtttaacttcttagaaaaggctttacaagaccctgctttcgccgaacatctttttcgtagaattgaatctatggatgatgttgctgcatataataagaaaaggagactgcctcaaattgatcaaac

SEQ ID NO: 2290 - protein, 225 aa, Gossypium hirsutum
  misc_feature: Ceres Clone ID no. 100056410
  misc_feature (1)..(225): Bit score of 136.3 for HMM based on sequences of FIGURE 19.
  misc_feature (22)..(188): Pfam Name: HSF_DNA-bind Pfam Description: HSF-type DNA-binding
  misc_feature: Functional Homolog Of SEQ ID NO. 1587
MDPTAPSASVVGGGCGGGGGGPAPFLIKTYDMVDDSSTDDIVSWSSNKKSFVVWNPPDFARLLLPTYFKHNNFSSFIRQLNTYGFRKIDPERWEFANEDFVKDQRHLLKNIHRRKPIHSHSNPQGSLIDHERAGYEEEIEKLSREKAALEADVLRSEQERSSLKHQVEELTQQADQMERRQETLFNFLEKALQDPAFAEHLFRRIESMDDVAAYNKKRRLPQIDQ

SEQ ID NO: 2291 - DNA, 877 bp, Gossypium hirsutum
  misc_feature: Ceres Clone ID no. 100059286
  misc_feature: Encodes the peptide sequence at SEQ ID NO. 2292
tcgaaatgaagtgaagtgaaaacgaagtctcaaatggaaggagttgtagtaaaagaagaggaaactcaaatgacgtttgcaacagctgttgggactactgctgggttgtcttcatcttcatcgtcatcaaatgttactcctcagccgaaggaagggcttaacgaggttggtccgccgccgttcttgactaaaacttttgatatggtggaagacccttcgacggattcggtggtttcatggagtgaagctcgtaatagtttcattgtttgggattctcataaattttcaaccacgttgcttcctaggcacttcaagcacaacaatttctccagtttcattcgtcagctcaatacatatggttttagaaaagttgatccagatcgatgggaatttgccaatgaagggtttttaggagggcaaaagcagctacttaaaacgattaagaggagaaggaacatagtgcaaagctcacagcatcaagctggaggaggaggagcttgtgttgagttaggacaatttggattagatgaagaactggagagattaaagagggatcgaagtgttttactagctgaaatcgtgagattaagacaacaacagcagcattcaagggaccagattgttgcaatggaggataggttacagagcacagagaagaaacagcaacagataatgtcgttccttgctaaggcacttcgaaacccgactttcatacagcaacttgctcagaacagacaggctaaaggcgtcgaaatcggacgaaaacggaggctcacggcgagccccagtgtggagaatttacaacaagcagcagtccctgtggtggttgataatgatcaagttgaggaacaagaaggattggcaactattgagactg

SEQ ID NO: 2292 - protein, 281 aa, Gossypium hirsutum
  misc_feature: Ceres Clone ID no. 100059286
  misc_feature (1)..(281): Bit score of 164.9 for HMM based on sequences of FIGURE 19.
  misc_feature (48)..(217): Pfam Name: HSF_DNA-bind Pfam Description: HSF-type DNA-binding
  misc_feature: Functional Homolog Of SEQ ID NO. 1587
MEGVVVKEEETQMTFATAVGTTAGLSSSSSSSNVTPQPKEGLNEVGPPPFLTKTFDMVEDPSTDSVVSWSEARNSFIVWDSHKFSTTLLPRHFKHNNFSSFIRQLNTYGFRKVDPDRWEFANEGFLGGQKQLLKTIKRRRNIVQSSQHQAGGGGACVELGQFGLDEELERLKRDRSVLLAEIVRLRQQQQHSRDQIVAMEDRLQSTEKKQQQIMSFLAKALRNPTFIQQLAQNRQAKGVEIGRKRRLTASPSVENLQQAAVPVVVDNDQVEEQEGLATIET

SEQ ID NO: 2293 - DNA, 722 bp, Zea mays
  misc_feature: Ceres Clone ID no. 100904240
  misc_feature: Encodes the peptide sequence at SEQ ID NO. 2294
caggcagcaggcggcagcagcagcacgcgctgccgcagcaccagtcatggaggtcgccggcgcccgcgagcccggtagcggaggaggaggaggtggcggcggtggcggaccagccccgttcctgctgaagacgtacgagatggtggacgacccgtcgagcgacgcggtggtgtcatggagcgacgcatccgacgggagcttcgtcgtctggaaccagcccgagttcgccgcgcggatgctgcctacctacttcaagcacaacaacttctccagcttcatccgccagctcaacacatacggtcttcgcaaaatagacccagagcgctgggaatttgctaatgagtactttgtcaagggacagaagcacctgctgaagaatatccacaggaggaaacccatccacagccatagccatcagccaggtgccctgcctgacaatgagcgtgcgttatttgaggatgagattgacaggctttcacgagagaaagctgccctccaggctgacctctggaaattcaatcagcagcagtcaggtgctgtgaaccagttagaagatcttgagcggcgagtgcttgacatggagcagcgacagacgaagatgctcagcttcttgcagcaggctaggaagaatcctcagtttgtcaggaagctcgttaagatggcagaggaatccccaatctttgcggacgcgtttcacaagaagcgaaggctacctgggcttg

SEQ ID NO: 2294 - protein, 225 aa, Zea mays
  misc_feature: Ceres Clone ID no. 100904240
  misc_feature (1)..(225): Bit score of 134.0 for HMM based on sequences of FIGURE 19.
  misc_feature (22)..(189): Pfam Name: HSF_DNA-bind Pfam Description: HSF-type DNA-binding
  misc_feature: Functional Homolog Of SEQ ID NO. 1587
MEVAGAREPGSGGGGGGGGGGPAPFLLKTYEMVDDPSSDAVVSWSDASDGSFVVWNQPEFAARMLPTYFKHNNFSSFIRQLNTYGLRKIDPERWEFANEYFVKGQKHLLKNIHRRKPIHSHSHQPGALPDNERALFEDEIDRLSREKAALQADLWKFNQQQSGAVNQLEDLERRVLDMEQRQTKMLSFLQQARKNPQFVRKLVKMAEESPIFADAFHKKRRLPGL

SEQ ID NO: 2295 - DNA, 1057 bp, Glycine max
  misc_feature: Ceres Clone ID no. 1047133
  misc_feature: Encodes the peptide sequence at SEQ ID NO. 2296
ataatagacttatattccatggctccgccgctcgaacacaacggcgtttccaccagcggtgactctctgagatctattccgacgccgtttctcaccaaaaccttgcaactcgtcgacgatcacaccatcgaccatgtgatttcgtggaacgattctggatcgtccttcatcgtctggaacaccaccgctttcgccaaggatttgcttcctaaatatttcaagcacaacaacttctccagcttcgttcgccaactcaacacttatggattcagaaaagttgtacctgaccgctgggagttctcgaacgagtatttccgaagagacgagaagcggctcctctgcgaaatacagcgacggaagatcctcccggcaacgccgccgacccgagcgactgcgaccgcggcggttctatctccgctgccgctatctacgattccgccggcgaagctgatcgtgtcgccgtcgaactcagcggaggagcaggtgatttcgtctaactcgtcgccggcggagctgttggatgagaacgaccggctgaggaaggagaacattctgttaacgaaggaattggaggagatgagatcgctctgcaacaatatattcaatctcatgtcgaattacgctaacgttcaagcggacggtggttccgcgggggtggcggcscggtgcttcggcgaggatgcggtggaggagatgaatccgaagctgtttggggtggtgattggtacgaagcgagcgagagaagagaatgatacggttttgagtytgcatcagccgttccatgcggacgtgaaatccgaagcgttggatttcgcaagacgtggcgaaaataaaaaaacgccgtggctaaatcaatgtcatagagcaaatcagagagtgtgtaattgacacacgacgttgtaacagcagctaggaacacgttaggttaagctaggggcgtcgcagagaatcagagtcctgagcacggagacgcgcgtggcaaatgtacgtcgttaaccgtttgggacttttttcgtagaagcttytcagaagaaaacgatactttcgcgttcatttc

SEQ ID NO: 2296 - protein, 289 aa, Glycine max
  misc_feature: Ceres Clone ID no. 1047133
  misc_feature (1)..(289): Bit score of 396.9 for HMM based on sequences of FIGURE 19.
  misc_feature (22)..(218): Pfam Name: HSF_DNA-bind Pfam Description: HSF-type DNA-binding
  misc_feature: Functional Homolog Of SEQ ID NO. 1587
  misc_feature (215)..(215): Xaa is any aa, unknown, or other
  misc_feature (250)..(250): Xaa is any aa, unknown, or other
MAPPLEHNGVSTSGDSLRSIPTPFLTKTLQLVDDHTIDHVISWNDSGSSFIVWNTTAFAKDLLPKYFKHNNFSSFVRQLNTYGFRKVVPDRWEFSNEYFRRDEKRLLCEIQRRKILPATPPTRATATAAVLSPLPLSTIPPAKLIVSPSNSAEEQVISSNSSPAELLDENDRLRKENILLTKELEEMRSLCNNIFNLMSNYANVQADGGSAGVAXRCFGEDAVEEMNPKLFGVVIGTKRAREENDTVLSXHQPFHADVKSEALDFARRGENKKTPWLNQCHRANQRVCN

SEQ ID NO: 2297 - DNA, 1110 bp, Brassica napus
  misc_feature: Ceres Clone ID no. 1090276
  misc_feature: Encodes the peptide sequence at SEQ ID NO. 2298
acacattgttttttagtttctttaattatcattgctttcttacaacttctgttttcacaatctctatgtctccgagcgataacagttatactacgatggctaccaatgaatctcagagaactgctccgacgccgtttctcaccaaaacttttaacctcgtcgaagacccttgtaccaacggcgttatatcatggaacgaagatggttcctccttcgtcgtatggaaccaaacagacttcgctaaggacttgcttccgaaacacttcaaacacaacaacttctccagctttgtccgccagctcaacacttacggattcaagaaagttgtaccggaccggtgggagttctctaacgagtttttcaggagaggagagaaacgtctcctccgcgacatccagcgtcggaaactaacccctcaagcagctgtttctccgccgcggtctcaagtagttgtcgcggctcagacggcgaaaatggttgtgtctccgtctagttcaggtgaagaacaggccatgtctccgtcgtcgtcgtcgaccggaaacggtggtttgtctaccgagctgttggaggagaacgagaggcttcggaatgagaacatccagcttagccgtgagcttgcgcagatgaagtctctctacggtaacatctttggactcatgtccaactacgccggagctagtagcagtcacgagatgatggagattgaggaagaagcgagcccgaggctgtttggtgtttcgataggactgaaacggaccagaagcgaaggaggtcatgtgcagacggtttctacggcggcggaggagacgccgtggctgaggcactataatctagccaatcagagagtctgtaattaacggctcagattatgtttgtaagatgtgtacgcgaagtagatgattattacagctttcagacagttagcacgtgtcacatatggtttctagaagtttcatcaatcttgacttcttctcgaactataaatgctccttttctgttttcttctttcaatagatttttctgtactttttctttttgactattttttttcttttctcaaaacaactaaaaattgatgaaatttgaatttggaacaagtatattctccat

SEQ ID NO: 2298 - protein, 263 aa, Brassica napus
  misc_feature: Ceres Clone ID no. 1090276
  misc_feature (1)..(263): Bit score of 333.2 for HMM based on sequences of FIGURE 19.
  misc_feature (22)..(214): Pfam Name: HSF_DNA-bind Pfam Description: HSF-type DNA-binding
  misc_feature: Functional Homolog Of SEQ ID NO. 1587
MSPSDNSYTTMATNESQRTAPTPFLTKTFNLVEDPCTNGVISWNEDGSSFVVWNQTDFAKDLLPKHFKHNNFSSFVRQLNTYGFKKVVPDRWEFSNEFFRRGEKRLLRDIQRRKLTPQAAVSPPRSQVVVAAQTAKMVVSPSSSGEEQAMSPSSSSTGNGGLSTELLEENERLRNENIQLSRELAQMKSLYGNIFGLMSNYAGASSSHEMMEIEEEASPRLFGVSIGLKRTRSEGGHVQTVSTAAEETPWLRHYNLANQRVCN

SEQ ID NO: 2299 - DNA, 2053 bp, Zea mays
  misc_feature: Ceres Clone ID no. 1414288
  misc_feature: Encodes the peptide sequence at SEQ ID NO. 2300
gaacgtgctcttctcgcccgcccggtcttgtctctcctctccagaaccttccaacggcagagtgctcgccgcgtggtctagaaccttccacaagcctcgcgacgtgtctcgacgcgccggtacggcggtgggggtatttaggggtccggccaccggccaccgcccgcccttcccccgatttcaccgaccattttccccattttacagcggcgaatatctctcatctcccccgtcctctttgctgcaacacctcctacccacccgacagaaatatcctaagcgccgacccgaatacccgattcgctcctcgtccggtcgattcctgctcctaatcgctcgaatcgagtccttgccccgtgttccgtgccacaatctgggcgcttggctcccgcgagccggggttcttgggcctgggcggaggccatggacaagccggtggcgccgggcattatcaaggaggagctcctggagcagcagccgccgacgcaggacggtgtgggtggcggcggggatgcgccgcgcccgatggaggggctgcacgaggtgggtcccccgcctttcctcaccaagacgttcgaccttgtggaggacccggccaccgacgccgtcctctcctggagccgcgccggcaacagcttcatcgtctgggacccgcacgtcttcgcctacgggctgctcccgcgcctcttcaagcacagtaacttctccagcttcgtgcgccagctcaacacctatggcttcagaaaggttgatcctgacaggtgggagtttgcaaatgaaggtttcctcagaggtcaaaggcacctgctgaagatgataaagagaaggaagccaccatcagctgtggcaccattgcgacagcaacgtgcccctgcttcttgcctggaggttggtgagtttggatttgaggaggagattgataggctgaagcgtgacaagaacattttaatcacagaagtagtaaaactaaggcaggagcagcaaagtactaaagatcatgtgagagccatggaggaaaggctacgagtggctgaacagaagcaggtacagatgatggggttcttggcaagagcaatgcggaacccagagttcttccagcagttggcccagcagcaagacaagaggaaggagctcgaggataccatctcaaagaaaagaaggcggcccattgacaacacaccattctacagtgatggggaaagcgaacagcttgattcacagttgaaaatgttcgagtcaggtgttctcaatgggctcaatgaacctgagctggagaatttagcagtgaacattcaggagcttgggaagggaagcatagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaacaactggggtatctgagttcttctagcccaaaatagagccagttcctaatggttgcccccacaatcactggtgctttccctaccctactgttgcagaccatcctgatcaaaccgccaggaatgatgatggatctggcagacaagttgactggtggtggagaggtgttcatactgaaggcgtgctgtggagaggtcactgccttgacgttgaaggcttagcgctgtactctgctgtgggagttacgtgtggggtgttggctaaatgtctcttccggcgtcttctggcaaaatgatctcgtggacggtgactggcaaagatgcctaggggccaacgtatacgtacacagctgttatcagatcttgttcaaagtcattgcgcggttttgacggtgctatgtatcgatcagggttctggccttctggggttgggttgtagaattgactggctgatctagtgttctccatgtatgactggtgtaaccttaaaacaccctcagcttgttgttgaactgtgacaagcatctcgtttttttgttgtactccattttcatcatcattgtacatcaaattgctgaattatgaacagatccct

SEQ ID NO: 2300 - protein, 357 aa, Zea mays
  misc_feature: Ceres Clone ID no. 1414288
  misc_feature (1)..(357): Bit score of 198.8 for HMM based on sequences of FIGURE 19.
  misc_feature (44)..(214): Pfam Name: HSF_DNA-bind Pfam Description: HSF-type DNA-binding
  misc_feature: Functional Homolog Of SEQ ID NO. 1587
MDKPVAPGIIKEELLEQQPPTQDGVGGGGDAPRPMEGLHEVGPPPFLTKTFDLVEDPATDAVLSWSRAGNSFIVWDPHVFAYGLLPRLFKHSNFSSFVRQLNTYGFRKVDPDRWEFANEGFLRGQRHLLKMIKRRKPPSAVAPLRQQRAPASCLEVGEFGFEEEIDRLKRDKNILITEVVKLRQEQQSTKDHVRAMEERLRVAEQKQVQMMGFLARAMRNPEFFQQLAQQQDKRKELEDTISKKRRRPIDNTPFYSDGESEQLDSQLKMFESGVLNGLNEPELENLAVNIQELGKGSIDDGNLTQVSDQSELNDDFWAELLVEDFGDKAGQPELEGRTEDVNDLAQQLGYLSSSSPK

SEQ ID NO: 2301 - DNA, 1882 bp, Arabidopsis thaliana
  misc_feature: Ceres Clone ID no. 146737
  misc_feature: Encodes the peptide sequence at SEQ ID NO. 2302
aacacttgagagagtctctgtctctgtaaaagatatttgagcttgagaagaacagaagaaacttccaggatcaatcaatcgatcaactttagtgaactaactcttgatttttcattcgaagttatggaatcggttcccgaatccgtaccatcgccgaactcgaatacaccgtcaataccaccgccggtgaactccgtaccgcctttcttgagtaaaacctacgacatggttgatgatccgttgaccaatgaggtcgtttcgtggagcagcgggaacaacagcttcgtcgtctggagtgtcccggagttctcgaaggtgctcttgcccaagtatttcaagcacaacaacttctccagcttcgtcagacagttaaatacttatggtttcagaaaagttgatcctgaccgatgggaatttgcaaatgaaggatttcttagaggccgaaaacaactactgaagagtattgtcaggagaaaaccttcgcatgtgcagcagaatcagcaacaaactcaagttcagagctcatctcttggtgcttgtgtcgaggtggggaagtttggaatagaagaagaagtggaaagacttaagcgggataagaatgttcttatgcaagaactcgtcaggttaaggcagcaacagcaagctactgaaaaccaactgcagaatgtgggacagaaagttcaggtgatggagcaaaggcaacaacaaatgatgtcgtttttagcaaaggctgttcaaagtccaggtttcttaaaccagttagtacaacagaataataatgatggcaacagacaaattccaggaagcaacaaaaagaggagacttcctgtagatgagcaggagaatcgtggcgacaatgtggctaatggtcttaaccgccagattgttagatatcagccgtcgataaacgaagcagcacaaaatatgcttcgacagttcttaaatactagtacctcacctcggtatgaatcagtttcaaacaatcctgacagtttcctattgggtgatgttcccagttctacctctgtagacaatgggaacccttcaagtagagtttctggagtaacattggccgagttttcacccaacacagttcagtcagcaacgaatcaagtacccgaagcaagtttggctcatcatcctcaagctggtctggttcagccaaatataggtcaaagtccggctcaaggagcagcacctgcagactcttggagccctgaatttgatttagttggatgcgagacagatagtggagagtgttttgatccaataatggctgttttagatgagtcagaaggcgatgcaatttctcctgaaggtgagggaaagatgaatgagttactggagggagtccctaagctgcccggaatccaagatccattctgggaacagttcttttctgttgaactcccagcgattgcagatacagacgagattctatcaggatcagtggagaataatgacttggtaatggaacaagaaccaaacgagtggacccgtaatgaacaacaaatgaagtatcttactgaacaaatgggactgctttcctcagaagcacagaggaaataaaggggaggttgcgaaaggagatatcaaggaaggaggaatatatcagatggtgtgtataccctttacatttttacttaaatgaagaaaaaaaacagagagaagaaacataaaagatttaccaccaagcttgtgaatagttagtagagatcggtttttgtgttgtttatattatacttttgtgtgaaaacgttcatcttgttcaattatcatctcagtagtacggtaatctgttggtcactgaccggttaatgaccaaaaaatcaagattattttcttatgtttatttcttttgatcatgaagatccttatgacg

SEQ ID NO: 2302 - protein, 481 aa, Arabidopsis thaliana
  misc_feature: Ceres Clone ID no. 146737
  misc_feature (1)..(481): Bit score of 341.8 for HMM based on sequences of FIGURE 19.
  misc_feature (26)..(200): Pfam Name: HSF_DNA-bind Pfam Description: HSF-type DNA-binding
  misc_feature: Functional Homolog Of SEQ ID NO. 1587
MESVPESVPSPNSNTPSIPPPVNSVPPFLSKTYDMVDDPLTNEVVSWSSGNNSFVVWSVPEFSKVLLPKYFKHNNFSSFVRQLNTYGFRKVDPDRWEFANEGFLRGRKQLLKSIVRRKPSHVQQNQQQTQVQSSSLGACVEVGKFGIEEEVERLKRDKNVLMQELVRLRQQQQATENQLQNVGQKVQVMEQRQQQMMSFLAKAVQSPGFLNQLVQQNNNDGNRQIPGSNKKRRLPVDEQENRGDNVANGLNRQIVRYQPSINEAAQNMLRQFLNTSTSPRYESVSNNPDSFLLGDVPSSTSVDNGNPSSRVSGVTLAEFSPNTVQSATNQVPEASLAHHPQAGLVQPNIGQSPAQGAAPADSWSPEFDLVGCETDSGECFDPIMAVLDESEGDAISPEGEGKMNELLEGVPKLPGIQDPFWEQFFSVELPAIADTDEILSGSVENNDLVMEQEPNEWTRNEQQMKYLTEQMGLLSSEAQRK

SEQ ID NO: 2303 - DNA, 2323 bp, Zea mays
  misc_feature: Ceres Clone ID no. 1577511
  misc_feature: Encodes the peptide sequence at SEQ ID NO. 2304
gaggaatccattcccaatttgcgttcccactcccaccaccgcttcttcccgtatcccttgtcctccctaatttcctctcacaaaaagcgggtgcggcgtcctgccactcacctcggtctcggggggcgccgtgcggcgggcgcccgtgctgctggtttcgctccaggggagaaggggcagagggagtagagcaggttaggtccgtttgcgttttcttttgcgggtttgtaggtcaaaagctcggcgagcactttccgctccacctcctcacgctcggaatcaaatcgatgccccccctgatttggttcctggtatcggtgcatgagcttgctccaagagatctcccttttggttcggcgtcaggggttctgtgaggtcacgcggcttcttcctcttggcgctcctcacatgtccgggcgcttcgatctctgcccactgcgcgagtgattctgctgctgcagcagctgttaggtgcgcgcggtccgttatggggtgaaccgaagcgttcctcgcagggctgtgggtttattacgccgcctgtttgcttccccgctccatgtccttgtgcccatgcttctttgcttttgtcacgcctgaaccgtgtcttcttgtagtatctgaggcttggcagttggcaagtacaaactagcaacttgcttaggtataaagtataaaccagtgtctggtgcagagcccaaaggggtcacgaatcgttgatgcatagatctgcttctggctgagataaggctctaagttcgctctgttgatggggctaccatgagccacgggaacgggatgttgaattctgtcaaggtggagaggtggccagcagcagtcgctgcaaatggccagcctaggccgatggatgtgctccacgacggcagctcgccgccgttccttaccaagacgtatgacatggttgatgacccaaccacgaacgccgttgtgtcatggagtgccgccaacaatagctttgtagtttgggatcctcatatctttgggacggtgctgctgccaaggtacttcaagcacaacaacttctccagctttgttcggcagctcaatacttatggcttcagaaaggtggatcctgacagatgggaatttgctaatgaggagtttctgagaggtcagaggcacctcctcaaaaacattaggcgtcggaaacctccacactcatctccaaatcaacaatctcttggctcttacctcgaggtaggacactttggatatgaagaagagattgatcagctgaagagggataaacagctcttgatggctgaggtagtgaagctgaggcaggagcaccaaaatactagatcagatctacaggccatggaagagaaattacaagataccgagcagaagcagcagcagatgatggcattcatggcacgcgtcatgcagaaccctgatttcatgcgtcagctgatctcccagcgggagatgaggaaggagctcgaggatgccatctcgaagaagagaaggcgccgcattgaccagggacatgaagctggtagcatgggcactggttctagcctggagcaagggccacagggagtgtttgaaccgcaggagccggtggaatcactcgccaacggtgtgccatctgatctggagagttcgtctgttgaggcgaagggattggaggttcgacagggtgtttcttcaggtggttctgagcatctgaatggcaggccaagcggagagttaaatgatgatttctgggaggaccttctgcacgaggggggacttggtgcagatgcaggcaatgctgttggtcaggatgatatgaacatggacatggacccagatgttagcctgcctcaactgaaacaacatggacccagacattagccgctcttgtgctatcacaatggctgtgactctgtgagtatctttacagttatgctcgttatacccctgtggtgtacctgtttcgatcgtcttcgaccaaatgtcacgtcgactgcagtctccagttgttaatacagtctgttcagcacgctgatttaagtatttgggtcaagatgttcatataatcctgtggtatccagagatattatagtttgttttcgtaactgtttgcgcagagaccatgctatgttgcctgcaggctatcagtgtatttgttctaacagatcgcaacgctggtacaacgcagtgacctgccagactgggccactatgagattgtagggaaagaccagatagcttgtgtatgtaaaagctgatccatagtagcctatcatgtgcaacgctattgccctttgggatttggcatttcactgtatataacatatcatcgccgtattgccgcatcc

SEQ ID NO: 2304 - protein, 359 aa, Zea mays
  misc_feature: Ceres Clone ID no. 1577511
  misc_feature (1)..(359): Bit score of 243.2 for HMM based on sequences of FIGURE 19.
  misc_feature (38)..(205): Pfam Name: HSF_DNA-bind Pfam Description: HSF-type DNA-binding
  misc_feature: Functional Homolog Of SEQ ID NO. 1587
MSHGNGMLNSVKVERWPAAVAANGQPRPMDVLHDGSSPPFLTKTYDMVDDPTTNAVVSWSAANNSFVVWDPHIFGTVLLPRYFKHNNFSSFVRQLNTYGFRKVDPDRWEFANEEFLRGQRHLLKNIRRRKPPHSSPNQQSLGSYLEVGHFGYEEEIDQLKRDKQLLMAEVVKLRQEHQNTRSDLQAMEEKLQDTEQKQQQMMAFMARVMQNPDFMRQLISQREMRKELEDAISKKRRRRIDQGHEAGSMGTGSSLEQGPQGVFEPQEPVESLANGVPSDLESSSVEAKGLEVRQGVSSGGSEHLNGRPSGELNDDFWEDLLHEGGLGADAGNAVGQDDMNMDMDPDVSLPQLKQHGPRH

SEQ ID NO: 2305 - DNA, 712 bp, Glycine max
  misc_feature: Ceres Clone ID no. 1641439
  misc_feature: Encodes the peptide sequence at SEQ ID NO. 2306
  misc_feature (565)..(565): n is a, c, t, g, unknown, or other
accataacatcattctgcccttccctcgcgtttcaacaccgataacccgcaaaaatctccattgatctgcgcctcctgttccatggcaaagctgcctgtggaatacaacggcgactgcgccaccaccgcctcagcatccgcctccgcagccgcggagtctcagagatccattcccacgccgtttctcaccaaaacctttcaactcgtcgacgaccaatccatcgacgatgttatttcctggaacgacgacggatcaacgtttatcgtctggaaccctaccgtcttcgccagagacttgcttcctaaatatttcaaacacaacaatttctctagcttcgttcgccagctcaacacttacggattcagaaaagttgtacctgatcggtgggagttctcgaacgagtatttccgccgaggcgagaagcggcttctgtgcgaaattcagcggcggaagatctcctcgccggcgtcgtctccgacggcgccggcgacggtttcggtcactgcgccgatgccgttgactgcgataccgatcatatcgccgtcgaactccggcgaggagcangtgacgtcgtcgaactcatcgccggcggagcttctcgacgagaacgagcgactgaggaaagagaacgttcagttaacgaaagagctcgcggagatgagatcgctctgcaacaatatttattctctcatgtcaaattatgcaaacgcc

SEQ ID NO: 2306 - protein, 210 aa, Glycine max
  misc_feature: Ceres Clone ID no. 1641439
  misc_feature (1)..(210): Bit score of 295.5 for HMM based on sequences of FIGURE 19.
  misc_feature (32)..(208): Pfam Name: HSF_DNA-bind Pfam Description: HSF-type DNA-binding
  misc_feature: Functional Homolog Of SEQ ID NO. 1587
  misc_feature (161)..(161): Xaa is any aa, unknown, or other
MAKLPVEYNGDCATTASASASAAAESQRSIPTPFLTKTFQLVDDQSIDDVISWNDDGSTFIVWNPTVFARDLLPKYFKHNNFSSFVRQLNTYGFRKVVPDRWEFSNEYFRRGEKRLLCEIQRRKISSPASSPTAPATVSVTAPMPLTAIPIISPSNSGEEXVTSSNSSPAELLDENERLRKENVQLTKELAEMRSLCNNIYSLMSNYANA

SEQ ID NO: 2307 - DNA, 1492 bp, Panicum virgatum
  misc_feature: Ceres Clone ID no. 1814498
  misc_feature: Encodes the peptide sequence at SEQ ID NO. 2308
agcgagagcccccggccaccaaccaaccaaaccccaagcaagcagccgcgagcccaaatccgccggatcacaccgggcatgcgccgagcccccgccgccgccgccgcagcagcagcagcctgagtaggaggacgaggggggaggctggtctcgggtggggatggaggcgggcggcgggggcgcgtcctcgttgccgccgttcctgagcaagacgtacgagatggtggacgacccggccacggacgccgtggtggcgtggacgccgccggggaccagtttcgtcgtcgccaaccaggccgagttctgcagggatctgctccccaagtacttcaagcacaacaacttctccagcttcgtgcggcagctcaacacctacggcttcagaaaaattgatcctgagcaatgggagtttgcaaatgaggatttcattaggggacaacggcaccgactgaaaaatatacataggcgcaaacccatattcagtcactcatcacacaatcaggtttctgcaccgttagcagatcatgaaaggcgggaatatgaagaggaaatcgagaagctcaagtgcgagaatgcagatctcatctcagagcttgaaaagaatgcggaaaagaaacttgatatggagagacgaatgcaggagctggataataagttgatatctttggaggatcggcaaaagaatctgatagcttatgtcagagatattgtacgggcaccaggatttcgctctagctttgtgcagcaaactgatcatcacggaaagaaaaggagactactaatacctgcttctctccaccaagatgcaaataccgaggggaatcagattgtgcatgggggcttaacgaacccaccagtttacagagaatcatttgacaaaatggagtcttccttgaactcattggagaatttctttcgagaagcaagtgaagcatttgatatttcatatgatgatggtgtcccgggaccttcatctgccattgttatcacagagctccattcatctggagaaagtgatcctgttgtaccatcacctccatcaaggatgcatacctcttcagctggtgcaggagattcactctcaaggatgcatacctcttcagctggtgcaggagattcgctctcttctcatgacgtatcagggtcaactagctgcgcagaaagtcctcccctccctcaaatgcagtcctgtacagattcacgagctaaggtgtctgagatcgatgttaatcttgagcctgctattacagaaactggtccatcaagggatcaacctgccgaggaccatccaagtttagcacctgcaaatgatggcttttgggagcaatttcttactgagcagcctggttccaatgcacatcagggggtccaatcagaaaggcgagatggagacagtaaagatgatcggacgagaacaggagatcaggaaaacttatggggggggaaagaagaatgtggaacagatgacagaaaaactgggggcatctcacct

SEQ ID NO: 2308 - protein, 444 aa, Panicum virgatum
  misc_feature: Ceres Clone ID no. 1814498
  misc_feature (1)..(444): Bit score of 209.4 for HMM based on sequences of FIGURE 19.
  misc_feature (12)..(194): Pfam Name: HSF_DNA-bind Pfam Description: HSF-type DNA-binding
  misc_feature: Functional Homolog Of SEQ ID NO. 1587
MEAGGGGASSLPPFLSKTYEMVDDPATDAVVAWTPPGTSFVVANQAEFCRDLLPKYFKHNNFSSFVRQLNTYGFRKIDPEQWEFANEDFIRGQRHRLKNIHRRKPIFSHSSHNQVSAPLADHERREYEEEIEKLKCENADLISELEKNAEKKLDMERRMQELDNKLISLEDRQKNLIAYVRDIVRAPGFRSSFVQQTDHHGKKRRLLIPASLHQDANTEGNQIVHGGLTNPPVYRESFDKMESSLNSLENFFREASEAFDISYDDGVPGPSSAIVITELHSSGESDPVVPSPPSRMHTSSAGAGDSLSRMHTSSAGAGDSLSSHDVSGSTSCAESPPLPQMQSCTDSRAKVSEIDVNLEPAITETGPSRDQPAEDHPSLAPANDGFWEQFLTEQPGSNAHQGVQSERRDGDSKDDRTRTGDQENLWGGKEECGTDDRKTGGISP

SEQ ID NO: 2309 - DNA, 1963 bp, Panicum virgatum
  misc_feature: Ceres Clone ID no. 1862704
  misc_feature: Encodes the peptide sequence at SEQ ID NO. 2310
ctcgccacccaaatattccgcggagaacccacccactcgctgcctgcaatcgcctccccatccccacccccccgcgcgggcctcctaaccctagtcctcgtcccgtccccccatggcggcgtgaacggccgccgtacggatcgcgcgggatatgcagggcggtgtcgcggctgctgccgctgctgctgcggcggccgcggcgacggtgaccacggcggtggcgcctccagtggccccggcccctgcggccgcgaccgctcacgcggcggtgggtaacggcggggcggccaccgcgccgccgccgcccttcctcatgaagacctacgagatggtcgacgacccggccacggacgacgtcgtgtcctggggccccgggaacaacagcttcatcgtctggaacacgcccgagttcgccagggacctcctgcccaagtacttcaagcacagcaacttctcctccttcgtcaggcagctcaacacatatgggtttagaaaggttgatccagacagatgggaatttgcaaatgagggttttctgagaggacaaaaacatctattgaagactatcaacagaaggaaaccatcgttgcaggggaacagccagccgcagcagccccaattgcagaacgctcctttgccagcctgtgttgaggtcggtaaatttgggctggaggaagagatagaacggctgaaaagggataagaatgttcttatgcaagagcttgtcaggctgagacagcaacagcagacaactgaccatcagctgcagactttggggaagcgtcttcaagggatggagtcacggcagcaacagatgatgtctttcctggccaaagcaatgcaaagtcctggtttcctagcacagttcgtacagcaaaatgagaacagcaggaggagaatagtagccgtgaacaagaagaggaggctgcccaagcaagatgacggcctagactctgaaagtgcttctgcctcattggacggtcaaattgtcaagtatcagcctatgatcaacgaagctgccaaagcaatgctgaggaagatcctaaagctagatgtttcacatagatttgaatctgtgggcaattcagataattttctactggagaattatctgccagccgctcaaggttttgacagctcttcgtcgaccagaaattctggagtaacccttgcagaggttccagctaactcaggtttgccgtatgtggctgcgagctctgggctttcagctatctgttcgtcttcagtggctcctgaaatccagtgtccagttgttttggacaacagctcatccaaccaagttcccaacatgagtgttgtgcctcctgtttcaaagcctatagcaccagggagtgatatcactattccggaattcccagatctggctgacatagtatctgatgactctgatattcctggaggaccctttgggatgcctggacctgagtttcccctggccgaagagggtgatgacagtgtccccatcgagactgatgagattttgtacaatgatgagactcagaagctgccagcaattgtcgattccttctgggagcagttcctggttggcagccctctatctgttgataacgatgaagttgattcaggtgtactagatacaagggagacactaccggagaatggatggaaaaaagtggagcacgtggctaaccttacggaacagatgggccttctatcaccaaatcacagggggtgagatgtattatcctaaggtaggctggtaataagctttggaagcgtcgcctgccctttttgttaatgtttaagattgtccttattgctgaaatgatatgctgatatatcaaccactcaacctatatgcggggggattcaatgttccacccatgaatgatcttggtacgctccaggaattcacctgcttgtatctaggtttggcaggcttgagaacagaacaatggtaacttgtcaaatctgcatgatc

SEQ ID NO: 2310 - protein, 521 aa, Panicum virgatum
  misc_feature: Ceres Clone ID no. 1862704
  misc_feature (1)..(521): Bit score of 413.4 for HMM based on sequences of FIGURE 19.
  misc_feature (51)..(226): Pfam Name: HSF_DNA-bind Pfam Description: HSF-type DNA-binding
  misc_feature: Functional Homolog Of SEQ ID NO. 1587
MQGGVAAAAAAAAAAAATVTTAVAPPVAPAPAAATAHAAVGNGGAATAPPPPFLMKTYEMVDDPATDDVVSWGPGNNSFIVWNTPEFARDLLPKYFKHSNFSSFVRQLNTYGFRKVDPDRWEFANEGFLRGQKHLLKTINRRKPSLQGNSQPQQPQLQNAPLPACVEVGKFGLEEEIERLKRDKNVLMQELVRLRQQQQTTDHQLQTLGKRLQGMESRQQQMMSFLAKAMQSPGFLAQFVQQNENSRRRIVAVNKKRRLPKQDDGLDSESASASLDGQIVKYQPMINEAAKAMLRKILKLDVSHRFESVGNSDNFLLENYLPAAQGFDSSSSTRNSGVTLAEVPANSGLPYVAASSGLSAICSSSVAPEIQCPVVLDNSSSNQVPNMSVVPPVSKPIAPGSDITIPEFPDLADIVSDDSDIPGGPFGMPGPEFPLAEEGDDSVPIETDEILYNDETQKLPAIVDSFWEQFLVGSPLSVDNDEVDSGVLDTRETLPENGWKKVEHVANLTEQMGLLSPNHRG

SEQ ID NO: 2311 - DNA, 1689 bp, Gossypium hirsutum
  misc_feature: Ceres Clone ID no. 1917953
  misc_feature: Encodes the peptide sequence at SEQ ID NO. 2312
agagaatttcaagtctctgtttttctgattttctttttgtagaaaatacaataaggtaaagttatgatcttgtttcgattccagaaagtaaaagcttggtgttgttactaatggaaactgatacgatcaaaccctgcgataacgtcgttcattctcgattcttccgttctggattttattgctggggttgggaattcttgactgctctgcttctctttagttgttctgcctaaaaacgaccaggtttttcaatttgttcttcctttttacttttgtaatcataattctttgttagaatcttttttttggggggtttacgtgtactttgggagggatttgatcaatcggaaagtcggaaaatatggcgcaaaggtcagttccggcgccgttcttgatcaaaacgtaccagctggtggatgatccgaccaccgacgatgtgatttcatggaatgaaaacggcacgtcttttgtcgtttggaaaactgctgattttgcaaaagatttgcttcccaattatttcaagcacaacaacttttccagctttgtccgtcagctcaacacttacggattccgaaaggttgttccagacaaatgggaattcgcgaacgagaacttcaagcgaggacaaaaagagctcttgtccgacatccgtcgccggaagacggtgacaacatcgccggctaataatcccgcgaacgggaaaacgtctggtgcgagagcttcctcccctactaactccggtgaggacctagggtcaacttccacgtcgacatcaccggaatcgaagaatccgggatcggtggaaacgacgccggcagcgaacacgaatcagtacgccgatctatcagacgagaacgagaagctgaagaaggataatgagatgttgagctcggagctggcgcaagccaagaagcaatgcgacgaactggtcgcgtttttaaccgagtgcgtgaaggtggggcccgatcaaatagatcgcatcatgcggcaaggaaacggtggttccacccttgaaggcgacgatcttggccgtttctacggcgtcgatgacaacgacgatgatgaaaaaggcggcggcgaagatggaaacggaagtttgaaactgtttggggtgtggttgaaaagcgcgggaaaaaagcgggcccgcgaggagaaaattgtgtacggtgggccacacgctaaagagatgaagaccattgattttcgccacgtggctttgatgatgaagagcggcaaggtttgcaactgagcctatcaccggttctcatcgatagcaaggaagttgatttcgtacaaatataactaggattaaataaaaaagtttttttattttggataattatttaatatatgggtggaagtgttttcttaactttagaagcgtggtaaaaaaattgtcaaatgtatttaattaatatttaaaaataaaaatatataattagatacatgacaatcttttaatcatacttataaaatttaaaaattccaccttaagtccatctattttataattttagtaacaatatggaagtaaatattttttagaaataaaaaaaaaacattctaaagttaggtgggtcaattagtcagcaattgtgggaggcaaaaatcaaaggcaaatgggtccttcaactttgccctgttgttacaaaattgttgtttatatgtttaatagattgttctactttt

SEQ ID NO: 2312 - protein, 295 aa, Gossypium hirsutum
  misc_feature: Ceres Clone ID no. 1917953
  misc_feature (1)..(295): Bit score of 375.7 for HMM based on sequences of FIGURE 19.
  misc_feature (7)..(210): Pfam Name: HSF_DNA-bind Pfam Description: HSF-type DNA-binding
  misc_feature: Functional Homolog Of SEQ ID NO. 1587
MAQRSVPAPFLIKTYQLVDDPTTDDVISWNENGTSFVVWKTADFAKDLLPNYFKHNNFSSFVRQLNTYGFRKVVPDKWEFANENFKRGQKELLSDIRRRKTVTTSPANNPANGKTSGARASSPTNSGEDLGSTSTSTSPESKNPGSVETTPAANTNQYADLSDENEKLKKDNEMLSSELAQAKKQCDELVAFLTECVKVGPDQIDRIMRQGNGGSTLEGDDLGRFYGVDDNDDDEKGGGEDGNGSLKLFGVWLKSAGKKRAREEKIVYGGPHAKEMKTIDFRHVALMMKSGKVCN

SEQ ID NO: 2313 - DNA, 884 bp, Gossypium hirsutum
  misc_feature: Ceres Clone ID no. 1924338
  misc_feature: Encodes the peptide sequence at SEQ ID NO. 2314
ttcaccaaaacccaaaaggaaacaactcggaaaatggacccaactgcaccctccgcgtcggtcgtcggcggcggctgtggtggtggcggaggagggccggcacctttccttataaaaacatacgacatggtagacgactcatcgaccgacgacatcgtttcatggagttctaacaaaaagagctttgtggtttggaaccctcctgattttgctcgccttttgcttcccacttatttcaagcacaataatttctccagctttatcaggcagcttaatacctatgggttccggaaaattgatcccgaacgatgggaatttgccaatgaagattttgtgaaagatcaaaggcatcttcttaagaatattcatcgaagaaaacctattcacagccatagtaatccacagggttctttgatagatcatgaaagagctggatacgaagaagaaattgaaaagctttcacgtgagaaagctgcacttgaggctgatgttttgaggtctgaacaagagcggtcatctttgaagcatcaggtggaagagctgacacaacaagctgatcaaatggagcgtaggcaagagactttgtttaacttcttagaaaaggctttacaagaccctgctttmggcccgaacatctttttcgtmgaattgaatctatggatgatgttgctgcatatgmataagcmaaaggagactgccataggattcatcaatccattccctgtggccgacctttgcattttcgactggaccagttgatctacactctagtttggaaatgttgtccacctggatatctatgaacgagcttatactacaatgctcatcacctgtttctgctattatctcggattctcacatcccgcaatgatctaatgcatacg

SEQ ID NO: 2314 - protein, 241 aa, Gossypium hirsutum
  misc_feature: Ceres Clone ID no. 1924338
  misc_feature (1)..(241): Bit score of 138.6 for HMM based on sequences of FIGURE 19.
  misc_feature (22)..(188): Pfam Name: HSF_DNA-bind Pfam Description: HSF-type DNA-binding
  misc_feature: Functional Homolog Of SEQ ID NO. 1587
  misc_feature (197)..(197): Xaa is any aa, unknown, or other
  misc_feature (204)..(204): Xaa is any aa, unknown, or other
  misc_feature (216)..(216): Xaa is any aa, unknown, or other
  misc_feature (218)..(218): Xaa is any aa, unknown, or other
MDPTAPSASVVGGGCGGGGGGPAPFLIKTYDMVDDSSTDDIVSWSSNKKSFVVWNPPDFARLLLPTYFKHNNFSSFIRQLNTYGFRKIDPERWEFANEDFVKDQRHLLKNIHRRKPIHSHSNPQGSLIDHERAGYEEEIEKLSREKAALEADVLRSEQERSSLKHQVEELTQQADQMERRQETLFNFLEKALQDPAXGPNIFFXELNLWMMLLHMXKXKETAIGFINPFPVADLCIFDWTS

SEQ ID NO: 2315 - DNA, 1619 bp, Zea mays
  misc_feature: Ceres Clone ID no. 229513
  misc_feature: Encodes the peptide sequence at SEQ ID NO. 2316
gccaaatcgaaggagattgaacgaagcagcccagccaaattcccctcgccgccccgtcccttctcgacatttcttgtcccgtcgtcgcctcaatctcgaagcctctccggcggagccgcctcatcatgttccgaaggcctccaaccaaacatcctctagggtttccgcatcgtccgtcgcgatgggcttcacgaagcggtcgccccagcatcccgcctccccagccggcggcgaggtcggcgcccagacggcagggaaggtcacaccagtgccggcggcgccggagtcggcgcccgcggcggtggtgccgaggcctccggacgtggcgcccttcctgaccaaggtctacgacatggtctccgacccggccaccgacgcggtcatctcctggagcgccgccggcggcagtttcgtgatctgggactcgcacgctttcgagcgcgacctgctgccgcggcacttcaagcacaatcacttcaccagcttcatacgccagctcaacacctacggatttcataaagttgatccagatagatgggaatgggccaatgaaggctttgttaagggccaaaaacatcttttgaagaccatcaagagaaagaagaaatcctctcaggatgtacctagtgatctgcagtcggtgcctgtcaaaactgcacctggcactgagaatatcgagataggaaaatatggaggccttgaaaaggaggttgagacacttaagagggacaaggcccttctaatgcagcagcttgtagatctacggcagtaccagcaatcatctagcgctgaagtgcagaatttaattcaacgcctccgtgtgatggagcagaaccagcagcagatgatggcacttttggcaattgttgtccagaatccagacttcctgaaccagctcgtgcagcagcagcgcaggagtaactggtggaatgatgatggtaacaggaaaagaaggttccaagctctggaacatggtcctgtagatgaccaagagacttctggtggaggcgcacaaattattcaatatcgtcctcctgttcctgaaacttccaatcagccaataccagcaaatgaagctttctattcaacccctgcacaaccagcttcaagccctgcacttgagatgcccatggatgtagagatgacttcaaacaatgttaatacctttgattcaactggcaatgattttactgacacctctgctctatgtgaatggtatgacatggatatatttggtgatgaacttgagcacattcttcaacagccagagcaggactttcaagtggaccctcctttaacagttgaggattatggttatgatcatccacggttagagcaggactatcagatggaagcacaacagaattgcaaaaatcctcaatatgttgcctgtgtcttgaagcaaagggaaagccatgcatctgatgtccattagtactgatcagtttgagctgatgtcataactgaagcatgagcggtggtcccccagaatgttgtccagtaacattagtggatagagatttgtgatgaacagaatcttgagactggcaggttagccaccattgggaacctgaagaccgtcgggattgctcagaattcagtatactaatactaatact

SEQ ID NO: 2316 - protein, 417 aa, Zea mays
  misc_feature: Ceres Clone ID no. 229513
  misc_feature (1)..(417): Bit score of 160.6 for HMM based on sequences of FIGURE 19.
  misc_feature (49)..(226): Pfam Name: HSF_DNA-bind Pfam Description: HSF-type DNA-binding
  misc_feature: Functional Homolog Of SEQ ID NO. 1587
MGFTKRSPQHPASPAGGEVGAQTAGKVTPVPAAPESAPAAVVPRPPDVAPFLTKVYDMVSDPATDAVISWSAAGGSFVIWDSHAFERDLLPRHFKHNHFTSFIRQLNTYGFHKVDPDRWEWANEGFVKGQKHLLKTIKRKKKSSQDVPSDLQSVPVKTAPGTENIEIGKYGGLEKEVETLKRDKALLMQQLVDLRQYQQSSSAEVQNLIQRLRVMEQNQQQMMALLAIVVQNPDFLNQLVQQQRRSNWWNDDGNRKRRFQALEHGPVDDQETSGGGAQIIQYRPPVPETSNQPIPANEAFYSTPAQPASSPALEMPMDVEMTSNNVNTFDSTGNDFTDTSALCEWYDMDIFGDELEHILQQPEQDFQVDPPLTVEDYGYDHPRLEQDYQMEAQQNCKNPQYVACVLKQRESHASDVH

SEQ ID NO: 2317 - DNA, 1408 bp, Zea mays
  misc_feature: Ceres Clone ID no. 292275
  misc_feature: Encodes the peptide sequence at SEQ ID NO. 2318
gtaatctcaatcgtatcgtccacctcaacaaaccttcgtccacgcttcgactcctgcaggagtgagggagagagtgatggagaggtgcgggagctgggactgcgacgcggcggcagcgcagaaggcggtaccggcgccgttcctgaccaagacgtaccagctggtggacgacccggccacggaccacatcgtctcctggggggacgaccgggtctccaccttcgtggtctggcgcccgccggagttcgcgcgcgacatcctccccaactacttcaagcacaacaacttctcctccttcgttcgacagctaaacacctacgggttccggaaggtcgtcccggagcggtgggagttcgggaacgagttcttccggaagggggagaagcagctgctgtgcgagatccaccggcggaagacgtcgacgtccgcggctccgccgtcgcctccgccattcttcgcggcgcctcacttcccgctcttccacccggacgccccgcaccaccaccaccaccaccagttcgtggggggaggagacgacggggctgtggcggccgcgcacgtcggcggcgtcggcgtcgccctcgcgttcccgcacccgcattgttggagggagccgccgcactccgccgcgccggtagccacgcggctgctagccctgggcgcggctcctccggcgccgtcgtccccgctgccggccgccgatgccggcggaggcgggcgcgcggccgtgctggtggaggagaacgagcggctgcggcgcagcaacgcggcgctgctgcaggagctggcgcacatgcgcaagctgtacaacgacatcatctacttcgtgcagaaccacgtgcgccccgcggcgcccagccctgccgcggccgcgttcctgcagggcctcggcctgcaggcgcgcaagaagcccgccgcggggccgctcaaccactccggtgggagcaccacgtccagcagctcgctcaccatcgcggaggaggagccctcgcccccgcccccgccgcagcaggccgacaagagcgccggaagcagcggcactgcgcggtctgccgccgaccgcgcgccgcccaccatgctcttcggagtgcacctcagcgccgcgcgaggcagcaagaggccggcttccccggaggaagaagacgaccagtcgcccacgtcgcctgctgggaagccacggctggcgctggagtgcgccggcttgagcctggccgtcgcggtgccctccgccggcgcctcgtcccctgctagcactagctagctaagctcactcaccttgcgcgcaacctgacgcgcgtttgcatgctgctgcatgcaaacgcaacggcgggcgtggccgttttgttgttctagctctagtttgatcgacgtgttccatttgaaccggtagatccagatgggttctctc

SEQ ID NO: 2318 - protein, 394 aa, Zea mays
  misc_feature: Ceres Clone ID no. 292275
  misc_feature (1)..(394): Bit score of 240.1 for HMM based on sequences of FIGURE 19.
  misc_feature (19)..(271): Pfam Name: HSF_DNA-bind Pfam Description: HSF-type DNA-binding
  misc_feature: Functional Homolog Of SEQ ID NO. 1587
MERCGSWDCDAAAAQKAVPAPFLTKTYQLVDDPATDHIVSWGDDRVSTFVVWRPPEFARDILPNYFKHNNFSSFVRQLNTYGFRKVVPERWEFGNEFFRKGEKQLLCEIHRRKTSTSAAPPSPPPFFAAPHFPLFHPDAPHHHHHHQFVGGGDDGAVAAAHVGGVGVALAFPHPHCWREPPHSAAPVATRLLALGAAPPAPSSPLPAADAGGGGRAAVLVEENERLRRSNAALLQELAHMRKLYNDIIYFVQNHVRPAAPSPAAAAFLQGLGLQARKKPAAGPLNHSGGSTTSSSSLTIAEEEPSPPPPPQQADKSAGSSGTARSAADRAPPTMLFGVHLSAARGSKRPASPEEEDDQSPTSPAGKPRLALECAGLSLAVAVPSAGASSPASTS

SEQ ID NO: 2319 - DNA, 1627 bp, Triticum aestivum
  misc_feature: Ceres Clone ID no. 615781
  misc_feature: Encodes the peptide sequence at SEQ ID NO. 2320
aagaaattctcgccccccaacccaacccccaaccaaccaaccaaacccaaccgaagaagccgagccgaaccccactccgccgatcagccgctatgcgctgaggccgaatcgccgcagcccgaggaggagaagggggtggaggggatggaggggagtggcgggtccgcgtcgctgccgccgttcctcaccaagacgtacgagatggtggacgagccggccacggacgcggtggtggcgtggacgccgtccggcaccagcttcgtcgtcctcagccaggccgacttctgccgggatcttctccccaagtacttcaagcacaacaacttctccagcttcgtgcgccagctcaacacctacggctttaggaaggtagatccagaacaatgggaatttgcaaatgaagaattcctacgagatcagcggcatcggttgaaaaatatccatagacgcaagccaatattcagccattcatcacacactcagggtgccggaccattagctgatagtgaaaggagggactatgaggaggaaattgagaggctcaagtgtgataatgcatcactaaatttacagcttgagaggaagaaaactgatatggagagtaaaatgaaggctttggaagacaaactatttgctattgaggatcagcagaaaaatcttatatcttatgtcagagaaattgtgaatgcacctggatttctttctagcttcgtagaacaatctgatcatcatggaaagaagaggagactgcctaaaccaatttcattccatgatgatgcttgtactcaggggaaccagattatgcattgtgacttggtcaactcaccagctcatgaactttttaggtcatcatttgacaaaatggaatcatccttaaattccttggagaatttcttcaaagaagcgagtgaggcatttggtaatgatgtttcatctgatggtgatgtcccaggtcattcttcagctgttgttcttacagagctccattcaactggggagagtgacccccacgcgcaatcacctccgtccatgatgcatacttgttcagctggtgtaggagattcacactcttctcgtgatatagcagagtccgccagctgtccagagagtcctctgcttccccaagctcattctcgtgcagattcacgagctaaggtctccgagatagatgtcaatttagaacctgctgttacagaaaatggtccatcgagagatcaacaacccacccaagaccttcctgctgacgcaaatgatggattttggcagcagtttcttaccgagcagcctgggttgacccatgcacaccaggaggcccaatcagaacggcgagacagagaagcaaatcaaacaacagcaggagaccgcggaagtttttggttggacaagagcagcatcgaacagatgacaaaaaaactggggcatctcacctcagctgagaaaacctgagtatgtatttctcatttcttgtagctgaaaatgaccagtacagaaacattaggaccatggcacctcccagtgaggtatgcctgctaacatttactttgcagtgtatcagaattgtgtgtgttagattgttgcagactatgtgctatatactaccttgatatacgttcatactttgttagcg

SEQ ID NO: 2320 - protein, 433 aa, Triticum aestivum
  misc_feature: Ceres Clone ID no. 615781
  misc_feature (1)..(433): Bit score of 177.4 for HMM based on sequences of FIGURE 19.
  misc_feature (11)..(173): Pfam Name: HSF_DNA-bind Pfam Description: HSF-type DNA-binding
  misc_feature: Functional Homolog Of SEQ ID NO. 1587
MEGSGGSASLPPFLTKTYEMVDEPATDAVVAWTPSGTSFVVLSQADFCRDLLPKYFKHNNFSSFVRQLNTYGFRKVDPEQWEFANEEFLRDQRHRLKNIHRRKPIFSHSSHTQGAGPLADSERRDYEEEIERLKCDNASLNLQLERKKTDMESKMKALEDKLFAIEDQQKNLISYVREIVNAPGFLSSFVEQSDHHGKKRRLPKPISFHDDACTQGNQIMHCDLVNSPAHELFRSSFDKMESSLNSLENFFKEASEAFGNDVSSDGDVPGHSSAVVLTELHSTGESDPHAQSPPSMMHTCSAGVGDSHSSRDIAESASCPESPLLPQAHSRADSRAKVSEIDVNLEPAVTENGPSRDQQPTQDLPADANDGFWQQFLTEQPGLTHAHQEAQSERRDREANQTTAGDRGSFWLDKSSIEQMTKKLGHLTSAEKT

SEQ ID NO: 2321 - DNA, 1892 bp, Triticum aestivum
  misc_feature: Ceres Clone ID no. 925997
  misc_feature: Encodes the peptide sequence at SEQ ID NO. 2322
tttgaggccacgcgcccggcgcgcgatctagaaccttccacagccttcccgacgcctcccgacgcgcgcgcactgtacggacgggtatttagcactgcggccgccactccaccccgccgcccgacgaaattcacccaccgtctccctcatttctttacccacccgcccaccatttctttaccacacgacaaagatctatcccgccgccttcgattccacccgagatatcccgcgattccagccgagcttcagcgggagcagagttggcgggggtcatggaggcggcggtggcggggggcgttgtgaaggaggaggagctgctgctgcacgaggagcagccgccggcggggccgcagcagcaggacggggcgctgccgcggccgatggaggggctgcacgaggccgggccgccgccgttcctcaccaagacgtacgacctggtggaggacccggccacggaccaggtcgtgtcatggggccgcgccggcaacaccttcgtcgtctgggacccgcacgtcttcgccgaggcactgctcccgcgcctcttcaagcactccaacttctccagcttcgtccgccagctcaacacctatggattcagaaaggttgatcctgacagatgggagtttgcaaatgaaggtttccttaggggtcagaggcatcttctcaagatgatcaagagaaggaagccgccatccaacgcgccctcatcgcagcagcaggccctcacatcttgcctggaggttggcgagtttggatttgaggaagagattgacaggctcaagcgcgacaagaacctcttgatcacagaggtagtgaagctaaggcaggagcagcaagctactaaggataacgtgcaagccatggaaggcaggctacgagctgctgaacagagacaggcccagatgatggggttcttggcaagagcaatgcgtaacccacacttcttccaacaattagtccagaagcaagataagaggaaggagcttgaggatgccatctcgaagaaaagaaggcggcctatagacaatgctccattttatggtcccgcggcgacaacaagtcagagcgagcaacttgattcacagttcctgtttgattctggtgtcctcagtgaacctggaatgaatgggatggagaatttagcgcagaacattcaggagcttgggcagggcaaaacagacgaggagaagaaggatgaagctaatgggcagttggatatcaacaacgatttctgggcagagctattttctgatgattttggagacggagacgggtctgggctgtcagagttggagggaaggagacctgaagatatcgacgaactggcacagcagttggggtatctgagttctactagcccgcagtagagttttgttcacagtggttcacttcaaccaacaaacattgcttcttcagtactactattgcagatcatcttgaacaacctgatttagttgattggtggcaacatgactggctatctgaggtgttccataccggagattggaccgtgttgatggcacctctgggtagagagtagaagctgaagactaattgctgcgtcgcttgatggagacccatgacgtgtattgaatgggtacctaaactcgcaactctgaagaagatggtccagatcgtcgacattcggttggtcttgagctggtgttcagcagcagtagctgtggaagtgtgttactgtatatactcgttgggtgaagttttgttgtggaagtctggtctgtagtcagccgttggcatctgggtgtgggtttacccatttctcctgctgctgtccatttgccaatttaccttacttttagggcctgtgtcctgtgtgatgattggtagtgtatgctggaacctctgttatattgagataataaatgttc

SEQ ID NO: 2322 - protein, 364 aa, Triticum aestivum
  misc_feature: Ceres Clone ID no. 925997
  misc_feature (1)..(364): Bit score of 221.3 for HMM based on sequences of FIGURE 19.
  misc_feature (46)..(215): Pfam Name: HSF_DNA-bind Pfam Description: HSF-type DNA-binding
  misc_feature: Functional Homolog Of SEQ ID NO. 1587
MEAAVAGGVVKEEELLLHEEQPPAGPQQQDGALPRPMEGLHEAGPPPFLTKTYDLVEDPATDQVVSWGRAGNTFVVWDPHVFAEALLPRLFKHSNFSSFVRQLNTYGFRKVDPDRWEFANEGFLRGQRHLLKMIKRRKPPSNAPSSQQQALTSCLEVGEFGFEEEIDRLKRDKNLLITEVVKLRQEQQATKDNVQAMEGRLRAAEQRQAQMMGFLARAMRNPHFFQQLVQKQDKRKELEDAISKKRRRPIDNAPFYGPAATTSQSEQLDSQFLFDSGVLSEPGMNGMENLAQNIQELGQGKTDEEKKDEANGQLDINNDFWAELFSDDFGDGDGSGLSELEGRRPEDIDELAQQLGYLSSTSPQ

SEQ ID NO: 2323 - protein, 489 aa, Picea sitchensis
  misc_feature: Public GI ID no. 116787265
  misc_feature (1)..(489): Bit score of 238.2 for HMM based on sequences of FIGURE 19.
  misc_feature (65)..(244): Pfam Name: HSF_DNA-bind Pfam Description: HSF-type DNA-binding
  misc_feature: Functional Homolog Of SEQ ID NO. 1587
MVECGVLMCVCVGVFCRSLIMDSQNSGISAGDEVNLGNFNVKEEESMQMPRCPRPMEGLHCAGPPPFLTKTYDMVEDPLTDTVVSWSSTNNSFVVWNSHLFSSDLLPKYFKHNNFSSFVRQLNTYGFRKVDPDRWEFANEGFLRGQKHLLKLIQRRKPSCPPQFIDNLHHHHQQDQQQGMGACVEVGQFGMVGEIEGLRRDKSVLMLEVVKLRQQQQSTRNQLQTIGHRLQSTEQRQQHMMTFLARAIQNPTFLAQLSQNKQASKRLATSKKRRRLPKGEAQQDLPSFPASEGRIVKYQSSTSTPADSDHTQNSSNLEAFLSTMGHVDSPDMPTPHKTFQDREQDESSSSISMIAEQLYGFEPGSAFDISMPVDIPIETASAFDRNSVNLVGAEGEEDLDLENVNDVFWEELLNEHFDSQDDSGTEAEANFPDQDKGNFSSSSRSDVNLLAEQMGLTAFHQSIPIIPEKLIALESGLVSHSNLKNPSYF

SEQ ID NO: 2324 - protein, 368 aa, Populus balsamifera subsp. trichocarpa
  misc_feature: Public GI ID no. 118488115
  misc_feature (1)..(368): Bit score of 313.5 for HMM based on sequences of FIGURE 19.
  misc_feature (22)..(248): Pfam Name: HSF_DNA-bind Pfam Description: HSF-type DNA-binding
  misc_feature: Functional Homolog Of SEQ ID NO. 1587
MALMLDNCEGILLSLDSHKSVPAPFLTKTYQLVDDPATDHIVSWGEDDTTFVVWRPPEFARDLLPNYFKHNNFSSFVRQLNTYGFRKIVPDRWEFANEFFKKGEKHLLCEIHRRKTAQPQVAINQHHHHQHHPHSPFGVNGPSFFPFSSRTSISPSDSDEQANNNWCDSPPLTSPPRGVASATVIGGGGGYNSSVFALSEDNERLRRSNNMLMSELAHMKKLYNDIIYFVQNHVKPVAPSNSYSSSLLLCGPAPYATANPVTSNGSLAQKPLNQLLGYYPTTAPNNPKQAPQVHVLNSPTTTSQSSLTFLEEANNNGCKTKLFGVPLHSKKRLHPEYGSNPGNMETNKARMVLDKDDLGLNLMPPSRC

SEQ ID NO: 2325 - protein, 306 aa, Carex stenophylla subsp. stenophylloides
  misc_feature: Public GI ID no. 151303349
  misc_feature (1)..(306): Bit score of 155.8 for HMM based on sequences of FIGURE 19.
  misc_feature (32)..(202): Pfam Name: HSF_DNA-bind Pfam Description: HSF-type DNA-binding
  misc_feature: Functional Homolog Of SEQ ID NO. 1587
MDPVKVKNEVLVQPAHGPAPGPMESLHEGGPPPFLRKTYEIVDDPSTNQVVSWGPAGNSFVVWDPHQFATTLLPRYFKHGNFSSFVRQLNTYGFRKIDPDKWEFANEGFFHGQRNLLKSIKRRKSPANISAIQQSQPLDQCLELGQFGPEQEIDRLKRDKNTLIAEVIKLRQEHIVTRSHVQAMEEKLEDAEKKQHQVMGFLARAMQNPTFLQQLAQQHEKRKEIEEAISKKRRRPIEAGSSSTQCPPLFGEIGTGAGAFREDGELENDFWEELLQDEMVKEEADVENDVEALARQLGYMTSHRPE

SEQ ID NO: 2326 - protein, 352 aa, Vitis vinifera
  misc_feature: Public GI ID no. 157336541
  misc_feature (1)..(352): Bit score of 199.0 for HMM based on sequences of FIGURE 19.
  misc_feature (36)..(203): Pfam Name: HSF_DNA-bind Pfam Description: HSF-type DNA-binding
  misc_feature: Functional Homolog Of SEQ ID NO. 1587
MNPPVRGSSSSYPDEPLIAASQRPQPMEGLHDIGPPPFLNKTYDLVDDPSTDSIVSWSIGNNSFVVWDPQIFAGNLLPRYFKHNNFSSFVRQLNTYGFRKVDPDRWEFANEEFLRGQKPLLKKIKRKKALQPYTSQQAVGPSVEVERFGLDGEVDHRRRDKEVLMMELVKLRRQQQDTRAYLQAMEQRIKGTELKLKQMMNFWAKVIKNPSIIQKLVQQSRTKELESALTKKRRLIDEVPTYVEAPGEGTSVKIEPHDYDDISAFEVSELDTLAMDMEGLSKTGKKPGNEQIEKEEMKLESGNKALDIGIWEEFLNEELEGDMGLLGTVGGDDEEDVNVLVDQLCDLVSSPV

SEQ ID NO: 2327 - protein, 415 aa, Vitis vinifera
  misc_feature: Public GI ID no. 157339031
  misc_feature (1)..(415): Bit score of 144.1 for HMM based on sequences of FIGURE 19.
  misc_feature (12)..(186): Pfam Name: HSF_DNA-bind Pfam Description: HSF-type DNA-binding
  misc_feature: Functional Homolog Of SEQ ID NO. 1587
MVKSTEAGSVVPPFLKKCYEMVDDEASDAIISWNLSNDSFVIRDTTEFSHQLLPKYFKHNNFSSFMRQLNIYGFRKIDTDHWEFANEGFIRGQKHLLKNIRRRKQLQGQDKQKSSHQRDKSAGACEEIEASKLWNDVEILKTDRNALTQQLVKLRQHQETAESKLLVLRERLQGMEKNQQQMLSFLVMAMQSPEFLVQFMQPKEKNWRMAEVGKNMLERRAENGEPAASDVMIVRYQPPMDETPKPLPIPTSNSEKSLESDGMIVRYQPPMDETAKPLLMAKSNSEKSLESDFFMNIDFMKILMDGNMGSSEHQEPLILPDLPDDDILDQLLLENFADAKLDNQQAPIDSGMVMDPTVNQTQLDEPQHFELLNLEQKMPLKRMEKPYELEVESTLHGTRFEKSQHSELLTEQMGQ

SEQ ID NO: 2328 - protein, 361 aa, Vitis vinifera
  misc_feature: Public GI ID no. 157339268
  misc_feature (1)..(361): Bit score of 209.0 for HMM based on sequences of FIGURE 19.
  misc_feature (27)..(194): Pfam Name: HSF_DNA-bind Pfam Description: HSF-type DNA-binding
  misc_feature: Functional Homolog Of SEQ ID NO. 1587
MGSSSSSSSSPGFAPHPLEGLHEVGPPPFLTKTFDMVEDPATDSVVSWSRARNSFIVWDSHKFSTTLLPRYFKHSNFSSFIRQLNTYGFRKVDPDRWEFANEGFLGGQKHLLKNIKRRRHVSQNTQQGGLGACVELGQYGLEDELERLKRDRNVLMAEIGKLRQQQQNSRNELVAMEGRMQNTEKKQMQMMTFLAKALNNPSFVQQFIQQRRELRGAEIGRKRRLTTSQSAENLQEVITVASIDQAFSYTNQDDGDMSGIESEIETFFSGGWDNESSEDIKDPKADSIDNNLGSVNDVIWEELLSDDLIAGNEEEVPPLRLGDHHEPETDVEVEDLVATPSDWGEDFQDLVDQMAFLRSKS

SEQ ID NO: 2329 - protein, 496 aa, Vitis vinifera
  misc_feature: Public GI ID no. 157341912
  misc_feature (1)..(496): Bit score of 617.7 for HMM based on sequences of FIGURE 19.
  misc_feature (33)..(209): Pfam Name: HSF_DNA-bind Pfam Description: HSF-type DNA-binding
  misc_feature: Functional Homolog Of SEQ ID NO. 1587
MEGASGSSSAVNSGGGGGGAPPPHPIPNSNAPPPFLSKTYDMVDDPATNSIVSWSPTNNSFVVWNPPEFARDLLPKYFKHNNFSSFVRQLNTYGFRKVDPDRWEFANEGFLRGQKHLLRSINRRKPAHGHNLQQPQQSHSQGSSVGACVEVGKFGLEEEVERLKRDKNVLMQELVRLRQQQQTTDNQLQTMVQRLQGMEQRQQQMMSFLAKAVQSPGFLAQFVQQQNESNRRITEANKKRRLKREDTAEGEHSAAPSDGQIVKYQPLMNEATKAMLRQMVKMDTSAFSNDSDNFLIGDVSSSSNGVEKGGSSTCVSGVTLQEVPPTSLPVASGVPSHDPPSAPISEIQSPPDICALVGAQEAVPISIALPDVILPELSQIPEMLPKSIVDIHKDDYVGPQSGNVEFMDPISLGIDGAMPIDIDNISADPDIDALLDASSNFWEDLLVDNDEVESTPLEDTTKGNEMQPSENGWDKAQHMAKLTEQMGLLTSDTKRI

SEQ ID NO: 2330 - protein, 398 aa, Vitis vinifera
  misc_feature: Public GI ID no. 157342621
  misc_feature (1)..(398): Bit score of 143.2 for HMM based on sequences of FIGURE 19.
  misc_feature (68)..(233): Pfam Name: HSF_DNA-bind Pfam Description: HSF-type DNA-binding
  misc_feature: Functional Homolog Of SEQ ID NO. 1587
MESVEVKEESMWVEVEDSGELWGSSVAAKEEKMLEADGGGESGWCCSSLAAAAEVAKPMEGLHEAGPPPFLKKTFEMVEDPETDSVVSWSVARNSFIVWDSHNFSQSLLPKYFKHSNFSSFIRQLNTYGFRKIDSDRWEFANEAFQGGKRHLLKNIKRRRHGCLQQQGSRSGAESVKLQLEAEVESLRKDQNILNVEILRMRQRQETSQNHLTAVEERIRGAECKQKQMFIFMAKAVKNPSFVQQLIQKRQKRELGDGEIGKKRRLASMLSVGSLLEAIFSNQTVHYRNQNLVQEEPSLQSEIQSLFCSGIDDESGGSPPEDQEANVISGTGNPDLLSFNNGMLEKLMEEDPICQNEAEELLSGKPSILDFELEEWIEKPVDWSVYVKELMEPQFGCV

SEQ ID NO: 2331 - protein, 285 aa, Vitis vinifera
  misc_feature: Public GI ID no. 157343210
  misc_feature (1)..(285): Bit score of 328.3 for HMM based on sequences of FIGURE 19.
  misc_feature (22)..(210): Pfam Name: HSF_DNA-bind Pfam Description: HSF-type DNA-binding
  misc_feature: Functional Homolog Of SEQ ID NO. 1587
MAFTVDKCEEMVFSVESQKAVPAPFLTKTYQLVDDPHTDHIVSWGEDETTFVVWRPPEFARDLLPNYFKHNNFSSFVRQLNTYGFKKIVADRWEFANEYFRKGGKHMLSEIHRRKTPHHHHQPYHDHHQPPQFLQPELENSVWIDSPLPSPTASSDVLTALTQDNHRLRRKNFMLLSELAHMKTLYNDIIFFIQNHVKPVAPYDQRPKSNAAPKLIELDSSLQSPNVSGMQTPKHRYSAGNCSMSTLTDDQQTNNGSFKLFGVPLSGKKRLHPEKFDPEELQCPY

SEQ ID NO: 2332 - protein, 442 aa, Vitis vinifera
  misc_feature: Public GI ID no. 157344554
  misc_feature (1)..(442): Bit score of 346.6 for HMM based on sequences of FIGURE 19.
  misc_feature (13)..(182): Pfam Name: HSF_DNA-bind Pfam Description: HSF-type DNA-binding
  misc_feature: Functional Homolog Of SEQ ID NO. 1587
MEASQSTSSNSPPPFLTKTYEMVDDPITDSIVSWSQAGHSFVVWNPPEFAKDLLPKYFKHNNFSSFVRQLNTYGFRKADPEQWEFANEEFIRGQRHLLKNIHRRKPIHSHSTQNQVGSAPLPESEKQEFEAEIERLKHDKGALLSELQRYKQENQFFEFQTQSLGKRVFNMELRQRKMMAYLAQVLQKPGFTSSLMAQSEIHNKKRRLLMPNYLFNEANVEENMVVTFQKEKPDTISVQGENVEMIESLESSLNFWENFLYGIGQGSADVMDGFGTLSQPSPLIITEMHSSSDPDTSTQPCSPKSYPSSPHSRDIHSSPELARATNHADSPAISSIYLNIDGCPKSLRIDVNSEPTNASEVEASKECEGGTTAAGANDVFWAQFLTETPGSSDAQEVQSERRDAYGGKGDSKPDDHRKYWWDTNNLDHLTKKMGHLTSSERT

SEQ ID NO: 2333 - protein, 531 aa, Vitis vinifera
  misc_feature: Public GI ID no. 157346270
  misc_feature (1)..(531): Bit score of 164.9 for HMM based on sequences of FIGURE 19.
  misc_feature (98)..(265): Pfam Name: HSF_DNA-bind Pfam Description: HSF-type DNA-binding
  misc_feature: Functional Homolog Of SEQ ID NO. 1587
MNPRDNPYLDRKESPPPPYQSEAPAAEAVQPKTEPFSVGSQPFPSGSPLLQIRPISSLEPPFSGEPIVTVGVAAEAEAEAEEIGAPQPLDCLQDNPIPPFLSKTFDIVDDVLLDPIVSWGPTGESFVVWDPVEFSRLVLPRNFKHNNFSSFVRQLNTYGFRKIDSDKWEFANEGFMRGKRHLLKNIRRRKSPQSQHTGSYAGPSSEIAMSGLESEVERLRKQKSLLMQEVIELQQQHSGTIHQMEVVNERIQAAEKRQKKMVSFLAKLLQNPEFLARLLPKDDQKDIGVPRMMRKFVKHQKLEPGKSDSSMGGQIVKYRPGSENLITSSLFPPSNPDSCEQFPNDCLQVIAGKLDLGMESVPFGTRKVSSDELAAVAHKLIEAPEQVREETASLGPVGLVFKGKNLVSSQPEGSTNYNLSFIDDSTKEKAFPEFLSPGIDGIIKQADIWSMGFDDSADMTSSCGELWGNVTNYDVPDLGLTGGISDIWDLGSLQAAEGLGIDKWPSDESTFNEPENQADQPKDYTSKNTYP

SEQ ID NO: 2334 - protein, 361 aa, Vitis vinifera
  misc_feature: Public GI ID no. 157348009
  misc_feature (1)..(361): Bit score of 244.4 for HMM based on sequences of FIGURE 19.
  misc_feature (39)..(207): Pfam Name: HSF_DNA-bind Pfam Description: HSF-type DNA-binding
  misc_feature: Functional Homolog Of SEQ ID NO. 1587
MNPMYPVKEEFPGSSSSPQSGEPPVVPQPVEGLHDAGPPPFLTKTFDIVDDPASDHVVSWSRAGSSFVVWDPHAFSTNLLPKNFKHNNFSSFVRQLNTYGFRKIDPDRWEFANEGFIRGQRHLLKNIRRRKTPSQAPPPHQALDPCVEVGRFGLDGEVDRLQRDKHVLMMELVKLRQQQQNTRITLQAMEQRLQGTEIKQQQMMNFLARAMQNPAFIQQLVQQKERRKEIVEAISKKRRRPIDQGTSGAGGTESSHGNGLRNPIKIEPLHFTEGNGFEVSELEALAFEMQGLGRPRKELEDHEELDPPESEDKELDEGFWEELLNERFGCPSSLPGAEGEEEEEDVNVLAGRFGYLGSSPQ

SEQ ID NO: 2335 - protein, 389 aa, Vitis vinifera
  misc_feature: Public GI ID no. 157354692
  misc_feature (1)..(389): Bit score of 372.2 for HMM based on sequences of FIGURE 19.
  misc_feature (12)..(184): Pfam Name: HSF_DNA-bind Pfam Description: HSF-type DNA-binding
  misc_feature: Functional Homolog Of SEQ ID NO. 1587
MDESPGSSNSPPPFLTKTYEMVDDPTTDSIVSWSQTNKSFIVWNPEDFSRDLLPRFFKHNNFSSFIRQLNTYGFRKIDSEQWAFANEDFIRGQPHLLRNIHRRKPVHSHSIQNQKGQGTSCPLSESDREGYRADIERLKHDKGALLLELQRHKEDRQGLELQMQHLKDRLQHMEQRQQTVISYLARMLQKPGLALSFLPSMETHNRKRRLLTSNCFYDESDVEENRIATSHTVNTEKLDATSVLELVEFLESSLSSWEDILDEFRPTSGTLIHPWSISYIQLNIDTRSKSTGIDMNCKPAATAPEVTTLKEQVVGAASPVPTGVNDVFWEQFFTENPDSSAEEVQLERKDDESRKNEGKHGDHGRFWWNARSANKLADQMGQLTPAERT

SEQ ID NO: 2336 - protein, 305 aa, Vitis vinifera
  misc_feature: Public GI ID no. 157357193
  misc_feature (1)..(305): Bit score of 581.2 for HMM based on sequences of FIGURE 19.
  misc_feature (23)..(227): Pfam Name: HSF_DNA-bind Pfam Description: HSF-type DNA-binding
  misc_feature: Functional Homolog Of SEQ ID NO. 1587
MAPLPVEQTGESLAGESQRSLPTPFLTKTYQLVDDPAVDDLISWNEDGSTFIVWRPAEFARDLLPKYFKHNNFSSFVRQLNTYGFRKVVPDRWEFANDYFRKGEKALLRDIQRRKISPMAAAAATTVTVAAVLPVVARAVSPTNSGDEQVLSSNSSPATVPVTVHRTSSCSSTPEILEENERLRRENSQLTQELTQLRGLCNNILALMTNYAAGQIDAGGIPEGRPLDLLTERQLPVEAGQSGVKAEGDLSPRLFGVSIGVKRVRRDEEEESEKEAQTQQQEVKSEPLDGSSDHHQDPPWLELRS

SEQ ID NO: 2337 - protein, 262 aa, Vitis vinifera
  misc_feature: Public GI ID no. 157360768
  misc_feature (1)..(262): Bit score of 350.7 for HMM based on sequences of FIGURE 19.
  misc_feature (19)..(204): Pfam Name: HSF_DNA-bind Pfam Description: HSF-type DNA-binding
  misc_feature: Functional Homolog Of SEQ ID NO. 1587
MSRPPVEQSGGESQKSLPTPFLTKTYQLVEDRTVDDVISWNEDGSAFVVWNTAVLARDLLPKYFKHNNFSSFVRQLNTYGFRKVVPDRWEFSNDCFRRGEKRLLCDIQRRRISSTAPISPVSSSNCADERLISSNSPPATTTTPHATSNTAGLIDENERLRKENVELNRELNRMKTLCNNIFALISSNYTNNIFGNVSQTDKPLNRFPEKQFSSEMMIEEEMTPRLFGVAIGAKRAREGEGGFGGRPGSGTGTPTALVGGEI

SEQ ID NO: 2338 - protein, 285 aa, Brassica rapa
  misc_feature: Public GI ID no. 157849714
  misc_feature (1)..(285): Bit score of 303.7 for HMM based on sequences of FIGURE 19.
  misc_feature (8)..(203): Pfam Name: HSF_DNA-bind Pfam Description: HSF-type DNA-binding
  misc_feature: Functional Homolog Of SEQ ID NO. 1587
MAAQRSVPAPFLSKTYQLVDDQSTDDVVSWNEDGTAFVVWKTAEFAKDLLPQYFKHNNFSSFIRQLNTYGFRKTVPDKWEFANDNFRRGQEELLSEIRRRKAVIAAAGKCVVVGSPSESNSAGDDHGSSSTSSPGSKHPGSVENMVADLSGENEKLKRENSSLSSELAAAKRQRDELVAFLTEQMKVGPEQIDQMIKGGGKKLKPAVEEEESDCEGCGGDNGGAAVEGEKGVAGEGLKLFGVWVKGERKKRGRDEKNFVVGGSHMTEIKNVDFHAPLWKSSKVCN

SEQ ID NO: 2339 - protein, 459 aa, Oryza sativa subsp. indica
  misc_feature: Public GI ID no. 166787940
  misc_feature (1)..(459): Bit score of 206.1 for HMM based on sequences of FIGURE 19.
  misc_feature (19)..(187): Pfam Name: HSF_DNA-bind Pfam Description: HSF-type DNA-binding
  misc_feature: Functional Homolog Of SEQ ID NO. 1587
MESSNLGGGGGGGGGGGPPPFLIKTYEMVEDAATNHVVSWGPGGASFVVWNPLDFSRDLLPKYFKHNNFSSFIRQLNTYGFRKIDPERWEFANEDFIRGHTHLLKNIHRRKPVHSHSLQNQINGPLAESERRELEEEINRLKYEKSILVADLQRQNQQQYVINWQMQAMEGRLVAMEQRQKNIVASLCEMLQRRGGAVSSSLLESDHFSKKRRVPKMDLFVGDCAAGEEQKVFQFQGIGTDAPAMPPVLPVTNGEAFDRVELSLVSLEKLFQRANDACTAAEEVYSHGHGGTEPSTAICPEEMNTAPMETGIDLQLPASLHPSSPNTGNAHLHLSTELTESPGFVQSPELPMAEIREDIHVTRYPTQADVNSEIASSTDTSQDGTSGTEASHGPTNDVFWERFLTETPRSCLDESERQESPKDDVKAELGCNGFHHREKVDQITEQMGHLASAEQTLHT

SEQ ID NO: 2340 - protein, 267 aa, Physcomitrella patens subsp. patens
  misc_feature: Public GI ID no. 168011201
  misc_feature (1)..(267): Bit score of 252.4 for HMM based on sequences of FIGURE 19.
  misc_feature (43)..(208): Pfam Name: HSF_DNA-bind Pfam Description: HSF-type DNA-binding
  misc_feature: Functional Homolog Of SEQ ID NO. 1587
MGGETQWPSAEAKEKNGIPPPAGGTASGNPTSQMDAPQSSGPPPFLTKTFEMVDDPATDAIVSWSEVGSSFVVWNTPEFAQELLPKYFKHNNFSSFVRQLNTYGFRKVDPDRWEFANEGFLRGRRDLLRSIHRRKPSSHAQQQQGAYVEGGKSGLEAEIERLKTDKNVLMLELARVRQQQQSTFRDLQLMAQRLHVSESRQQRMITFLAKAMANPSLFAQFVSQQNESNHLVRKKRRLPIQEDGDMDESMSPESSIENQIVTYQPSE

SEQ ID NO: 2341 - protein, 252 aa, Physcomitrella patens subsp. patens
  misc_feature: Public GI ID no. 168015654
  misc_feature (1)..(252): Bit score of 246.9 for HMM based on sequences of FIGURE 19.
  misc_feature (28)..(193): Pfam Name: HSF_DNA-bind Pfam Description: HSF-type DNA-binding
  misc_feature: Functional Homolog Of SEQ ID NO. 1587
GKLALAAGIASANPAPQMDAPPQSSGPPPFLIKTYEMVEVSATDAIVSWSEVGNSFVVWNPPEFAQDLLPKYFKHNNFSSFVRQLNTYGFRKVDPDRWEFANEGFMRGKRDMLRSIRRRKPAVHTQQQQGSCVEVGKLGLEGEIERLKRDKNVLMLELVRLRQQQQSTERELQVMTQRFHVSEHRQQRMISFLTKAMQNPSFFAQFVSQQNENNQVVRKKRRLPIHEYGDMHESMSPESSIENQMVAFQPSE

SEQ ID NO: 2342 - protein, 268 aa, Physcomitrella patens subsp. patens
  misc_feature: Public GI ID no. 168027726
  misc_feature (1)..(268): Bit score of 225.7 for HMM based on sequences of FIGURE 19.
  misc_feature (57)..(236): Pfam Name: HSF_DNA-bind Pfam Description: HSF-type DNA-binding
  misc_feature: Functional Homolog Of SEQ ID NO. 1587
MVSQVVKTDPHWPPLEESMGQERYSLNSDVVPSSSVPGFHNLSAPQPMDGLQSTAPPPFLTKTYDMVDDPATDPVVSWSTGHNSFIVWNPPDFAQELLPKYFKHNNFSSFVRQLNTYGFRKVDPDRWEFANEGFLRGRRDLLRTIHRRKPATHSQQSAQQQQQHQQTDQGSVGPCVEVGKFGLEGEIERLKRDKNVLMMELVRLRQQQQNTERDLQAMGQRLLTTENRQQHMMSFLAKAMQNPSFLAQLMQQSENKRLAATVRKKRRL

SEQ ID NO: 2343 - protein, 230 aa, Physcomitrella patens subsp. patens
  misc_feature: Public GI ID no. 168028001
  misc_feature (1)..(230): Bit score of 213.5 for HMM based on sequences of FIGURE 19.
  misc_feature (11)..(219): Pfam Name: HSF_DNA-bind Pfam Description: HSF-type DNA-binding
  misc_feature: Functional Homolog Of SEQ ID NO. 1587
MLFYDCHRSVPAPFLTKTYHLVNDPATNDIVSWGEDGTTFVVWRPPEFARDLLPNYFKHNNFSSFVRQLNTYGFRKVVPERWEFANDYFRRGERHLLCEIHRRKALQPASGTGSAQQSRSLSPSTSIEDQAWSPISSPMSSPLPISVPTQHPTLPVMSISDENERLRKDNNLLLCEVSRLRRLYEETVSIIHQQYKATPTDFSALTSRYNTIDVSLTVLSRKSFCFQHPS

SEQ ID NO: 2344 - protein, 407 aa, Physcomitrella patens subsp. patens
  misc_feature: Public GI ID no. 168053175
  misc_feature (1)..(407): Bit score of 251.5 for HMM based on sequences of FIGURE 19.
  misc_feature (1)..(173): Pfam Name: HSF_DNA-bind Pfam Description: HSF-type DNA-binding
  misc_feature: Functional Homolog Of SEQ ID NO. 1587
MVDDPATDPVVSWSAGNNSFIVWNPPDFAQELLPKYFKHNNFSSFVRQLNTYGFRKVDPDRWEFANEGFLRGRRDLLRSIHRRKPATHSQQSVQQQQQQQHQQSEQGPVGPCVEVGKFGLEGEIERLKRDKNVLMMELVRLRQQQQNTERDLQAMGQRLLTTENRQQHMMSFLAKAMQNPSFLAQLMQQSENKRLAATVRKKRRLPKQDSSGDDSANSDSPADNQIVAFHSNGNADSNGARAMIMQFFNSTDAASSPSLDSGPLEALFRDLGSAPSGTDVGTLASRQSGVTLTEMNIPGLGDSLPGPVIRSGEIKPDGLSGESMEFNADGGRAPSEGEEVISNLGSPAVSAANDIFWEQFLKTDGDEIVEDSVEVLAGEDVGEVKNWWSKKPSVEQLSVQMGQLAPG

SEQ ID NO: 2345 - protein, 435 aa, Pennisetum glaucum
  misc_feature: Public GI ID no. 169637055
  misc_feature (1)..(435): Bit score of 221.8 for HMM based on sequences of FIGURE 19.
  misc_feature (12)..(176): Pfam Name: HSF_DNA-bind Pfam Description: HSF-type DNA-binding
  misc_feature: Functional Homolog Of SEQ ID NO. 1587
MEAGGGGASSLPPFLSKTYEMVDDPATDAVVAWTPPGTSFVVVNRAEFCRDLLPKYFKHNNFSSFVRQLNTYGFRKVDPEQWEFLNDDFIRGQRHRLKNIHRRKPIFSHSSHPHGSGPLADNERREYEEEIEKLKRDNDALTLELEKNAQKKIDMERRMQELEDKLICLEDRQKNLIAYVRDIVQAPGFRSSFVQQPDHHGKKRRLPIPISLHQDENAEGNQIVHGALTNPLVCIESFDKMESSLNSLENFFREASGAFDISYDGGVPGPSSAVVITELHSSGESDPRVPSPPSRMHTSSAGAGDSLSSHDVTESTSCAESPPLPQMTTFDNSRAKVSEIDVNLEPAITETGPSRDQAPEDSPHPAPGTNDGFWEQFLTEQPGSNTHQEAQSERRDGDNKVDQARIGDRENLWWGKKNVEQMTEKLGHLTSAEKT

SEQ ID NO: 2346 - protein, 408 aa, Zea mays
  misc_feature: Public GI ID no. 194689430
  misc_feature (1)..(408): Bit score of 162.9 for HMM based on sequences of FIGURE 19.
  misc_feature (49)..(226): Pfam Name: HSF_DNA-bind Pfam Description: HSF-type DNA-binding
  misc_feature: Functional Homolog Of SEQ ID NO. 1587
MGFTKRSPQHPASPAGGEVGAQTAGKVTPVPAAPESAPVAVVPRPPDVAPFLTKVYDMVSDPATDAVISWSAGGGSFVIWDSHAFERDLLPRHFKHNHFTSFIRQLNTYGFHKVDPDRWEWANEGFVKGQKHLLKTIKRKKKSSQDVPSDLQSVPVKTAPGTENIEIGKYGGLEKEVETLKRDKALLMQQLVDLRQYQQSSSAEVQNLIQRLRVMEQNQQQMMALLAIVVQNPDFLNQLVQQQRRSNWWNDDGNRKRRFQALEHGPVDDQETSGGGAQIIQYRPPVPETSNQPIPANEAFYSTPAQPASSPALEMPMDVEMTSNNVDTFDSTGNDFTDTSALCEWDDMDIFGDELEHILQQPEQDFQVDPPLTVEDYGYDHPRLEQDCQMEAQQNCKNPQYADVITEA

SEQ ID NO: 2347 - protein, 407 aa, Zea mays
  misc_feature: Public GI ID no. 194693220
  misc_feature (1)..(407): Bit score of 181.0 for HMM based on sequences of FIGURE 19.
  misc_feature (49)..(226): Pfam Name: HSF_DNA-bind Pfam Description: HSF-type DNA-binding
  misc_feature: Functional Homolog Of SEQ ID NO. 1587
MGSKKRSPQHPASPAGGEVGAQAAGKATPVTAAPETAPVAVVPKPPDVAPFLTKVYDMVSDPATDAVISWSAGGGSFVIWDSHVFERDLLPRHFKHNHFTSFIRQLNTYGFHKVDPDRWEWANEGFIKGQKHLLKTIKRKKKSSQDVPSDLQSVPVKTAPGTENIEIGKYGGLEKEVETLKRDKALLMQQLVDLRQYQQTSSLEVQSLIQRLRVMEQNQQQMMALLAIVVHNPDFLNQLVQQQCRSNWWNDDGNRKRRFQALEHGPVDDSETSGGGAQIIQYCPPVPETSNQPTPANEAFCSSPVQSVSSHALEMPMDVEMASNNVGTLDSTGNDFTDTSALCEWDDMDIFGGGLEHILQQTEQDFQVDPLTIEDYGYDRPWLEQDCQVEAQQNCKNPQYADVITEA

SEQ ID NO: 2348 - protein, 408 aa, Zea mays
  misc_feature: Public GI ID no. 194708220
  misc_feature (1)..(408): Bit score of 162.2 for HMM based on sequences of FIGURE 19.
  misc_feature (49)..(226): Pfam Name: HSF_DNA-bind Pfam Description: HSF-type DNA-binding
  misc_feature: Functional Homolog Of SEQ ID NO. 1587
MGFTKRSPQHPASPAGGEVGAQTAGKVTPVPAAPESAPAAVVPRPPDVAPFLTKVYDMVSDPATDAVISWSAAGGSFVIWDSHAFERDLLPRHFKHNHFTSFIRQLNTYGFHKVDPDRWEWANEGFVKGQKHLLKTIKRKKKSSQDVPSDLQSVPVKTAPGTENIEIGKYGGLEKEVETLKRDKALLMQQLVDLRQYQQSSSAEVQNLIQRLRVMEQNQQQMMALLAIVVQNPDFLNQLVQQQRRSNWWNDDGNRKRRFQALEHGPVDDQETSGGGAQIIQYRPPVPETSNQPIPANEAFYSTPAQPASSPALEMPMDVEMASNNVNTFDSTGNDFTDTSALCEWDDMDIFGDELEHILQQPEQDFQVDPPLTVEDYGYDHPRLEQDCQMEAQQNCKNPQYADVITEA

SEQ ID NO: 2349 - DNA, 600 bp, Solanum lycopersicum
  misc_feature: Ceres Annot ID no. 8460826
  misc_feature: Encodes the peptide sequence at SEQ ID NO. 2350
atgtggaaccctaaggatgacgatgattcgtgggaagttagggcttttgaggaagatactgggaattccatgggtgcaacttggccaccaaggttctatacttgcaccttttgtcggagagagttccggtccgcccaagccctaggtggtcacatgaatgtgcaccgtagtgaccgtgtcaggctcaatcaaacaccgtcacatgcttcaaatagctccactattaatttccccaatgccaattctacccttcttatccaaaatcaagaattcatccaaaatggtggactttgctttctttactccatgcctaattattattataataaccctaatcccacaacaattaataaatctagtaatgtagatccctcaaatctcctctccaatatctcaccctttttgacaaacaatttgatgtctccttgcactattccatcttcaaatttccagccccacaacatcagctcttcatcatttaacacaagtgaaccttcagcatctaatagtactagtaacgacaataatcgcgataagaggattgaagatgagattgatcttgagctaaggctaggatggagatcagcaataccaagatga

SEQ ID NO: 2350 - protein, 199 aa, Solanum lycopersicum
  misc_feature: Ceres Annot ID no. 8460826
  misc_feature (1)..(199): Bit score of 160.6 for HMM based on sequences of FIGURE 10.
  misc_feature (33)..(55): Pfam Name: zf-C2H2 Pfam Description:  Zinc finger, C2H2 type
  misc_feature: Functional Homolog Of SEQ ID NO. 907
MWNPKDDDDSWEVRAFEEDTGNSMGATWPPRFYTCTFCRREFRSAQALGGHMNVHRSDRVRLNQTPSHASNSSTINFPNANSTLLIQNQEFIQNGGLCFLYSMPNYYYNNPNPTTINKSSNVDPSNLLSNISPFLTNNLMSPCTIPSSNFQPHNISSSSFNTSEPSASNSTSNDNNRDKRIEDEIDLELRLGWRSAIPR

SEQ ID NO: 2351 - DNA, 663 bp, Zea mays
  misc_feature: Ceres Clone ID no. 100867507
  misc_feature: Encodes the peptide sequence at SEQ ID NO. 2352
tcccgtcggccgtcccaaaagaagcggaaatttacaacccagtccaccacgggccacacaatccccaaatctaacccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccgactggcggcgtcggcgcccggcctggcggagcggttcctcagggccttccggccggcgctgtacgaggtgctggcgtcgacggcgacgacgtgcgaggcggacggcggcggcggcggcgacgactgcagcgtgtgcctggccgggttccgggcgagggccgtggtgaaccgcctcccctgcggccacctcttccaccgcgcctgcctcgagacctggctccggtacgagcgcgccacgtgcccgctctgccgcgcccacgtgcccctccccgccgacgagacgccgctgctccgctacccggagttcgagtgatccggtaaaaacccaccccggtcgcgtcgcgcctcggctgtgtgctgcacgttccgtgtggccttccatctactcctacacccagattgctaaggaggttg

SEQ ID NO: 2352 - protein, 157 aa, Zea mays
  misc_feature: Ceres Clone ID no. 100867507
  misc_feature (1)..(157): Bit score of 173.6 for HMM based on sequences of FIGURE 5.
  misc_feature (96)..(137): Pfam Name: zf-C3HC4 Pfam Description: Zinc finger, C3HC4 type (RING finger)
  misc_feature: Functional Homolog Of SEQ ID NO. 337
MGISSMPEPRDSLLGYLVYNTVISIAALAGLVRAALVFLDLQAALPPGDDGGDRLAASAPGLAERFLRAFRPALYEVLASTATTCEADGGGGGDDCSVCLAGFRARAVVNRLPCGHLFHRACLETWLRYERATCPLCRAHVPLPADETPLLRYPEFE

SEQ ID NO: 2353 - DNA, 1000 bp, Zea mays
  misc_feature: Ceres Clone ID no. 100873442
  misc_feature: Encodes the peptide sequence at SEQ ID NO. 2354
ccgtcggccgtcccaaaagaagcggaaatttacaacccagtccaccacgggccacacaatccccaaatctaacccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccgactggcggcgtcggcgcccggcctggcggagcggttcctcagggccttccggccggcgctgtacgaggtgctggcgtcgacggcgacgacgtgcgaggcggacggcggcggcggcggcgacgactgcagcgtgtgcctggccgggttccgggcgagggccgtggtgaaccgcctcccctgcggccacctcttccaccgcgcctgcctcgagacctggctccggtacgagcgcgccacgtgcccgctytgccgcgcccacgtgcccctccccgccgacgagacgccgctgctccgctacccggagttcgagtgatccggtaaaaacccaccccggtcgcgtcgcgcctcggctgtgtgctgcacgttccgtgtggccttccgtgtacgcgtagcaaaccaaagaagaagaaaaaaaaggtgtaggagcagtagtagtagtgcagggttgctgtcgcttgctttcccctttcgcttyttgtattccccctccctcccattctctttgctgtttccgttccgtgctgtagcctgtagcgtgtaaatactccggttcgcacttggcagcagaggcagagtgtagagtgctcccgtggccgtggctgatggtgtagcacttttttcgagctcagctcgtgtagtacattgcatccttcttcctattcaattttcccccgactggctaaaatatcgaggactgttttggaattggaacggttgtatgtgtgcgtgcagtgcatactgtaataataactc

SEQ ID NO: 2354 - protein, 157 aa, Zea mays
  misc_feature: Ceres Clone ID no. 100873442
  misc_feature (1)..(157): Bit score of 167.4 for HMM based on sequences of FIGURE 5.
  misc_feature (96)..(137): Pfam Name: zf-C3HC4 Pfam Description: Zinc finger, C3HC4 type (RING finger)
  misc_feature: Functional Homolog Of SEQ ID NO. 337
  misc_feature (136)..(136): Xaa is any aa, unknown, or other
MGISSMPEPRDSLLGYLVYNTVISIAALAGLVRAALVFLDLQAALPPGDDGGDRLAASAPGLAERFLRAFRPALYEVLASTATTCEADGGGGGDDCSVCLAGFRARAVVNRLPCGHLFHRACLETWLRYERATCPXCRAHVPLPADETPLLRYPEFE

SEQ ID NO: 2355 - DNA, 981 bp, Zea mays
  misc_feature: Ceres Clone ID no. 101113753
  misc_feature: Encodes the peptide sequence at SEQ ID NO. 2356
cggcagaccaccccgcccagcggccagcttgctcgccacgaccacgatgggcttccccgtggggtactcggagtcggagatgctgctcccgcgcgtgctgctgcaggtgctcctcctcctcggccacttccaccgcttcctcctctgggccttccacgccgtggggctcggcgacctgatcgacctcggctgcaactacccgccgccctccgcgtccacggcgcaggagatgatggagcaccagcaccaggggcgcgacgacgtggcctccccgctgcagcaccagcgcccggagttcaggcccgtcgcggcggcgctcatcgaggaggcgctccccgtggtgcggttcgacgagctgtgcggcgcggcgtgcgggggcggcgactgcgcggtgtgcctgggcggcatcggcggcggcgacgaggtgcggcggctcggcaactgccgccacgccttccaccgggcctgcctggaccgctggatggcgcacgaccagcgcacctgcccgctctgccgcgcgccgctcatcccatgggccgccgacgccgactacgacatgtcctatccgtctcccctgccgcccacgccactgcggcggcctcacgagctgctgctgctgcttaccggcctgggcggcttccagtgatgcgcctgcgcgtgggcagcgtggctggcacttgggcaggccggccacgcgaatccgatccgtggcgaggcaaaccgcgtgctcatgtgcggcccagcacgcccggtcggtcaggcgggtgaccgccgccaaacctgctcagttgccagccgtacacgcttggcctcgtcttcggtcgtgtctccgactccgttggttttttacagaggctcccagtcccaggtcaaacaaaaaaagaggcgaaacagacaaagcactcggaaattaggcaggtactgtactaggttgatctgtaggccgattgggcgactccaaatctgtggagctgtgaatcc

SEQ ID NO: 2356 - protein, 199 aa, Zea mays
  misc_feature: Ceres Clone ID no. 101113753
  misc_feature (1)..(199): Bit score of 141.8 for HMM based on sequences of FIGURE 5.
  misc_feature (114)..(156): Pfam Name: zf-C3HC4 Pfam Description: Zinc finger, C3HC4 type (RING finger)
  misc_feature: Functional Homolog Of SEQ ID NO. 337
MGFPVGYSESEMLLPRVLLQVLLLLGHFHRFLLWAFHAVGLGDLIDLGCNYPPPSASTAQEMMEHQHQGRDDVASPLQHQRPEFRPVAAALIEEALPVVRFDELCGAACGGGDCAVCLGGIGGGDEVRRLGNCRHAFHRACLDRWMAHDQRTCPLCRAPLIPWAADADYDMSYPSPLPPTPLRRPHELLLLLTGLGGFQ

SEQ ID NO: 2357 - DNA, 697 bp, Zea mays
  misc_feature: Ceres Clone ID no. 101145059
  misc_feature: Encodes the peptide sequence at SEQ ID NO. 2358
  misc_feature (443)..(443): n is a, c, t, g, unknown, or other
  misc_feature (500)..(500): n is a, c, t, g, unknown, or other
attcccgtcggccgtcccaaaagaagcggaaatttacaacccagtccaccacgggccacacaatccccaaatctaaccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccgactggcggcgtcgggcccgggactggcggagcggttcctcagggccttccggccggcgctgtacgaggtgctggcgtcgacggcgacgacgtgcgaggcggacggcggcggcggcggcgacgactgcagcgtgtgcctggccgggttccgggcgagggccgtggtgaaccgcctcccctgcggccacctcttncaccgcgcctgcctcgagacctggctccggttcgagcgcgccacgtgcccgctctgncgcgcccacgtgcccctccccgccgacgagacgccgctgctccgctccccggagttcgagtgatccgggtaaaacccaccccggtcgcgttgcgccctcgctgtgtgctgcacgttcccggtgggcctccgtgtccgcgtttccaacctgttttataaaaaataggtgtggagcccgtttggttcggccagggtcgc

SEQ ID NO: 2358 - protein, 157 aa, Zea mays
  misc_feature: Ceres Clone ID no. 101145059
  misc_feature (1)..(157): Bit score of 152.4 for HMM based on sequences of FIGURE 5.
  misc_feature (96)..(137): Pfam Name: zf-C3HC4 Pfam Description: Zinc finger, C3HC4 type (RING finger)
  misc_feature: Functional Homolog Of SEQ ID NO. 337
  misc_feature (118)..(118): Xaa is any aa, unknown, or other
  misc_feature (137)..(137): Xaa is any aa, unknown, or other
MGISSMPEPRDSLLGYLVYNTVISIAALAGLVRAALVFLDLQAALPPGDDGGDRLAASGPGLAERFLRAFRPALYEVLASTATTCEADGGGGGDDCSVCLAGFRARAVVNRLPCGHLXHRACLETWLRFERATCPLXRAHVPLPADETPLLRSPEFE

SEQ ID NO: 2359 - DNA, 717 bp, Glycine max
  misc_feature: Ceres Clone ID no. 1662513
  misc_feature: Encodes the peptide sequence at SEQ ID NO. 2360
atcattccagaaccgtaatctccaaaccccacttcgtcagatactaaaaagaaaccaacagtttccatacttagtatttcttctctgactgactgatcaggttgacatcttgacattgcaatcctgccttttggttccccatttccatgtttgtggattcttcctgattcaaaggcaatatattgtgtcttcatagctcagtttttgagcctcatcagttgcaacttgcaacacaaactttatctataacttggtatctctaaaggactctcagcattgatcaaaatgggcctctctagtctcccagcaccatctgaaggagtattatgtgtccttctggtgaacactgtattgtcaatttccatattcaaaggcattgtaaggacaatcctgcacattgttggcatccatcttccatcatcctccacttcaccctcttcaccagatccctcccaagccgcacctgagtcatttgaattgcatcttagtccctcggagagttacattgaagagttcagaagccggacaccgacacttcggtttgacagtgtgtgctgctctaaacgacttgaacatgactgctctgtatgcctcactcagtttgaacccgaatcagagataaaccgcttatcgtgcggtcatctcttccacaaagtgtgcttggagaagtggctggactactggaacattacatgcccactttgccggactcccttg

SEQ ID NO: 2360 - protein, 144 aa, Glycine max
  misc_feature: Ceres Clone ID no. 1662513
  misc_feature (1)..(144): Bit score of 278.6 for HMM based on sequences of FIGURE 5.
  misc_feature (99)..(140): Pfam Name: zf-C3HC4 Pfam Description: Zinc finger, C3HC4 type (RING finger)
  misc_feature: Functional Homolog Of SEQ ID NO. 337
MGLSSLPAPSEGVLCVLLVNTVLSISIFKGIVRTILHIVGIHLPSSSTSPSSPDPSQAAPESFELHLSPSESYIEEFRSRTPTLRFDSVCCSKRLEHDCSVCLTQFEPESEINRLSCGHLFHKVCLEKWLDYWNITCPLCRTPL

SEQ ID NO: 2361 - DNA, 634 bp, Gossypium hirsutum
  misc_feature: Ceres Clone ID no. 1793564
  misc_feature: Encodes the peptide sequence at SEQ ID NO. 2362
  misc_feature (573)..(573): n is a, c, t, g, unknown, or other
aatagctgaaactacaagccttcctcttctccctcactcctcacacacacacacacacacacacacacacacacatacactgtctgtataatcacgtaaacaaaacctttctctttaattataattcattttcatcttaatttcttcatggggtttccagttggttacaccgaagttttcttaccgaaactcttcgtccacatgctttggtttctgggtttcatccgatgtctaattgttactctttttagctacctcggtctctccgatttcctcgaaccagacactgtttggcaggataaccggacccgaattacacccgagaacccgcccgtatcagctcttctgatccgtgaaatccttcccgtcataaagttcgaggagctcgttgtcgtgggggatccaccggagagttgtgccgtttgcttgtacgagttcgaaggaggtgaagagatcaggtggttgaggaactgtaggcacgttttccatcgggcgtgtttggaccgttggatggaccatgagcagaaaacatgtccgctctgtaggacaccgtttgtgcccgacgagttgcangacgagttcaatcaaagactctgggctgcttccggtgtcggtgatttacacagtgagtacg

SEQ ID NO: 2362 - protein, 162 aa, Gossypium hirsutum
  misc_feature: Ceres Clone ID no. 1793564
  misc_feature (1)..(162): Bit score of 181.5 for HMM based on sequences of FIGURE 5.
  misc_feature (90)..(132): Pfam Name: zf-C3HC4 Pfam Description: Zinc finger, C3HC4 type (RING finger)
  misc_feature: Functional Homolog Of SEQ ID NO. 337
  misc_feature (142)..(142): Xaa is any aa, unknown, or other
MGFPVGYTEVFLPKLFVHMLWFLGFIRCLIVTLFSYLGLSDFLEPDTVWQDNRTRITPENPPVSALLIREILPVIKFEELVVVGDPPESCAVCLYEFEGGEEIRWLRNCRHVFHRACLDRWMDHEQKTCPLCRTPFVPDELXDEFNQRLWAASGVGDLHSEY

SEQ ID NO: 2363 - DNA, 638 bp, Panicum virgatum
  misc_feature: Ceres Clone ID no. 1912347
  misc_feature: Encodes the peptide sequence at SEQ ID NO. 2364
gtggagctgggatcaaccactaacctacacctcttcctccttccccatcgagatgcatccacgttccatacgatgacaacacctgaattgcaatcaggtcgagtgcgcggtcgtcccccgcctgggaggagtacctcgaggacaattccagaattgcccagcggaccctgagggatagggcggtgaggatgggcctctccaccgtgcccacgcccaaggacagcctgggggggttcgtcctgtacgacaccgaggtgtcggtggccatcctggctgggctggtgcgcgcggcgctggtgttcctgggcctggcggcgccgtctccgtgggagggcctcgccgccgacaaccaccaccaccgccgccaggtggtgtcgtctatctcgcccctggggccgagcctcgcggaccggttccggagccggttccccccgtcgcggttcgggcggtggcgcggcggcgccggcgcggactgccgcgtgtgcctggcccggttcgagccggagacggtggtgaaccggctcccctgcgggcacctcttccaccgggcctgcctcgagacctgactggactacgaccacgccacctgcccgctctgccgactccgcctcctctcccccgccgccgccgatgactac

SEQ ID NO: 2364 - protein, 125 aa, Panicum virgatum
  misc_feature: Ceres Clone ID no. 1912347
  misc_feature (1)..(125): Bit score of 152.6 for HMM based on sequences of FIGURE 5.
  misc_feature (96)..(125): Pfam Name: zf-C3HC4 Pfam Description: Zinc finger, C3HC4 type (RING finger)
  misc_feature: Functional Homolog Of SEQ ID NO. 337
MGLSTVPTPKDSLGGFVLYDTEVSVAILAGLVRAALVFLGLAAPSPWEGLAADNHHHRRQVVSSISPLGPSLADRFRSRFPPSRFGRWRGGAGADCRVCLARFEPETVVNRLPCGHLFHRACLET

SEQ ID NO: 2365 - DNA, 658 bp, Miscanthus x giganteus
  misc_feature: Ceres Clone ID no. 2055950
  misc_feature: Encodes the peptide sequence at SEQ ID NO. 2366
gtccacgcatcgccaccgcgccatatctgcaggaagcaccaggccaggcacatcgcctcgcccccaccttccttccccctttcaccaccaccaccgccgcaagccaagaggcacggggcacgccaagggggaagtcagcaaatccggacaagcgctgccccggtcgcagccggcatgggtttcccggtgggctactcggagctggtcctcccgaagcagctgctccacctcctcctgctgctggggtacatccgccgcttcctcctctgggcgttcgacgccgtgggcctcggcgacctgctggatctcggggacgaccaccaggcgctgctgcaggaccaccaccaccaccacggcgacgcccaggggcgggaccacggcgcgctgccgcatcaggcggcggcgatgctgctgcagcagcactgccggccggagttccgggcggtgccggcgatggtcattgaggaggtcctccccgtggtgcggttcgacgagctggaggcgcgcgtcggcggggactgcgccgtgtgcctcagcggcatcggcggcggcgacgaggtgcggcggctcagcaactgccgccacgtcttccaccgcgcctgcctcgaacgctggatggagcacgaacagcgcacctgcccgctctgccgcgcgccgc

SEQ ID NO: 2366 - protein, 161 aa, Miscanthus x giganteus
  misc_feature: Ceres Clone ID no. 2055950
  misc_feature (1)..(161): Bit score of 107.5 for HMM based on sequences of FIGURE 5.
  misc_feature (116)..(158): Pfam Name: zf-C3HC4 Pfam Description: Zinc finger, C3HC4 type (RING finger)
  misc_feature: Functional Homolog Of SEQ ID NO. 337
MGFPVGYSELVLPKQLLHLLLLLGYIRRFLLWAFDAVGLGDLLDLGDDHQALLQDHHHHHGDAQGRDHGALPHQAAAMLLQQHCRPEFRAVPAMVIEEVLPVVRFDELEARVGGDCAVCLSGIGGGDEVRRLSNCRHVFHRACLERWMEHEQRTCPLCRAP

SEQ ID NO: 2367 - DNA, 1078 bp, Zea mays
  misc_feature: Ceres Clone ID no. 323551
  misc_feature: Encodes the peptide sequence at SEQ ID NO. 2368
agtcctccacgcacgcacgcacgcacgaccagttgccacggcagaccaccccgcccagcggccagcttgctcgccacgaccacgatgggcttccccgtggggtactcggagtcggagatgctgctcccgcgcgtgctgctgcaggtgctcctcctcctcggccacttccaccgcttcctcctctgggccttccacgccgtggggctcggcgacctgatcgacctcggctgcaactacccgccgccgccgccctccgcgtccacggcgcacgagatgatggagcaccagcaccagcaccaggggcgcgacgacgtggcctccccgctgcagcaccagcgcccggagttccggcccgtcgcggcggcgctcatcgaggaggcgctccccgtggtgcggttcgacgagctgggcggcgcgccgtgcggcggcggcgactgcgcggtgtgcctgagcggcatcggcggcggcgacgaggtgcggcggctcggcaactgccgccacgccttccaccgggcctgcctggaccgctggatggcgcacgaccagcgcacctgcccgctctgccgcgcgccgctcatcccctgggccgccgacgccgactacgacatgtcctatccgtctcccctgccgcccacgccactgcggcggcctcacgagctgctgctgctgcttaccggcctgggcggcttccagtgatgcgcctgcgcgtgggcagcgtggctggcacttgggcaggccggccacgcgaatccgatccgtggcgaggcaaaccgcgtgctcatgtgcggcccagcacgcccggtcggtcaggcgggtgaccgccgccaaacctgctcagttgccagccgtacacgcttgccggcctcgtcttcggtcgtgtctccgactccgttggtttttttacagaggctcccagtcccaggtcaaacaaaaaaggaggcgaaacagacaaagcagtcggaaattaggcaggtactgtactaggttgatctgtaggccgattgggcgactccaaatctgtggagctgtgaatcctttggcagattaaactaaaaattgtctctatagatcagaccac

SEQ ID NO: 2368 - protein, 203 aa, Zea mays
  misc_feature: Ceres Clone ID no. 323551
  misc_feature (1)..(203): Bit score of 136.1 for HMM based on sequences of FIGURE 5.
  misc_feature (118)..(160): Pfam Name: zf-C3HC4 Pfam Description: Zinc finger, C3HC4 type (RING finger)
  misc_feature: Functional Homolog Of SEQ ID NO. 337
MGFPVGYSESEMLLPRVLLQVLLLLGHFHRFLLWAFHAVGLGDLIDLGCNYPPPPPSASTAHEMMEHQHQHQGRDDVASPLQHQRPEFRPVAAALIEEALPVVRFDELGGAPCGGGDCAVCLSGIGGGDEVRRLGNCRHAFHRACLDRWMAHDQRTCPLCRAPLIPWAADADYDMSYPSPLPPTPLRRPHELLLLLTGLGGFQ

SEQ ID NO: 2369 - DNA, 678 bp, Arabidopsis thaliana
  misc_feature: Ceres Clone ID no. 39850
  misc_feature: Encodes the peptide sequence at SEQ ID NO. 2370
aatcacaatccaaaactctctctctctctctctgtctcttgtcttattatttatctctctaacggcgaggcaatgggttttccggtgggatattctgagctacttctcccaaaaatctttttctacttgttatctttcttaggtttgatacgtaaactcatctccacaatgttcaagatcattggtctaccagatttcttagaacctgaaccggtttcaacctcatggcccgacccaccacccacgttgaccaaacctgactcagcagcaatactagccggagagatgttaccggttgttcgattctcggatataaaccgaccggaatccgagtgttgcgcagtgtgtctctacgatttcgagaacgacgacgagatccgacggctgacgaattgtcgacatatatttcatcggggatgtttggaccgttggatgatgggttataatcagatgacgtgtccactttgtcgtacacagtttatacctgatcatcttcaactggagtttaatcaaaggctctggtctcaatcttctgctgtttcttctcaacttcttgatgaatcatcatcttaggacgtattaaatctttgtccaaacaaaaaaagaaagacatattaaatccttttttttggtactttcattgggaattgggtttggtgtgagatcgatgtaaatatc

SEQ ID NO: 2370 - protein, 166 aa, Arabidopsis thaliana; identical to SEQ ID NO: 367
  misc_feature: Ceres Clone ID no. 39850
  misc_feature (1)..(166): Bit score of 136.3 for HMM based on sequences of FIGURE 5.
  misc_feature (89)..(132): Pfam Name: zf-C3HC4 Pfam Description: Zinc finger, C3HC4 type (RING finger)
  misc_feature: Functional Homolog Of SEQ ID NO. 337

SEQ ID NO: 2371 - DNA, 486 bp, Brassica napus
  misc_feature: Ceres Clone ID no. 953316
  misc_feature: Encodes the peptide sequence at SEQ ID NO. 2372
aacctttattaaaacagagctcactctctctctctctctctctctagctccaatgggcttccccgtaggctacacagaggtcttcctcccgaagctcttcgtacaaacactctcaatcctcagtctcatcagaaccgtcgtcttctccctcttccgcttcttgggcctctccgacttcctcgaaatggaccaaacctggcccgactacacatcttacccgacccgaacacccgagctccgctcccccttctccgccctcctcatccgcgagatcttacccgtcatcaagttcgaagacgtgacgacctcttccggcgaagatctgccggagagctgcgccgtctgcctctacgagttcgaaggagagcaagagatccggtggctgagaaactgcagacatatattccaccggagctgtctcgaccgttggatggatcacgatcragaagacgtgtcctctctgtagaacgccgtktgttccggacg

SEQ ID NO: 2372 - protein, 137 aa, Brassica napus
  misc_feature: Ceres Clone ID no. 953316
  misc_feature (1)..(137): Bit score of 102.7 for HMM based on sequences of FIGURE 5.
  misc_feature (95)..(129): Pfam Name: zf-C3HC4 Pfam Description: Zinc finger, C3HC4 type (RING finger)
  misc_feature: Functional Homolog Of SEQ ID NO. 337
  misc_feature (131)..(131): Xaa is any aa, unknown, or other
MGFPVGYTEVFLPKLFVQTLSILSLIRTVVFSLFRFLGLSDFLEMDQTWPDYTSYPTRTPELRSPFSALLIREILPVIKFEDVTTSSGEDLPESCAVCLYEFEGEQEIRWLRNCRHIFHRSCLDRWMDHDXEDVSSL

SEQ ID NO: 2373 - DNA, 522 bp, Brassica napus
  misc_feature: Ceres Clone ID no. 967713
  misc_feature: Encodes the peptide sequence at SEQ ID NO. 2374
aacctttattactcgcactctctctctagctccaatgggcttccccgtaggctacacagaggtcttcctcccgaagctcttcgtacaaacactctcaatcctcagtttcatcagaaccgtcgtcttctccctcttccgcttcttgggcctctccgacttcctcgaaatggaccaaacctggcccgactacacatctaacccgacccgaacacccgaactccgctcccccttctccgccctactcatccgcgagatcttacctgtcatcaagtttgaagacgtgacaacgacctccggagaagatctgccggagagctgcgcggtttgcctctacgagttcgaaggagagcaagagatccggtggctgagaaactgcagacatatattccaccggagctgtctcgaccgttggatggatcacgaccagaagacgtgtcctctctgtagaacgccgttcgttccagatgagatgcaagaagagtttaatcaacggctgtgggctgcttctggtgttcatgattt

SEQ ID NO: 2374 - protein, 162 aa, Brassica napus
  misc_feature: Ceres Clone ID no. 967713
  misc_feature (1)..(162): Bit score of 193.2 for HMM based on sequences of FIGURE 5.
  misc_feature (95)..(137): Pfam Name: zf-C3HC4 Pfam Description: Zinc finger, C3HC4 type (RING finger)
  misc_feature: Functional Homolog Of SEQ ID NO. 337
MGFPVGYTEVFLPKLFVQTLSILSFIRTVVFSLFRFLGLSDFLEMDQTWPDYTSNPTRTPELRSPFSALLIREILPVIKFEDVTTTSGEDLPESCAVCLYEFEGEQEIRWLRNCRHIFHRSCLDRWMDHDQKTCPLCRTPFVPDEMQEEFNQRLWAASGVHD

SEQ ID NO: 2375 - protein, 189 aa, Picea sitchensis
  misc_feature: Public GI ID no. 116786273
  misc_feature (1)..(189): Bit score of 179.5 for HMM based on sequences of FIGURE 5.
  misc_feature (105)..(146): Pfam Name: zf-C3HC4 Pfam Description: Zinc finger, C3HC4 type (RING finger)
  misc_feature: Functional Homolog Of SEQ ID NO. 337
MGLSSFPTTVSEGVLPILIVNTALSFAIIKDILRSFLQIVGLTTGTEPDFIDPSWPYPPENTPAVSTGHSEAQFIAEEIRQSLPIKRFQSFTDGFVGSDNSHVECAVCLSKFEEGVEIRQLTCCHLFHRPCLDKWLDHQQITCPLCRSCLISEEAAKNIRLREQELTDESVFWCSSFQEAAYHHTWIES

SEQ ID NO: 2376 - protein, 176 aa, Picea sitchensis
  misc_feature: Public GI ID no. 116792920
  misc_feature (1)..(176): Bit score of 98.6 for HMM based on sequences of FIGURE 5.
  misc_feature (111)..(153): Pfam Name: zf-C3HC4 Pfam Description: Zinc finger, C3HC4 type (RING finger)
  misc_feature: Functional Homolog Of SEQ ID NO. 337
MGLSQFPEAWEGGVILFIIIHAALFMAMVRGILICILRKVGFKVYTEPPELAETLWSYAYAEEEASELDSGLAQFAMTAEAIEDRLPVTLFEASSSSSSCSDGDNNGVCGCVVCLRKFHGGEEIRSLPCGHVFHRNCVDKWVLDYENMACPLCRLSPVVNVPAEDDGSYLTEELVM

SEQ ID NO: 2377 - protein, 120 aa, Vitis vinifera
  misc_feature: Public GI ID no. 157339167
  misc_feature (1)..(120): Bit score of 118.2 for HMM based on sequences of FIGURE 5.
  misc_feature (82)..(116): Pfam Name: zf-C3HC4 Pfam Description: Zinc finger, C3HC4 type (RING finger)
  misc_feature: Functional Homolog Of SEQ ID NO. 337
MGLSNFHSPAEGVLPVLVMNTVMSVALLKNMVRSVLQVMGANGSSPNLEEDPSNEEYSPMSENAKERRVSVTQFKSLSHSRFEAEEEVSELSCKHFFHKGCWEKWFDNKHSSCPLCRSIL

SEQ ID NO: 2378 - protein, 167 aa, Vitis vinifera
  misc_feature: Public GI ID no. 157349819
  misc_feature (1)..(167): Bit score of 212.7 for HMM based on sequences of FIGURE 5.
  misc_feature (89)..(131): Pfam Name: zf-C3HC4 Pfam Description: Zinc finger, C3HC4 type (RING finger)
  misc_feature: Functional Homolog Of SEQ ID NO. 337
MGFPVGYTEVFLPKLFLHTLSFLGFIRKLIFSLFHFLGLSDFLETDVSWSETQAQVPEYPPVSAVLIREILPVMKFGEAVCGGDAPESCAVCLYDFEVGEEIRRLTNCKHIFHRSCLDRWMDHDQKTCPLCRTPFVPDEMQDEFNQRLWAASGITDFYSEYGTVSGL

SEQ ID NO: 2379 - protein, 151 aa, Vitis vinifera
  misc_feature: Public GI ID no. 157350973
  misc_feature (1)..(151): Bit score of 288.6 for HMM based on sequences of FIGURE 5.
  misc_feature (96)..(137): Pfam Name: zf-C3HC4 Pfam Description: Zinc finger, C3HC4 type (RING finger)
  misc_feature: Functional Homolog Of SEQ ID NO. 337
MGLSSLPAPSEGVLCVLLVNTALSISIFKGIVRAILHVIGIHLSATPSSSDSPEPTSEPFEFRRNPSETCMEEFRSRNPAIRFDTVCSCKRPEHDCAVCLTRFEPDSEINHLPCGHFFHKVCLEKWLDYWNITCPLCRTPLMPEEETSCFW

SEQ ID NO: 2380 - protein, 133 aa, Arabidopsis thaliana
  misc_feature: Public GI ID no. 186493771
  misc_feature (1)..(133): Bit score of 133.0 for HMM based on sequences of FIGURE 5.
  misc_feature (87)..(129): Pfam Name: zf-C3HC4 Pfam Description: Zinc finger, C3HC4 type (RING finger)
  misc_feature: Functional Homolog Of SEQ ID NO. 337
MGISHYPTASEGVMPMLVMNTVVSVSLVKNMVRSVVNMVSSETNEARNKEDDQDHEDSKRRRRISITHFESLCENRGSRNEREAMDCCVCLCGFKEEEEVSELVSCKHYFHSACLDKWFGNNHTTCPLCRSIL

SEQ ID NO: 2381 - protein, 146 aa, Zea mays
  misc_feature: Public GI ID no. 194704122
  misc_feature (1)..(146): Bit score of 238.6 for HMM based on sequences of FIGURE 5.
  misc_feature (87)..(128): Pfam Name: zf-C3HC4 Pfam Description: Zinc finger, C3HC4 type (RING finger)
  misc_feature: Functional Homolog Of SEQ ID NO. 337
MGISSMPAPEDSLLGFVLYNTAASVAILAGLVRAALLFLGLAAAAEDEEPRQQAEAVTVTAVGPSLADRFRSRFRPSRYGRRRGGDCRVCLVRFETESVVQRLPCGHLFHRACLETWIDYDHATCPLCRHRLLPPAAAADEVPRIA

What is claimed is:

1. A method of modulating a trait in a plant, said method comprising
introducing into a plant cell an exogenous nucleic acid, said exogenous nucleic acid comprising a regulatory region operably linked to a nucleotide sequence encoding a polypeptide comprising the amino acid sequence of SEQ ID NO:1540;
producing a plant from said plant cell; and
selecting a plant for short hypocotyl under low light or SD+EODFR as compared to a control plant that does not comprise said nucleic acid;
wherein said plant otherwise comprises the morphology of a control plant that does not comprise said nucleic acid.

2. The method of claim 1, wherein said nucleotide sequence comprises the nucleotide sequence of SEQ ID NO:1537, SEQ ID NO:1538, or SEQ ID NO:1539.

3. The method of claim 1, wherein said nucleotide sequence comprises the nucleotide sequence of SEQ ID NO:1537.

4. The method of claim 1, wherein said nucleotide sequence comprises the nucleotide sequence of SEQ ID NO:1538.

5. The method of claim 1, wherein said nucleotide sequence comprises the nucleotide sequence of SEQ ID NO:1539.

* * * * *